US008541665B2

(12) United States Patent
Jiang et al.

(10) Patent No.: US 8,541,665 B2
(45) Date of Patent: Sep. 24, 2013

(54) POLYNUCLEOTIDES AND POLYPEPTIDES IN PLANTS

(75) Inventors: Cai-Zhong Jiang, Fremont, CA (US); Jacqueline E. Heard, Stonington, CT (US); Oliver Ratcliffe, Oakland, CA (US); Robert A. Creelman, Castro Valley, CA (US); Luc Adam, Hayward, CA (US); T. Lynne Reuber, San Mateo, CA (US); Jose Luis Riechmann, Pasadena, CA (US); Volker Haake, Berlin (DE); Arnold N. Dubell, San Lorenzo, CA (US); James S. Keddie, San Mateo, CA (US); Bradley K. Sherman, Berkeley, CA (US)

(73) Assignee: Mendel Biotechnology, Inc., Hayward, CA (US)

( * ) Notice: Subject to any disclaimer, the term of this patent is extended or adjusted under 35 U.S.C. 154(b) by 239 days.

(21) Appl. No.: 12/917,303

(22) Filed: Nov. 1, 2010

(65) Prior Publication Data

US 2011/0078806 A1    Mar. 31, 2011

Related U.S. Application Data

(60) Continuation-in-part of application No. 11/642,814, filed on Dec. 20, 2006, now Pat. No. 7,825,296, which is a division of application No. 10/666,642, filed on Sep. 18, 2003, now Pat. No. 7,196,245, application No. 12/917,303, which is a continuation-in-part of application No. 12/077,535, filed on Mar. 17, 2008, now Pat. No. 8,030,546.

(60) Provisional application No. 60/434,166, filed on Dec. 17, 2002, provisional application No. 60/411,837, filed on Sep. 18, 2002, provisional application No. 60/465,809, filed on Apr. 24, 2003.

(51) Int. Cl.
*C12N 15/82* (2006.01)
*A01H 5/00* (2006.01)
*A01H 4/00* (2006.01)
*A01H 5/02* (2006.01)

(52) U.S. Cl.
USPC ........ 800/320.1; 800/298; 800/278; 800/289; 800/287

(58) Field of Classification Search
None
See application file for complete search history.

(56) References Cited

U.S. PATENT DOCUMENTS

| | | | |
|---|---|---|---|
| 5,994,622 A | 11/1999 | Jofuko et al. |
| 6,121,513 A | 9/2000 | Zhang et al. |
| 6,664,446 B2 | 12/2003 | Heard et al. |
| 6,706,866 B1 | 3/2004 | Thomashow et al. |
| 6,717,034 B2 | 4/2004 | Jiang et al. |
| 6,835,540 B2 | 12/2004 | Broun et al. |
| 6,946,586 B1 | 9/2005 | Fromm et al. |
| 7,109,393 B2 | 9/2006 | Gutterson et al. |
| 7,135,616 B2 | 11/2006 | Heard et al. |
| 7,193,129 B2 | 3/2007 | Reuber et al. |
| 7,196,245 B2 | 3/2007 | Jiang et al. |
| 7,223,904 B2 | 5/2007 | Heard et al. |
| 7,238,860 B2 | 7/2007 | Ratcliffe et al. |
| 7,345,217 B2 | 3/2008 | Zhang et al. |
| 7,511,190 B2 | 3/2009 | Creelman et al. |
| 7,598,429 B2 | 10/2009 | Heard et al. |
| 7,601,893 B2 | 10/2009 | Reuber et al. |
| 7,635,800 B2 | 12/2009 | Ratcliffe et al. |
| 7,659,446 B2 | 2/2010 | Sherman et al. |
| 7,663,025 B2 | 2/2010 | Heard et al. |
| 7,692,067 B2 | 4/2010 | Creelman et al. |
| 7,825,296 B2 | 11/2010 | Jiang et al. |
| 7,858,848 B2 | 12/2010 | Reuber et al. |
| 7,868,229 B2 | 1/2011 | Ratcliffe et al. |
| 7,888,558 B2 | 2/2011 | Gutterson et al. |
| 7,897,843 B2 | 3/2011 | Jiang et al. |
| 7,939,715 B2 | 5/2011 | Ratcliffe et al. |
| 7,956,242 B2 | 6/2011 | Zhang et al. |
| 7,960,612 B2 | 6/2011 | Zhang et al. |
| 7,994,394 B2 | 8/2011 | Adam et al. |
| 8,022,274 B2 | 9/2011 | Riechmann et al. |
| 8,030,546 B2 | 10/2011 | Reuber et al. |
| 8,110,725 B2 | 2/2012 | Riechmann et al. |
| 8,283,519 B2 | 10/2012 | Creelman et al. |
| 2002/0076775 A1 | 6/2002 | Crane et al. |
| 2003/0041356 A1 | 2/2003 | Reuber |
| 2003/0061637 A1 | 3/2003 | Jiang et al. |
| 2003/0093837 A1 | 5/2003 | Keddie et al. |

(Continued)

FOREIGN PATENT DOCUMENTS

EP    1033405 A2    6/2000
EP    03779082      7/2007

(Continued)

OTHER PUBLICATIONS

Abe et al (2003, The Plant Cell 15:63-78).*

(Continued)

*Primary Examiner* — Stuart F Baum

(74) *Attorney, Agent, or Firm* — Yifan Mao; Jeffrey M. Libby; Simona Bandong

(57) ABSTRACT

The invention relates to plant transcription factor polypeptides, polynucleotides that encode them, homologs from a variety of plant species, and methods of using the polynucleotides and polypeptides to produce transgenic plants having advantageous properties compared to a reference plant. Sequence information related to these polynucleotides and polypeptides can also be used in bioinformatic search methods and is also disclosed.

Figure 1:
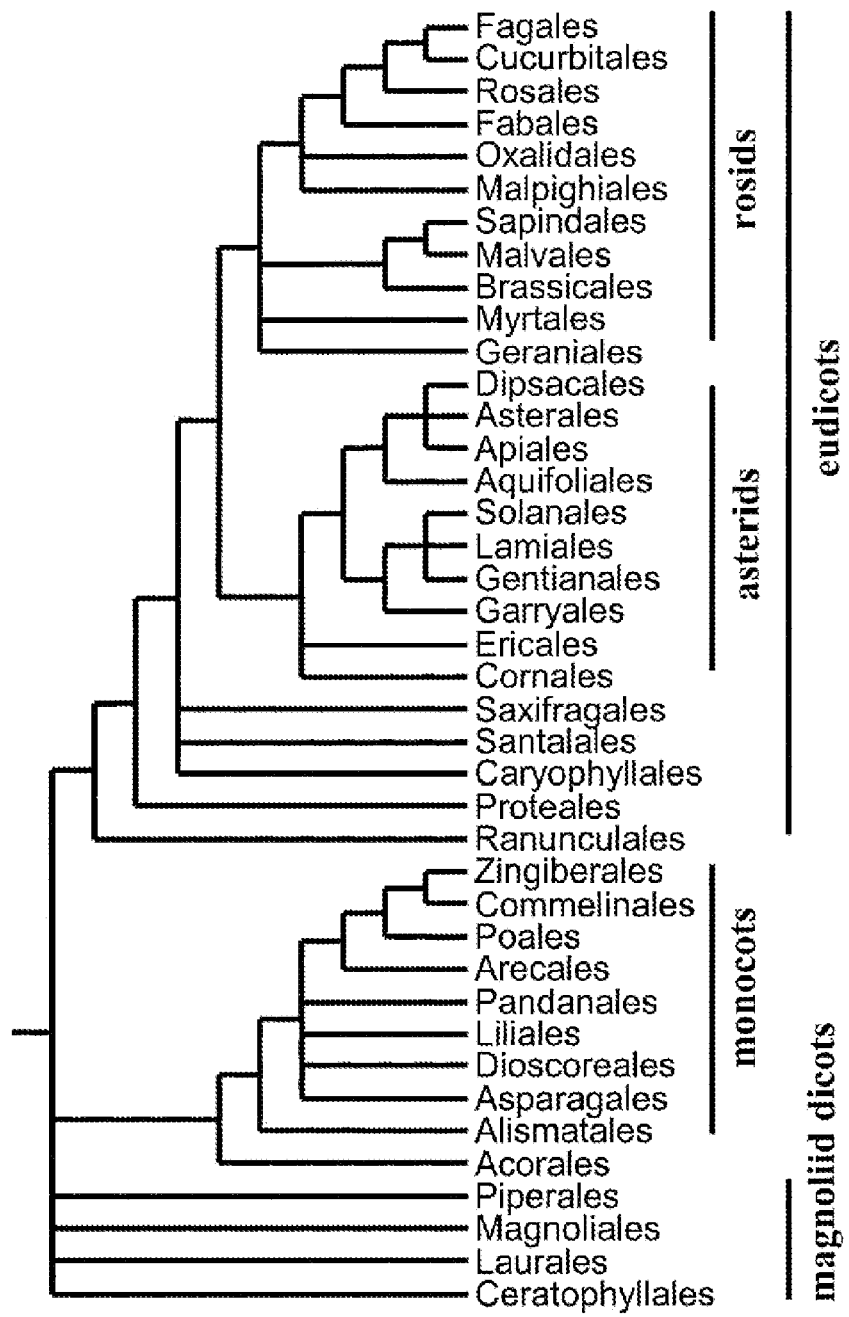

20 Claims, 10 Drawing Sheets (7 of 10 Drawing Sheet(s) Filed in Color)

(56) References Cited

U.S. PATENT DOCUMENTS

| | | |
|---|---|---|
| 2003/0101481 A1 | 5/2003 | Zhang et al. |
| 2003/0121070 A1 | 6/2003 | Adam et al. |
| 2003/0131386 A1 | 7/2003 | Samaha et al. |
| 2003/0188330 A1 | 10/2003 | Heard |
| 2004/0098764 A1 | 5/2004 | Heard et al. |
| 2004/0128712 A1 | 7/2004 | Jiang et al. |
| 2005/0086718 A1 | 4/2005 | Heard et al. |
| 2005/0155117 A1 | 7/2005 | Century et al. |
| 2005/0172364 A1 | 8/2005 | Heard |
| 2006/0015972 A1 | 1/2006 | Heard et al. |
| 2006/0162018 A1 | 7/2006 | Gutterson et al. |
| 2007/0226839 A1 | 9/2007 | Gutterson et al. |
| 2008/0163397 A1 | 7/2008 | Ratcliffe et al. |
| 2008/0229448 A1 | 9/2008 | Libby et al. |
| 2008/0301836 A1 | 12/2008 | Century et al. |
| 2009/0192305 A1 | 7/2009 | Riechmann et al. |
| 2009/0205063 A1 | 8/2009 | Zhang et al. |
| 2009/0265807 A1 | 10/2009 | Kumimoto et al. |
| 2009/0265813 A1 | 10/2009 | Gutterson et al. |
| 2010/0071086 A1 | 3/2010 | Repetti et al. |
| 2010/0083395 A1 | 4/2010 | Reuber et al. |
| 2010/0083402 A1 | 4/2010 | Heard et al. |
| 2010/0107279 A1 | 4/2010 | Ratcliffe et al. |
| 2010/0162427 A1 | 6/2010 | Riechmann et al. |
| 2010/0175145 A1 | 7/2010 | Heard et al. |
| 2010/0223689 A1 | 9/2010 | Ratcliffe et al. |
| 2010/0255584 A1 | 10/2010 | Cao et al. |
| 2011/0010796 A1 | 1/2011 | Repetti et al. |

FOREIGN PATENT DOCUMENTS

| | | |
|---|---|---|
| EP | 03779082 | 9/2007 |
| EP | 03779082.1 | 1/2008 |
| EP | 03779082.1 | 9/2009 |
| WO | 02/15675 A1 | 2/2002 |
| WO | 03/013227 A2 | 2/2003 |
| WO | 2004/031349 A3 | 4/2004 |
| WO | 2004/076638 A2 | 9/2004 |
| WO | 2005/001050 A2 | 1/2005 |
| WO | 2006/076099 A2 | 7/2006 |
| WO | 2008/005210 A3 | 1/2008 |

OTHER PUBLICATIONS

Bowie et al, Science 247:1306-1310, 1990.*
McConnell et al, Nature 411 (6838):709-713, 2001.*
Bailey, P.C. et al.; "Update on the Basic Helix-Loop-Helix Transcription Factor Gene Family in *Arabidopsis thaliana*"; Letter to the Editor; The Plant Cell; vol. 15; pp. 2497-2501; Nov. 2003.
Heim, M. A. et al.; "The Basic Helix-Loop-Helix Transcription Factor Family in Plants: A Genome-Wide Study of Protein Structure and Functional Diversity"; Mol. Biol. Evol.; vol. 20(5): pp. 735-747; 2003.
Kang, H. et al.; "Characterization of Salicylic Acid-Responsive, *Arabidopsis* Dof Domain Proteins: Overexpression of OBP3 Leads to Growth Defects"; The Plant Journal; vol. 21(4); pp. 329-339; 2000.
Kang, H. et al.; "Target Genes for OBP3, a Dof Transcription Factor, Include Novel Basic Helix-Loop-Helix Domain Proteins Inducible by Salicylic Acid"; The Plant Journal; vol. 35, pp. 362-372; 2003.
Kranz, H. D.; "Towards Functional Characterisation of the Members of the R2R3-MYB Gene Family From *Arabidopsis thaliana*"; The Plant Journal; vol. 16(2); pp. 263-276; 1998.
Ledent, V. et al.; "The Basic Helix-Loop-Helix Protein Family: Comparative Genomics and Phylogenetic Analysis"; Genome Res.; vol. 11; pp. 754-770; 2001.
Li, X. et al.: "Genome-Wide Analysis of Basic/Helix-Loop Helix Transcription Factor Family in Rice and *Arabidopsis*"; Plant Physiology; vol. 141, pp. 1167-1184, 2006.
Ogo, Y. et al.; "Isolation and Characterization of IRO2, a Novel Iron-Regulated bHLH Transcription Factor in Graminaceous Plants"; Journal of Experimental Botany; vol. 57, No. 11; pp. 2867-2878; 2006.
Ogo, Y. et al.; "The Rice bHLH Protein OsIRO2 is an Essential Regulator of the Genes Involved Fe Uptake under Fe-Deficient Conditions"; The Plant Journal; vol. 51; pp. 366-377; 2007.
Shin, R. et al.; "The *Arabidopsis* Transcription Factor MYB77 Modulates Auxin Signal Transduction"; The Plant Cell; vol. 19; pp. 2440-2453; 2007.
Toledo-Ortiz, G. et al.; "The *Arabidopsis* Basic/Helix-Loop-Helix Transcription Factor Family"; The Plant Cell, vol. 15, pp. 1749-1770; 2003.
Vorwieger, A. et al.; "Iron Assimilation and Transcription Factor Controlled Synthesis of Riboflavin in Plants"; Planta; vol. 226; pp. 147-158; 2007.
Wang, H.; et al.; "Iron Deficiency-Mediated Stress Regulation of Four Subgroup lb BHLH Genes in *Arabidopsis thaliana*"; Planta; vol. 226; pp. 897-908; 2007.
Yuan, Y. et al.; "Fit Interacts With AtbHLH38 and AtbHLH39 in Regulating Iron Uptake Gene Expression for Iron Homeostasis in *Arabidopsis*"; Cell Research, pp. 1-13; 2008.
NCBI Accession No. AL138655 (gi: 6899905) (Feb. 2, 2000) Nyakatura, G. et al.; *Arabidopsis thaliana* DNA Chromosome 3, BAC Clone F24113.

* cited by examiner

POLYNUCLEOTIDES AND POLYPEPTIDES IN PLANTS

RELATIONSHIP TO COPENDING APPLICATIONS

This application is a continuation in part application of U.S. application Ser. No. 11/642,814 (pending), filed Dec. 20, 2006, which is a divisional application of U.S. application Ser. No. 10/666,642 (issued as U.S. Pat. No. 7,196,245 on 27 Mar. 2007), which claims the benefit of copending U.S. Provisional Application No. 60/411,837, filed Sep. 18, 2002, U.S. Provisional Application No. 60/434,166, filed Dec. 17, 2002, and U.S. Provisional Application No. 60/465,809, filed Apr. 24, 2003. This application is a continuation in part of application Ser. No. 12/077,535 (pending), filed Mar. 17, 2008. The contents of all applications herein are incorporated by referenced in their entirety.

TECHNICAL FIELD

This invention relates to the field of plant biology, and to compositions and methods for modifying the phenotype of a plant.

BACKGROUND OF THE INVENTION

A plant's traits, such as its biochemical, developmental, or phenotypic characteristics, may be controlled through a number of cellular processes. One important way to manipulate that control is through transcription factors—proteins that influence the expression of a particular gene or sets of genes. Transformed and transgenic plants comprise cells having altered levels of at least one selected transcription factor, and may possess advantageous or desirable traits. Strategies for manipulating traits by altering a plant cell's transcription factor content can therefore result in plants and crops with new and/or improved commercially valuable properties.

Transcription factors can modulate gene expression, either increasing or decreasing (inducing or repressing) the rate of transcription. This modulation results in differential levels of gene expression at various developmental stages, in different tissues and cell types, and in response to different exogenous (e.g., environmental) and endogenous stimuli throughout the life cycle of the organism.

Because transcription factors are key controlling elements of biological pathways, altering the expression levels of one or more transcription factors can change entire biological pathways in an organism. For example, manipulation of the levels of selected transcription factors may result in increased expression of economically useful proteins or biomolecules in plants or improvement in other agriculturally relevant characteristics. Conversely, blocked or reduced expression of a transcription factor may reduce biosynthesis of unwanted compounds or remove an undesirable trait. Therefore, manipulating transcription factor levels in a plant offers tremendous potential in agricultural biotechnology for modifying a plant's traits We have identified polynucleotides encoding transcription factors, developed numerous transgenic plants using these polynucleotides, and have analyzed the plants for a variety of important traits. In so doing, we have identified important polynucleotide and polypeptide sequences for producing commercially valuable plants and crops as well as the methods for making them and using them. Other aspects and embodiments of the invention are described below and can be derived from the teachings of this disclosure as a whole.

SUMMARY OF THE INVENTION

The present invention is directed to novel recombinant polynucleotides, transgenic plants comprising the polynucleotides, and methods for producing the transgenic plants.

The recombinant polynucleotides may include any of the following sequences:
(a) the nucleotide sequences found in the sequence listing;
(b) nucleotide sequences encoding polypeptides found in the sequence listing;
(c) sequence variants that are at least 70% sequence identical to any of the nucleotide sequences of (a) or (b);
(d) orthologous and paralogous nucleotide sequences that are at least 70% identical to any of the nucleotide sequences of (a) or (b);
(e) nucleotide sequence that hybridize to any of the nucleotide sequences of (a) or (b) under stringent conditions, which may include, for example, hybridization with wash steps of 6×SSC and 65 C for ten to thirty minutes per step; and
(f) nucleotide sequences encoding a polypeptide having a conserved domain required for the function of regulating transcription and altering a trait in a transgenic plant, the conserved domain being at least 70% identical with a conserved domain of a polypeptide of the invention (i.e., a polypeptide listed in the sequence listing, or encoded by any of the above nucleotide sequences).

The invention also pertains to transgenic plants that may be produced by transforming plants with any recombinant polynucleotide of the invention. Due to the function of these polynucleotides, the transgenic plant will become altered phenotypically when compared with a wild-type plant. The traits that may be altered by transforming a plant with one of the present polynucleotides are numerous and varied, and may include, for example:

increased tolerance to various abiotic stresses, including cold, heat, freezing, low nitrogen and phosphorus conditions, osmotic stresses such as drought, and high salt concentrations;

increased tolerance to disease, including fungal disease, and particularly *Erysiphe*, *Fusarium*, and *Botrytis*; the present polynucleotides may be used to confer increased tolerance to multiple pathogens in transformed plants;

altered sensitivity or resistance to treatments that include glyphosate, ABA, and ACC, altered carbon/nitrogen (C/N) sensing;

advanced or delayed flowering time;

altered floral characteristics such as flower structure, loss of flower determinacy, or reduced fertility;

altered shoot meristem development, altered stem morphology and vascular tissue structure, and altered branching patterns;

reduced apical dominance;

altered trichome density, development, or structure;

altered root development, including root mass, branching and root hairs;

altered shade avoidance;

altered seed characteristics such as size, oil content, protein content, development, ripening, germination, or prenyl lipid content;

altered leaf characteristics, including size, mass, shape, color, glossiness, prenyl lipid content and other chemical modifications;

slower or faster growth than wild-type;

altered cell differentiation, proliferation, and expansion; altered phase change;

altered senescence, programmed cell death and necrosis, increased plant size and/or biomass, including larger seedlings than controls; dwarfed plants; and altered pigment, including anthocyanin, levels, in various plant tissues.

Methods for producing transgenic plants having altered traits are also encompassed by the invention. These method steps include first providing an expression vector having a recombinant polynucleotide of the invention, and at least one regulatory element flanking the polynucleotide sequence Generally, the regulatory element(s) control expression of the recombinant polynucleotide in a target plant. The expression vector is then introduced into plant cells. The plant cells are grown into plants, which are allowed to overexpress a polypeptide encoded by the recombinant polynucleotide. This overexpression results in the trait alteration, in the plant. Those plants that have altered traits are identified and selected on the basis of the desirability and degree of the altered trait.

BRIEF DESCRIPTION OF THE SEQUENCE LISTING AND FIGURES

The file of this patent contains at least one drawing executed in color. Copies of this patent with color drawing(s) will be provided by the Patent and Trademark Office upon request and payment of the necessary fee.

The Sequence Listing provides exemplary polynucleotide and polypeptide sequences of the invention. The traits associated with the use of the sequences are included in the Examples. The sequence listing was created on Nov. 1, 2010 and is 4,293,651 bytes (4.09 MB) as measured in windows MS-DOS. The entire content of the sequence listing is hereby incorporated by reference.

FIG. 1 shows a conservative estimate of phylogenetic relationships among the orders of flowering plants (modified from Angiosperm Phylogeny Group (1998) *Ann. Missouri Bot. Gard.* 84: 1-49). Those plants with a single cotyledon (monocots) are a monophyletic clade nested within at least two major lineages of dicots; the eudicots are further divided into rosids and asterids. *Arabidopsis* is a rosid eudicot classified within the order Brassicales; rice is a member of the monocot order Poales. FIG. 1 was adapted from Daly et al. ((2001) *Plant Physiol.* 127: 1328-1333).

Figure 2:
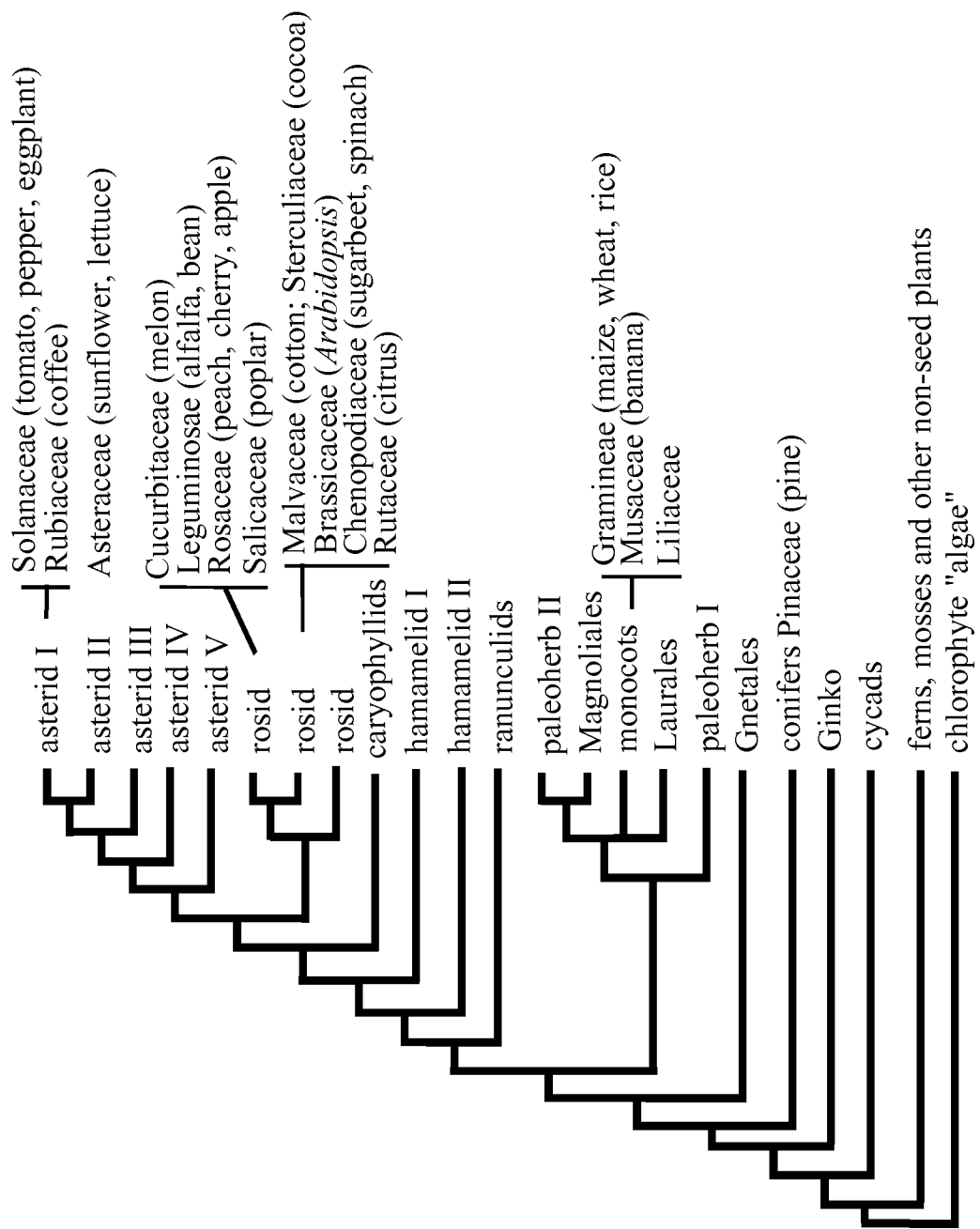

FIG. 2 shows a phylogenic dendogram depicting phylogenetic relationships of higher plant taxa, including clades containing tomato and *Arabidopsis*; adapted from Ku et al. (2000) *Proc. Natl. Acad. Sci.* 97: 9121-9126; and Chase et al. (1993) *Ann. Missouri Bot. Gard.* 80: 528-580.

Figure 3A:
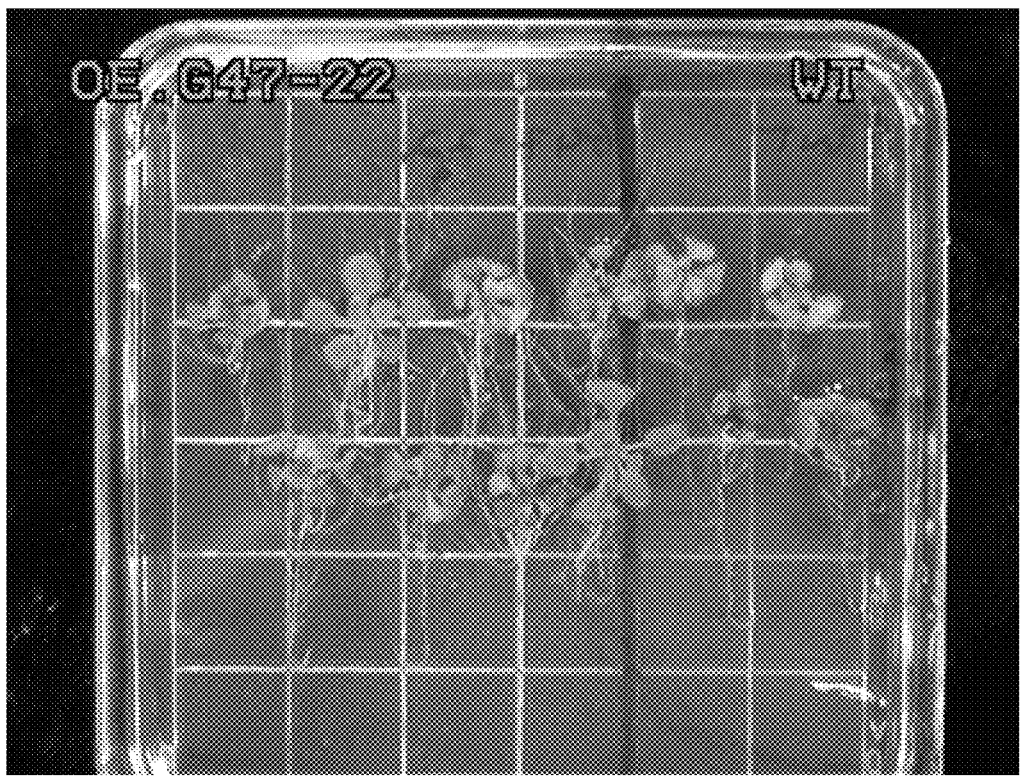
Figure 3B:

FIG. 3A illustrates an example of an osmotic stress assay. The medium used in this root growth assay contained polyethylene glycol (PEG). After germination, the seedlings of a 35S::G47 overexpressing line (the eight seedlings on left labeled "OE.G47—22") appeared larger and had more root growth than the four wild-type seedlings on the right. As would be predicted by the osmotic stress assay, G47 plants showed enhanced survival and drought tolerance in a soil-based drought assay, as did G2133, a paralog of G47 (see FIGS. 10A and 10B). FIG. 3B also demonstrates an interesting effect of G47 overexpression; the 35S::G47 plants on the left and in the center of this photograph had short, thick, fleshy inflorescences with reduced apical dominance.

Figure 4:
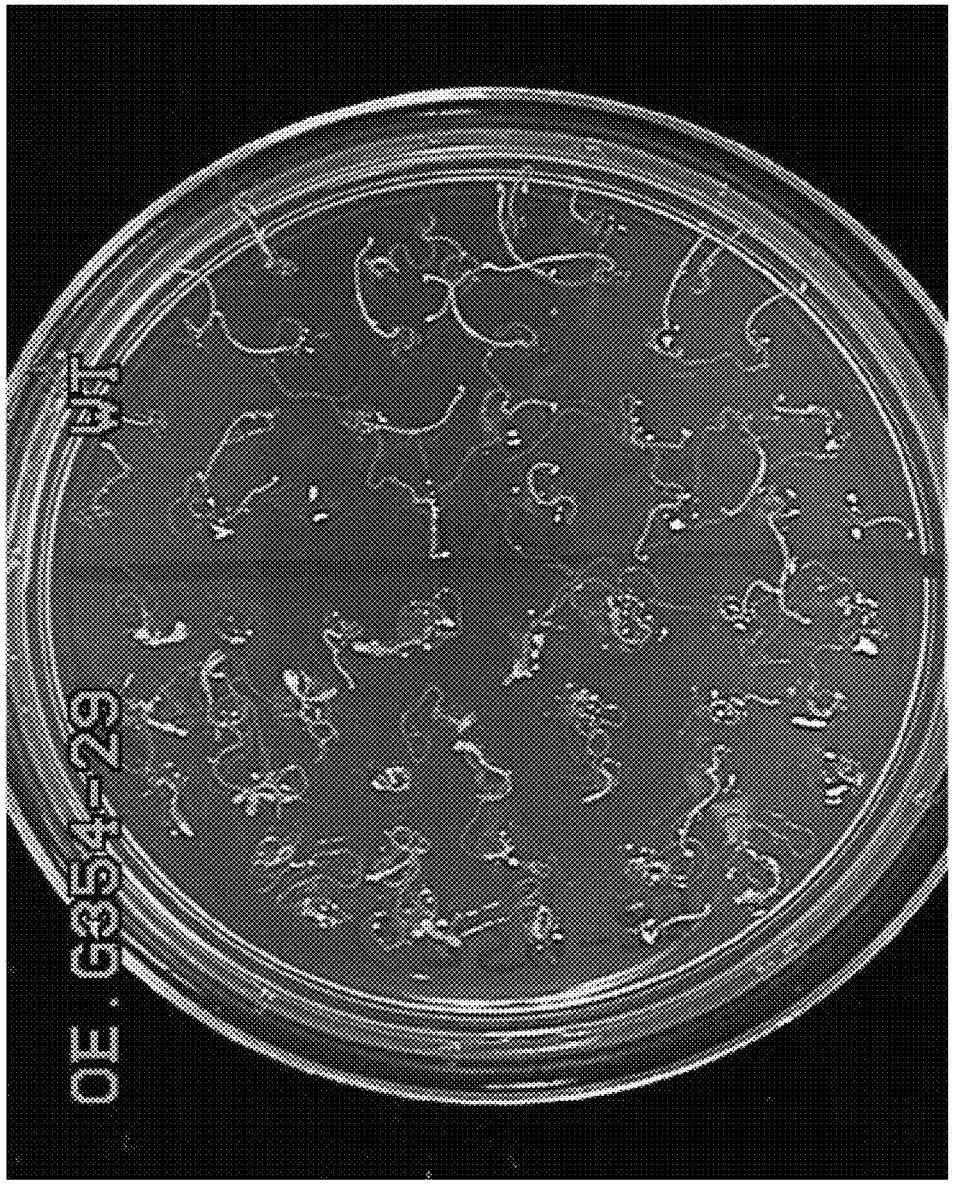

FIG. 4 demonstrates an example of the effects of an altered response to light. In a germination assay conducted on MS medium in darkness, overexpression of G354 resulted in more open and greenish cotyledons and thick hypocotyls compared to wild type (G354 overexpressors are labeled "G354-29" and wild-type "WT" in this figure). G354 overexpressors also had a drought-tolerance phenotype, as indicated in Example VIII, below. Closely related paralogs of this gene, G353 and G2839, showed a osmotic stress tolerance phenotype in a germination assay on media containing high sucrose. One line of 35S::G353 seedlings and several lines of 35S::G2839 were greener and had higher germination rates than controls. This suggests that G354 and its paralogs G353 and G2839 influence osmotic stress responses.

Figure 5A:
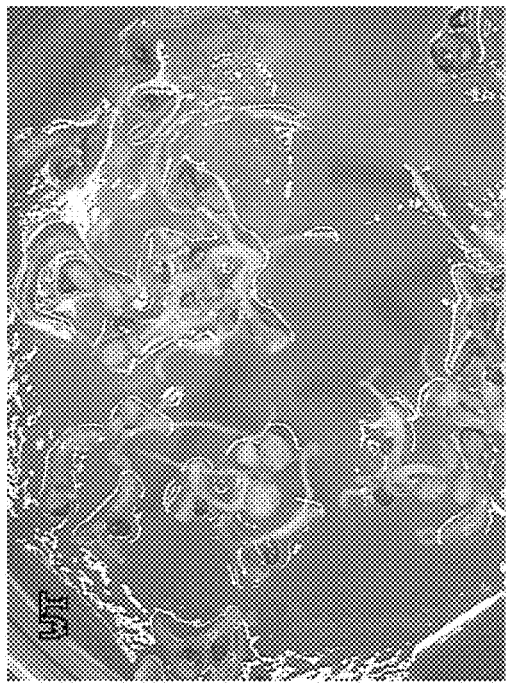
Figure 5B:
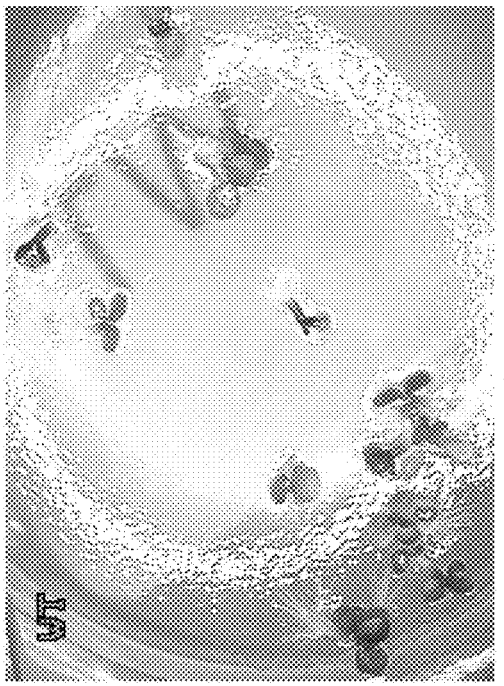
Figure 5C:

FIG. 5A is a photograph of *Arabidopsis* 35S::G1274 seedlings grown on low nitrogen media supplemented with sucrose plus glutamine. Seedlings of two overexpressing lines are present on this plate (not distinguished), and both lines contained less anthocyanin than the wild-type seedlings seen in FIG. 5B. The lack of anthocyanin production indicated that these lines were less stressed than control seedlings under the same conditions, a fact later confirmed in soil-based drought assays showing enhanced drought tolerance by G1274 overexpressing lines. G1274 overexpression (FIG. 5C) and wild-type (FIG. 5D) germination was also compared in a cold germination assay, in which the overexpressors were found to be larger and greener than the controls.

Figure 6A:
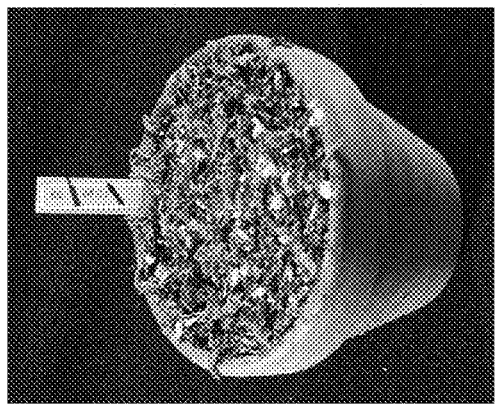
Figure 6B:
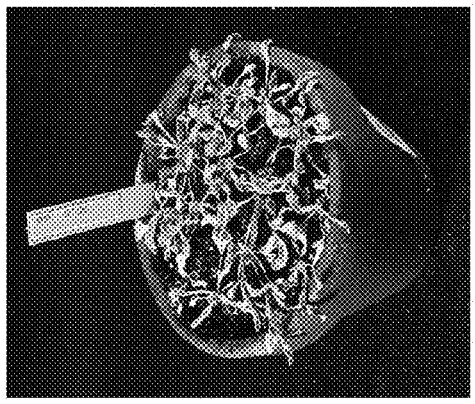
Figure 6C:
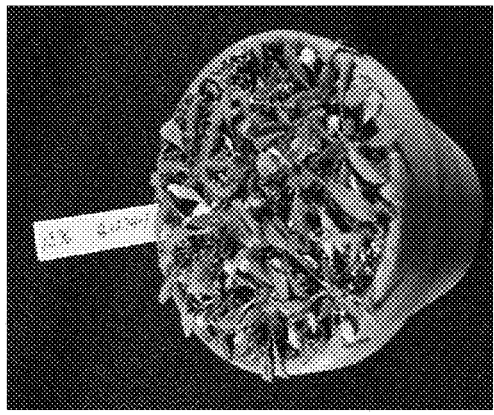
Figure 6D:

FIGS. 6A-6D compare soil-based drought assays for G1274 overexpressors and wild-type control plants, which confirms the results predicted after the performance of the plate-based osmotic stress assays. 35S::G1274 lines fared much better after a period of water deprivation (FIG. 6A) than control plants (FIG. 6B). This distinction was particularly evident in the overexpressor plants after being ministered with water, said plants recovering to a healthy and vigorous state, as shown in FIG. 6C. Conversely, none of the wild-type plants seen in FIG. 6D recovered after rewatering.

Figure 7A:
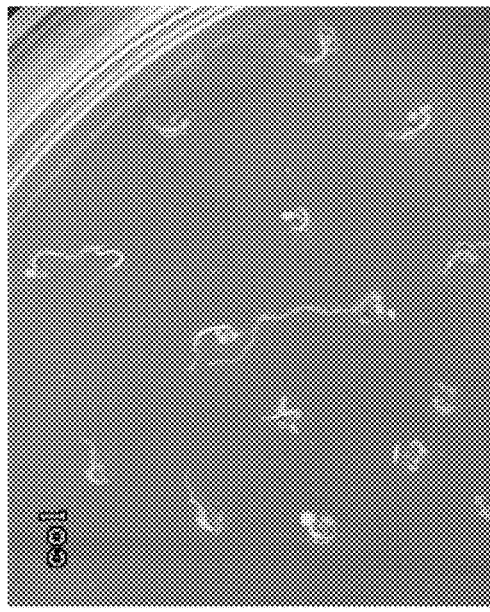
Figure 7B:
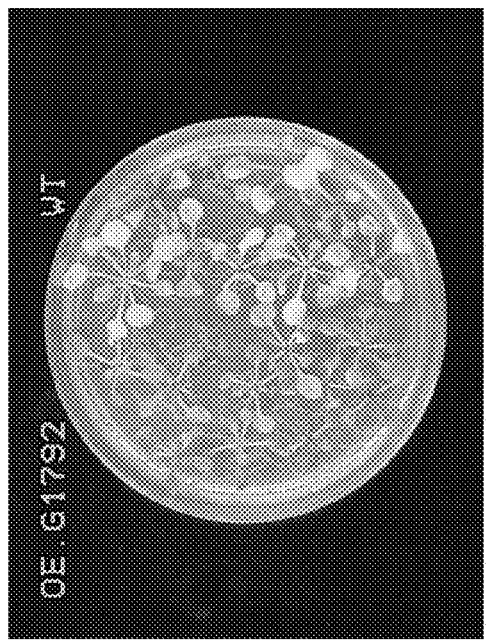
Figure 7C:
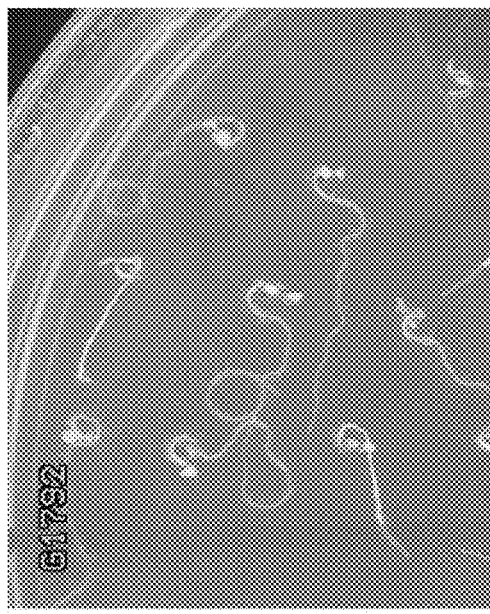
Figure 7D:
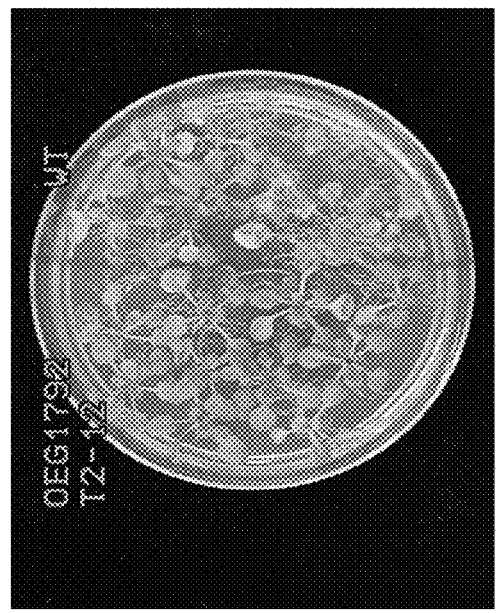

FIGS. 7A and 7B compare G1792 overexpressing *Arabidopsis* seedling growth on a single plate (two sectors of the same plate) with medium containing 3% sucrose medium lacking nitrogen, five days after planting The 35S::G1792 lines seen in FIG. 7A generally showed greater cotyledon expansion and root growth than the wild-type seedlings in FIG. 7B. FIG. 7C is a photograph of a single plate showing a G1792 overexpressing line (labeled G1792-12; on left) and wild-type plants (on right) five days after inoculation with *Botrytis cinerea*, showing the chlorosis and hyphal growth in the latter control plants but not in the former overexpressors. Similar results were obtained five days after inoculation with *Erysiphe orontii* (not shown) and with *Fusarium oxysporum*, as seen in FIG. 7D, with control plants on the right showing chlorosis, and G1792 overexpressors on the left appearing to be free of the adverse effects of infection.

Figure 8A:
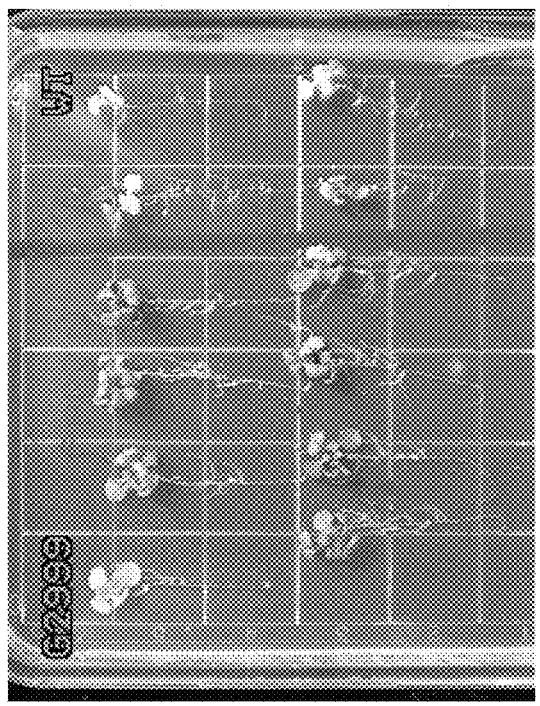
Figure 8C:
Figure 8B:
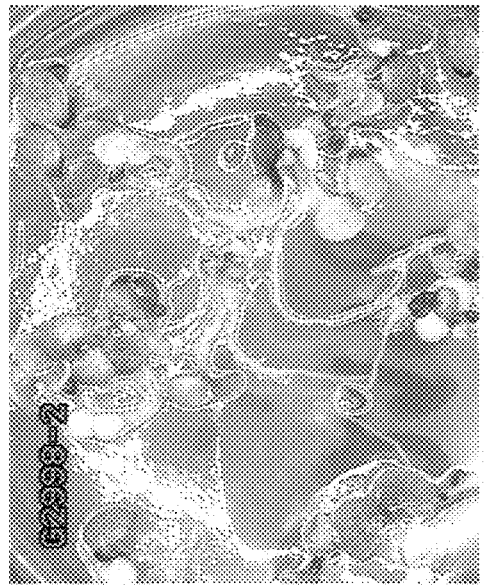

FIG. 8A illustrates the results of root growth assays with G2999 overexpressing seedlings and controls in a high sodium chloride medium. The eight 35S::G2999 *Arabidopsis* seedlings on the left were larger, greener, and had more root growth than the four control seedlings on the right. Another member of the G2999 clade, G2998, also showed a salt tolerance phenotype and performed similarly in the plate-based salt stress assay seen FIG. 8B. In the latter assay 35S::G2998 seedlings appeared large and green, whereas wild-type seedlings in the control assay plate shown in FIG. 8C were small and had not yet expanded their cotyledons. As is noted below, high sodium chloride growth assays often are used to indicate osmotic stress tolerance such as drought tolerance, which was subsequently confirmed with soil-based assays conducted with G2999-overexpressing plants.

Figure 9A:
Figure 9B:

FIG. 9A shows the effects of a heat assay on *Arabidopsis* wild-type and G3086-overexpressing plants. Generally, the overexpressors on the left were larger, paler, and bolted earlier than the wild type plants seen on the right in this plate. The same G3086 overexpressing lines, as exemplified by the eight seedlings on the left of FIG. 9B, were also found to be larger, greener, and had more root growth in a high salt root growth assay than control plants, including the four on the right in FIG. 9B.

Figure 10A:
Figure 10B:

FIGS. 10A and 10B compare the recovery from a drought treatment in two lines of G2133 overexpressing *Arabidopsis* plants and wild-type controls. FIG. 10A shows plants of 35S::G2133 line 5 (left) and control plants (right). FIG. 10B shows plants of 35S::G2133 line 3 (left) and control plants (right). Each pot contained several plants grown under 24 hours light. All were deprived of water for eight days, and are shown after re-watering. All of the plants of the G2133 overexpressor lines recovered, and all of the control plants were either dead or severely and adversely affected by the drought treatment.

DETAILED DESCRIPTION OF EXEMPLARY EMBODIMENTS

In an important aspect, the present invention relates to polynucleotides and polypeptides, for example, for modifying phenotypes of plants. Throughout this disclosure, various information sources are referred to and/or are specifically incorporated. The information sources include scientific journal articles, patent documents, textbooks, and World Wide Web browser-inactive page addresses, for example. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the invention.

It must be noted that as used herein and in the appended claims, the singular forms "a," "an," and "the" include plural reference unless the context clearly dictates otherwise. Thus, for example, a reference to "a plant" includes a plurality of such plants, and a reference to "a stress" is a reference to one or more stresses and equivalents thereof known to those skilled in the art, and so forth.

The polynucleotide sequences of the invention encode polypeptides that are members of well-known transcription factor families, including plant transcription factor families, as disclosed in Tables 4-9. Generally, the transcription factors encoded by the present sequences are involved in cell differentiation and proliferation and the regulation of growth. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits. The sequences of the invention may also be used to transform a plant and introduce desirable traits not found in the wild-type cultivar or strain. Plants may then be selected for those that produce the most desirable degree of over- or under-expression of target genes of interest and coincident trait improvement.

The sequences of the present invention may be from any species, particularly plant species, in a naturally occurring form or from any source whether natural, synthetic, semi-synthetic or recombinant. The sequences of the invention may also include fragments of the present amino acid sequences.

In this context, a "fragment" refers to a fragment of a polypeptide sequence which is at least 5 to about 15 amino acids in length, most preferably at least 14 amino acids, and which retain some biological activity of a transcription factor. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

As one of ordinary skill in the art recognizes, transcription factors can be identified by the presence of a region or domain of structural similarity or identity to a specific consensus sequence or the presence of a specific consensus DNA-binding site or DNA-binding site motif (see, for example, Riechmann et al. (2000) *Science* 290: 2105-2110). The plant transcription factors may belong to one of the following transcription factor families: the AP2 (APETALA2) domain transcription factor family (Riechmann and Meyerowitz (1998) *Biol. Chem.* 379: 633-646); the MYB transcription factor family (ENBib; Martin and Paz-Ares (1997) *Trends Genet.* 13: 67-73); the MADS domain transcription factor family (Riechmann and Meyerowitz (1997) *Biol. Chem.* 378: 1079-1101); the WRKY protein family (Ishiguro and Nakamura (1994) *Mol. Gen. Genet.* 244: 563-571); the ankyrin-repeat protein family (Zhang et al. (1992) *Plant Cell* 4: 1575-1588); the zinc finger protein (Z) family (Klug and Schwabe (1995) *FASEB J.* 9: 597-604); Takatsuji (1998) *Cell. Mol. Life. Sci.* 54:582-596); the homeobox (HB) protein family (Buerglin (1994) in *Guidebook to the Homeobox Genes*, Duboule (ed.) Oxford University Press); the CAAT-element binding proteins (Forsburg and Guarente (1989) *Genes Dev.* 3: 1166-1178); the squamosa promoter binding proteins (SPB) (Klein et al. (1996) *Mol. Gen. Genet.* 1996 250: 7-16); the NAM protein family (Souer et al. (1996) *Cell* 85: 159-170); the IAA/AUX proteins (Abel et al. (1995) *J. Mol. Biol.* 251: 533-549); the HLH/MYC protein family (Littlewood et al. (1994) *Prot. Profile* 1: 639-709); the DNA-binding protein (DBP) family (Tucker et al. (1994) *EMBO J.* 13: 2994-3002); the bZIP family of transcription factors (Foster et al. (1994) *FASEB J.* 8: 192-200); the Box P-binding protein (the BPF-1) family (da Costa e Silva et al. (1993) *Plant J.* 4: 125-135); the high mobility group (HMG) family (Bustin and Reeves (1996) *Prog. Nucl. Acids Res. Mol. Biol.* 54: 35-100); the scarecrow (SCR) family (Di Laurenzio et al. (1996) *Cell* 86: 423-433); the GF14 family (Wu et al. (1997) *Plant Physiol.* 114: 1421-1431); the polycomb (PCOMB) family (Goodrich et al. (1997) *Nature* 386: 44-51); the teosinte branched (TEO) family (Luo et al. (1996) *Nature* 383: 794-799); the ABI3 family (Giraudat et al. (1992) *Plant Cell* 4: 1251-1261); the triple helix (TH) family (Dehesh et al. (1990) *Science* 250: 1397-1399); the EIL family (Chao et al. (1997) *Cell* 89: 1133-44); the AT-HOOK family (Reeves and Nissen (1990) *J. Biol. Chem.* 265: 8573-8582); the S1FA family (Zhou et al. (1995) *Nucleic Acids Res.* 23: 1165-1169); the bZIPT2 family (Lu and Ferl (1995) *Plant Physiol.* 109: 723); the YABBY family (Bowman et al. (1999) *Development* 126: 2387-96); the PAZ family (Bohmert et al. (1998) *EMBO J.* 17: 170-80); a family of miscellaneous (MISC) transcription factors including the DPBF family (Kim et al. (1997) *Plant J.* 11: 1237-1251) and the SPF1 family (Ishiguro and Nakamura (1994) *Mol. Gen. Genet.* 244: 563-571); the GARP family (Hall et al. (1998) *Plant Cell* 10: 925-936), the TUBBY family (Boggin et al (1999) *Science* 286: 2119-2125), the heat shock family (Wu (1995) *Annu. Rev. Cell Dev. Biol.* 11: 441-469), the ENBP family (Christiansen et al. (1996) *Plant Mol. Biol.* 32: 809-821), the RING-zinc family (Jensen et al. (1998) *FEBS Letters* 436: 283-287), the PDBP family (Janik et al. (1989) *Virology* 168: 320-329), the PCF family (Cubas et al. *Plant J.* (1999) 18: 215-22), the SRS(SHI-related) family (Fridborg et al. (1999) *Plant Cell* 11: 1019-1032), the CPP (cysteine-rich polycomb-like) family (Cvitanich et al. (2000) *Proc. Natl. Acad. Sci.* 97: 8163-8168), the ARF (auxin response factor) family (Ulmasov et al. (1999) *Proc. Natl. Acad. Sci.* 96: 5844-5849), the SWI/SNF family (Collingwood et al. (1999) *J. Mol. Endocrinol.* 23: 255-275), the ACBF family (Seguin et al. (1997) *Plant Mol. Biol.* 35: 281-291), PCGL (CG-1 like) family (da Costa e Silva et al. (1994) *Plant Mol. Biol.* 25: 921-924) the ARID family (Vazquez et al. (1999) *Development* 126: 733-742), the Jumonji family (Balciunas et al. (2000), *Trends Biochem. Sci.* 25: 274-276), the bZIP-NIN family (Schauser et al. (1999) *Nature* 402: 191-195), the E2F family (Kaelin et al. (1992) *Cell* 70: 351-364) and the GRF-like family (Knaap et al. (2000) *Plant Physiol.* 122: 695-704). As indicated by any part of the list above and as known in the art, transcription factors have been sometimes categorized by class, family, and sub-family according to their structural content and consensus DNA-binding site motif, for example. Many of the classes and many of the families and sub-families are listed here. However, the inclusion of one sub-family and not another, or the inclusion of one family and not another, does not mean that the invention does not encompass polynucleotides or polypeptides of a certain family or sub-family. The list provided here is merely an example of the types of transcription factors and the knowledge available concerning the consensus sequences and consensus DNA-binding site motifs that help define them as known to those of skill in the art (each of the references noted above are specifically incorporated herein by reference). A transcription factor may include, but is not limited to, any polypeptide that can activate or repress transcription of a single gene or a number of genes. This polypeptide group includes, but is not limited to, DNA-binding proteins, DNA-binding protein binding proteins, protein kinases, protein phosphatases, protein methyltransferases, GTP-binding proteins, and receptors, and the like.

In addition to methods for modifying a plant phenotype by employing one or more polynucleotides and polypeptides of the invention described herein, the polynucleotides and polypeptides of the invention have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, e.g., mutation reactions, PCR reactions, or the like; as substrates for cloning e.g., including digestion or ligation reactions; and for identifying exogenous or endogenous modulators of the transcription factors.

Definitions

"Nucleic acid molecule" refers to a oligonucleotide, polynucleotide or any fragment thereof. It may be DNA or RNA of genomic or synthetic origin, double-stranded or single-stranded, and combined with carbohydrate, lipids, protein, or other materials to perform a particular activity such as transformation or form a useful composition such as a peptide nucleic acid (PNA).

"Polynucleotide" is a nucleic acid molecule comprising a plurality of polymerized nucleotides, e.g., at least about 15 consecutive polymerized nucleotides, optionally at least about 30 consecutive nucleotides, at least about 50 consecutive nucleotides. A polynucleotide may be a nucleic acid, oligonucleotide, nucleotide, or any fragment thereof. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single stranded or double stranded DNA or RNA. The polynucleotide optionally comprises modified bases or a modified backbone. The polynucleotide can be, e.g., genomic DNA or RNA, a transcript (such as an mRNA), a cDNA, a PCR product, a cloned DNA, a synthetic DNA or RNA, or the like. The polynucleotide can be combined with carbohydrate, lipids, protein, or other materials to perform a particular activity such as transformation or form a useful composition such as a peptide nucleic acid (PNA). The polynucleotide can comprise a sequence in either sense or antisense orientations. "Oligonucleotide" is substantially equivalent to the terms amplimer, primer, oligomer, element, target, and probe and is preferably single stranded.

"Gene" or "gene sequence" refers to the partial or complete coding sequence of a gene, its complement, and its 5' or 3' untranslated regions. A gene is also a functional unit of inheritance, and in physical terms is a particular segment or sequence of nucleotides along a molecule of DNA (or RNA, in the case of RNA viruses) involved in producing a polypeptide chain. The latter may be subjected to subsequent processing such as splicing and folding to obtain a functional protein or polypeptide. A gene may be isolated, partially isolated, or be found with an organism's genome. By way of example, a transcription factor gene encodes a transcription factor polypeptide, which may be functional or require processing to function as an initiator of transcription.

Operationally, genes may be defined by the cis-trans test, a genetic test that determines whether two mutations occur in the same gene and which may be used to determine the limits of the genetically active unit (Rieger et al. (1976) *Glossary of Genetics and Cytogenetics: Classical and Molecular,* 4th ed., Springer Verlag. Berlin). A gene generally includes regions preceding ("leaders"; upstream) and following ("trailers"; downstream) of the coding region. A gene may also include intervening, non-coding sequences, referred to as "introns", located between individual coding segments, referred to as "exons". Most genes have an associated promoter region, a regulatory sequence 5' of the transcription initiation codon (there are some genes that do not have an identifiable promoter). The function of a gene may also be regulated by enhancers, operators, and other regulatory elements.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

An "isolated polynucleotide" is a polynucleotide whether naturally occurring or recombinant, that is present outside the cell in which it is typically found in nature, whether purified or not. Optionally, an isolated polynucleotide is subject to one or more enrichment or purification procedures, e.g., cell lysis, extraction, centrifugation, precipitation, or the like.

A "polypeptide" is an amino acid sequence comprising a plurality of consecutive polymerized amino acid residues e.g., at least about 15 consecutive polymerized amino acid residues, optionally at least about 30 consecutive polymerized amino acid residues, at least about 50 consecutive polymerized amino acid residues. In many instances, a polypeptide comprises a polymerized amino acid residue sequence that is a transcription factor or a domain or portion or fragment thereof. Additionally, the polypeptide may comprise 1) a localization domain, 2) an activation domain, 3) a repression domain, 4) an oligomerization domain, or 5) a DNA-binding domain, or the like. The polypeptide optionally comprises modified amino acid residues, naturally occurring amino acid residues not encoded by a codon, non-naturally occurring amino acid residues.

"Protein" refers to an amino acid sequence, oligopeptide, peptide, polypeptide or portions thereof whether naturally occurring or synthetic.

"Portion", as used herein, refers to any part of a protein used for any purpose, but especially for the screening of a library of molecules which specifically bind to that portion or for the production of antibodies.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Homology" refers to sequence similarity between a reference sequence and at least a fragment of a newly sequenced clone insert or its encoded amino acid sequence.

"Hybridization complex" refers to a complex between two nucleic acid molecules by virtue of the formation of hydrogen bonds between purines and pyrimidines.

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value therebetween. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences.

The term "amino acid consensus motif" refers to the portion or subsequence of a polypeptide sequence that is substantially conserved among the polypeptide transcription factors listed in the Sequence Listing.

"Alignment" refers to a number of DNA or amino acid sequences aligned by lengthwise comparison so that components in common (i.e., nucleotide bases or amino acid residues) may be readily and graphically identified. The number of components in common is related to the homology or identity between the sequences. Alignments may be used to identify "conserved domains" and relatedness within these domains. An alignment may suitably be determined by means of computer programs known in the art, such as MacVector (1999) (Accelrys, Inc., San Diego, Calif.).

A "conserved domain" or "conserved region" as used herein refers to a region in heterologous polynucleotide or polypeptide sequences where there is a relatively high degree of sequence identity between the distinct sequences.

With respect to polynucleotides encoding presently disclosed transcription factors, a conserved region is preferably at least 10 base pairs (bp) in length.

A "conserved domain", with respect to presently disclosed polypeptides refers to a domain within a transcription factor family that exhibits a higher degree of sequence homology, such as at least 26% sequence similarity, at least 16% sequence identity, preferably at least 40% sequence identity, preferably at least 65% sequence identity including conservative substitutions, and more preferably at least 80% sequence identity, and even more preferably at least 85%, or at least about 86%, or at least about 87%, or at least about 88%, or at least about 90%, or at least about 95%, or at least about 98% amino acid residue sequence identity of a polypeptide of consecutive amino acid residues. A fragment or domain can be referred to as outside a conserved domain, outside a consensus sequence, or outside a consensus DNA-binding site that is known to exist or that exists for a particular transcription factor class, family, or sub-family. In this case, the fragment or domain will not include the exact amino acids of a consensus sequence or consensus DNA-binding site of a transcription factor class, family or sub-family, or the exact amino acids of a particular transcription factor consensus sequence or consensus DNA-binding site. Furthermore, a particular fragment, region, or domain of a polypeptide, or a polynucleotide encoding a polypeptide, can be "outside a conserved domain" if all the amino acids of the fragment, region, or domain fall outside of a defined conserved domain(s) for a polypeptide or protein. Sequences having lesser degrees of identity but comparable biological activity are considered to be equivalents.

As one of ordinary skill in the art recognizes, conserved domains may be identified as regions or domains of identity to a specific consensus sequence (see, for example, Riechmann et al. (2000) supra). Thus, by using alignment methods well known in the art, the conserved domains of the plant transcription factors for each of the following may be determined: the AP2 (APETALA2) domain transcription factor family (Riechmann and Meyerowitz (1998) supra; the MYB transcription factor family (ENBib; Martin and Paz-Ares (1997) supra); the MADS domain transcription factor family (Riechmann and Meyerowitz (1997) supra; Immink et al. (2003) supra); the WRKY protein family (Ishiguro and Nakamura (1994) supra); the ankyrin-repeat protein family (Zhang et al. (1992) supra); the zinc finger protein (Z) family (Klug and Schwabe (1995) supra; Takatsuji (1998) supra); the homeobox (HB) protein family (Buerglin (1994) supra); the CAAT-element binding proteins (Forsburg and Guarente (1989) supra); the squamosa promoter binding proteins (SPB) (Klein et al. (1996) supra); the NAM protein family (Souer et al. (1996) supra); the IAA/AUX proteins (Abel et al. (1995) supra); the HLH/MYC protein family (Littlewood et al. (1994) supra); the DNA-binding protein (DBP) family (Tucker et al. (1994) supra); the bZIP family of transcription factors (Foster et al. (1994) supra); the Box P-binding protein (the BPF-1) family (da Costa e Silva et al. (1993) supra); the high mobility group (HMG) family (Bustin and Reeves (1996) supra); the scarecrow (SCR) family (Di Laurenzio et al. (1996) supra); the GF14 family (Wu et al. (1997) supra); the polycomb (PCOMB) family (Goodrich et al. (1997) supra); the teosinte branched (TEO) family (Luo et al. (1996) supra); the ABI3 family (Giraudat et al. (1992) supra); the triple helix (TH) family (Dehesh et al. (1990) supra); the EIL family (Chao et al. (1997) Cell supra); the AT-HOOK family (Reeves and Nissen (1990) supra); the S1FA family (Zhou et al. (1995) supra); the bZIPT2 family (Lu and Ferl (1995) supra); the YABBY family (Bowman et al. (1999) supra); the PAZ family (Bohmert et al. (1998) supra); a family of miscellaneous (MISC) transcription factors including the DPBF family (Kim et al. (1997) supra) and the SPF1 family (Ishiguro and Nakamura (1994) supra); the GARP family (Hall et al. (1998) supra), the TUBBY family (Boggin et al. (1999) supra), the heat shock family (Wu (1995) supra), the ENBP family (Christiansen et al. (1996) supra), the RING-zinc family (Jensen et al. (1998) supra), the PDBP family (Janik et al. (1989) supra), the PCF family (Cubas et al. (1999) supra), the SRS(SHI-related) family (Fridborg et al. (1999) supra), the CPP (cysteine-rich polycomb-like) family (Cvitanich et al. (2000) supra), the ARF (auxin response factor) family (Ulmasov et al. (1999) supra), the SWI/SNF family (Collingwood et al. (1999) supra), the ACBF family (Seguin et al. (1997) supra), PCGL (CG-1 like) family (da Costa e Silva et al. (1994) supra) the ARID family (Vazquez et al. (1999) supra), the Jumonji family, (Balciunas et al. (2000) supra), the bZIP-NIN family (Schauser et al. (1999) supra), the E2F family Kaelin et al. (1992) supra) and the GRF-like family (Knaap et al (2000) supra).

The conserved domains for each of polypeptides of SEQ ID NO: 2N, wherein N=1-335 (that is, odd SEQ ID NO: 1, 3 5, 7 . . . 759) are listed in Table 5. Also, many of the polypeptides of Table 5 have conserved domains specifically indicated by start and stop sites. A comparison of the regions of the polypeptides in SEQ ID NO: 2N, wherein N=1-335 (that is, even SEQ ID NOs: 2, 4, 6, 8 . . . 760), or of those in Table 5, allows one of skill in the art to identify conserved domain(s) for any of the polypeptides listed or referred to in this disclosure, including those in Tables 4-9.

"Complementary" refers to the natural hydrogen bonding by base pairing between purines and pyrimidines. For example, the sequence A-C-G-T (5'->3') forms hydrogen bonds with its complements A-C-G-T (5'->3') or A-C-G-U (5'->3'). Two single-stranded molecules may be considered partially complementary, if only some of the nucleotides bond, or "completely complementary" if all of the nucleotides bond. The degree of complementarity between nucleic acid strands affects the efficiency and strength of the hybridization and amplification reactions. "Fully complementary" refers to the case where bonding occurs between every base pair and its complement in a pair of sequences, and the two sequences have the same number of nucleotides.

The terms "highly stringent" or "highly stringent condition" refer to conditions that permit hybridization of DNA strands whose sequences are highly complementary, wherein these same conditions exclude hybridization of significantly mismatched DNAs. Polynucleotide sequences capable of hybridizing under stringent conditions with the polynucleotides of the present invention may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al. (1985) *Nature* 313:402-404, and Sambrook et al. (1989) *Molecular Cloning: A Laboratory Manual,* 2nd Ed., Cold Spring Harbor Laboratory, Cold Spring Harbor, N.Y. ("Sambrook"); and by Haymes et al., "Nucleic Acid Hybridization: A Practical Approach", IRL Press, Washington, D.C. (1985), which references are incorporated herein by reference.

In general, stringency is determined by the temperature, ionic strength, and concentration of denaturing agents (e.g., formamide) used in a hybridization and washing procedure (for a more detailed description of establishing and determining stringency, see below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known transcription factor sequences. Numerous variations are possible in the conditions and means by which nucleic acid hybridization can be performed to isolate transcription factor sequences having similarity to transcription factor sequences known in the art and are not limited to those explicitly disclosed herein. Such an approach may be used to isolate polynucleotide sequences having various degrees of similarity with disclosed transcription factor sequences, such as, for example, transcription factors having 60% identity, or more preferably greater than about 70% identity, most preferably 72% or greater identity with disclosed transcription factors.

The term "equivalog" describes members of a set of homologous proteins that are conserved with respect to function since their last common ancestor (Haft et al., 2003). Related proteins are grouped into equivalog families, and otherwise into protein families with other hierarchically defined homology types.

The term "variant", as used herein, may refer to polynucleotides or polypeptides, that differ from the presently disclosed polynucleotides or polypeptides, respectively, in sequence from each other, and as set forth below.

With regard to polynucleotide variants, differences between presently disclosed polynucleotides and polynucleotide variants are limited so that the nucleotide sequences of the former and the latter are closely similar overall and, in many regions, identical. Due to the degeneracy of the genetic code, differences between the former and latter nucleotide sequences o may be silent (i.e., the amino acids encoded by the polynucleotide are the same, and the variant polynucleotide sequence encodes the same amino acid sequence as the presently disclosed polynucleotide. Variant nucleotide sequences may encode different amino acid sequences, in which case such nucleotide differences will result in amino acid substitutions, additions, deletions, insertions, truncations or fusions with respect to the similar disclosed polynucleotide sequences. These variations result in polynucleotide variants encoding polypeptides that share at least one functional characteristic. The degeneracy of the genetic code also dictates that many different variant polynucleotides can encode identical and/or substantially similar polypeptides in addition to those sequences illustrated in the Sequence Listing.

Also within the scope of the invention is a variant of a transcription factor nucleic acid listed in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide.

"Allelic variant" or "polynucleotide allelic variant" refers to any of two or more alternative forms of a gene occupying the same chromosomal locus. Allelic variation arises naturally through mutation, and may result in phenotypic polymorphism within populations. Gene mutations may be "silent" or may encode polypeptides having altered amino acid sequence. "Allelic variant" and "polypeptide allelic variant" may also be used with respect to polypeptides, and in this case the term refer to a polypeptide encoded by an allelic variant of a gene.

"Splice variant" or "polynucleotide splice variant" as used herein refers to alternative forms of RNA transcribed from a gene. Splice variation naturally occurs as a result of alternative sites being spliced within a single transcribed RNA molecule or between separately transcribed RNA molecules, and may result in several different forms of mRNA transcribed from the same gene. This, splice variants may encode polypeptides having different amino acid sequences, which may or may not have similar functions in the organism. "Splice variant" or "polypeptide splice variant" may also refer to a polypeptide encoded by a splice variant of a transcribed mRNA.

As used herein, "polynucleotide variants" may also refer to polynucleotide sequences that encode paralogs and orthologs of the presently disclosed polypeptide sequences. "Polypeptide variants" may refer to polypeptide sequences that are paralogs and orthologs of the presently disclosed polypeptide sequences.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent transcription factor. Thus, it will be readily appreciated by those of skill in the art, that any of a variety of polynucleotide sequences is capable of encoding the transcription factors and transcription factor homolog polypeptides of the invention. A polypeptide sequence variant may have "conservative" changes, wherein a substituted amino acid has similar structural or chemical properties. Deliberate amino acid substitutions may thus be made on the basis of similarity in polarity, charge, solubility, hydrophobicity, hydrophilicity, and/or the amphipathic nature of the residues, as long as the functional or biological activity of the transcription factor is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine (for more detail on conservative substitutions, see Table 2). More rarely, a variant may have "non-conservative" changes, e.g., replacement of a glycine with a tryptophan. Similar minor variations may also include amino acid deletions or insertions, or both. Related polypeptides may comprise, for example, additions and/or deletions of one or more N-linked or O-linked glycosylation sites, or an addition and/or or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840,544).

"Ligand" refers to any molecule, agent, or compound that will bind specifically to a complementary site on a nucleic acid molecule or protein. Such ligands stabilize or modulate the activity of nucleic acid molecules or proteins of the invention and may be composed of at least one of the following: inorganic and organic substances including nucleic acids, proteins, carbohydrates, fats, and lipids.

"Modulates" refers to a change in activity (biological, chemical, or immunological) or lifespan resulting from specific binding between a molecule and either a nucleic acid molecule or a protein.

The term "plant" includes whole plants, shoot vegetative organs/structures (e.g., leaves, stems and tubers), roots, flowers and floral organs/structures (e.g., bracts, sepals, petals, stamens, carpels, anthers and ovules), seed (including embryo, endosperm, and seed coat) and fruit (the mature ovary), plant tissue (e.g., vascular tissue, ground tissue, and the like) and cells (e.g., guard cells, egg cells, and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, horsetails, psilophytes, lycophytes, bryophytes, and multicellular algae. (See for example, FIG. 1, adapted from Daly et al. (2001) *Plant Physiol.* 127: 1328-1333; FIG. 2, adapted from Ku et al. (2000) *Proc. Natl. Acad. Sci.* 97: 9121-9126; and see also Tudge in *The Variety of Life*, Oxford University Press, New York, N.Y. (2000) pp. 547-606).

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic plant may contain an expression vector or cassette. The expression cassette typically comprises a polypeptide-encoding sequence operably linked (i.e., under regulatory control of) to appropriate inducible or constitutive regulatory sequences that allow for the expression of polypeptide. The expression cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

"Control plant" refers to a plant that serves as a standard of comparison for testing the results of a treatment or genetic alteration, or the degree of altered expression of a gene or gene product. Examples of control plants include plants that are untreated, or genetically unaltered (i.e., wild-type).

"Wild type", as used herein, refers to a cell, tissue or plant that has not been genetically modified to knock out or overexpress one or more of the presently disclosed transcription factors. Wild-type cells, tissue or plants may be used as controls to compare levels of expression and the extent and nature of trait modification with cells, tissue or plants in which transcription factor expression is altered or ectopically expressed, e.g., in that it has been knocked out or overexpressed.

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A polynucleotide fragment" refers to any subsequence of a polynucleotide, typically, of at least about 9 consecutive nucleotides, preferably at least about 30 nucleotides, more preferably at least about 50 nucleotides, of any of the sequences provided herein. Exemplary polynucleotide fragments are the first sixty consecutive nucleotides of the transcription factor polynucleotides listed in the Sequence Listing. Exemplary fragments also include fragments that comprise a region that encodes a conserved domain of a transcription factor.

Fragments may also include subsequences of polypeptides and protein molecules, or a subsequence of the polypeptide. Fragments may have uses in that they may have antigenic potential. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as 3 amino acids to the full length of the intact polypeptide, but are preferably at least about 30 amino acids in length and more preferably at least about 60 amino acids in length. Exemplary polypeptide fragments are the first twenty consecutive amino acids of a mammalian protein encoded by are the first twenty consecutive amino acids of the transcription factor polypeptides listed in the Sequence Listing. Exemplary fragments also include fragments that comprise a conserved domain of a transcription factor, for example, amino acid residues 11-80 of G47 (SEQ ID NO: 12), as noted in Table 5.

The invention also encompasses production of DNA sequences that encode transcription factors and transcription factor derivatives, or fragments thereof, entirely by synthetic chemistry. After production, the synthetic sequence may be inserted into any of the many available expression vectors and cell systems using reagents well known in the art. Moreover, synthetic chemistry may be used to introduce mutations into a sequence encoding transcription factors or any fragment thereof.

"Derivative" refers to the chemical modification of a nucleic acid molecule or amino acid sequence. Chemical modifications can include replacement of hydrogen by an alkyl, acyl, or amino group or glycosylation, pegylation, or any similar process that retains or enhances biological activity or lifespan of the molecule or sequence.

A "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance. Any technique can be used to measure the amount of, comparative level of, or difference in any selected chemical compound or macromolecule in the transgenic plants, however.

"Trait modification" refers to a detectable difference in a characteristic in a plant ectopically expressing a polynucleotide or polypeptide of the present invention relative to a plant not doing so, such as a wild-type plant. In some cases, the trait modification can be evaluated quantitatively. For example, the trait modification can entail at least about a 2% increase or decrease in an observed trait (difference), at least a 5% difference, at least about a 10% difference, at least about a 20% difference, at least about a 30%, at least about a 50%, at least about a 70%, or at least about a 100%, or an even greater difference compared with a wild-type plant. It is known that there can be a natural variation in the modified trait. Therefore, the trait modification observed entails a change of the normal distribution of the trait in the plants compared with the distribution observed in wild-type plants.

The term "transcript profile" refers to the expression levels of a set of genes in a cell in a particular state, particularly by comparison with the expression levels of that same set of genes in a cell of the same type in a reference state. For example, the transcript profile of a particular transcription factor in a suspension cell is the expression levels of a set of genes in a cell overexpressing that transcription factor compared with the expression levels of that same set of genes in a suspension cell that has normal levels of that transcription factor. The transcript profile can be presented as a list of those genes whose expression level is significantly different between the two treatments, and the difference ratios. Differences and similarities between expression levels may also be evaluated and calculated using statistical and clustering methods.

"Ectopic expression or altered expression" in reference to a polynucleotide indicates that the pattern of expression in, e.g., a transgenic plant or plant tissue, is different from the expression pattern in a wild-type plant or a reference plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression in a wild-type plant, cell or tissue, at any developmental or temporal stage for the gene. Overexpression can occur when, for example, the genes encoding one or more transcription factors are under the control of a strong expression signal, such as one of the promoters described herein (e.g., the cauliflower mosaic virus 35S transcription initiation region). Overexpression may occur throughout a plant or in specific tissues of the plant, depending on the promoter used, as described below.

Overexpression may take place in plant cells normally lacking expression of polypeptides functionally equivalent or identical to the present transcription factors. Overexpression may also occur in plant cells where endogenous expression of the present transcription factors or functionally equivalent molecules normally occurs, but such normal expression is at a lower level. Overexpression thus results in a greater than normal production, or "overproduction" of the transcription factor in the plant, cell or tissue.

The term "phase change" refers to a plant's progression from embryo to adult, and, by some definitions, the transition wherein flowering plants gain reproductive competency. It is believed that phase change occurs either after a certain number of cell divisions in the shoot apex of a developing plant, or when the shoot apex achieves a particular distance from the roots. Thus, altering the timing of phase changes may affect a plant's size, which, in turn, may affect yield and biomass.

"Tolerance" results from specific, heritable characteristics of a host plant that allow a pathogen to develop and multiply in the host while the host, either by lacking receptor sites for, or by inactivating or compensating for the irritant secretions of the pathogen, still manages to thrive or, in the case of crop plants, produce a good crop. Tolerant plants are susceptible to the pathogen but are not killed by it and generally show little damage from the pathogen (Agrios (1988) *Plant Pathology*, 3rd ed. Academic Press, N.Y., p. 129).

"Resistance", also referred to as "true resistance", results when a plant contains one or more genes that make the plant and a potential pathogen more or less incompatible with each other, either because of a lack of chemical recognition between the host and the pathogen, or because the host plant can defend itself against the pathogen by defense mechanisms already present or activated in response to infection (Agrios (1988)) *Plant Pathology*, 3rd ed. Academic Press, N.Y., p. 125).

A "sample" with respect to a material containing nucleic acid molecules may comprise a bodily fluid; an extract from a cell, chromosome, organelle, or membrane isolated from a cell; genomic DNA, RNA, or cDNA in solution or bound to a substrate; a cell; a tissue; a tissue print; a forensic sample; and the like. In this context "substrate" refers to any rigid or semi-rigid support to which nucleic acid molecules or proteins are bound and includes membranes, filters, chips, slides, wafers, fibers, magnetic or nonmagnetic beads, gels, capillaries or other tubing, plates, polymers, and microparticles with a variety of surface forms including wells, trenches, pins, channels and pores. A substrate may also refer to a reactant in a chemical or biological reaction, or a substance acted upon (e.g., by an enzyme).

"Substantially purified" refers to nucleic acid molecules or proteins that are removed from their natural environment and are isolated or separated, and are at least about 60% free, preferably about 75% free, and most preferably about 90% free, from other components with which they are naturally associated.

Traits that May be Modified in Overexpressing or Knock-out Plants

Trait modifications of particular interest include those to seed (such as embryo or endosperm), fruit, root, flower, leaf, stem, shoot, seedling or the like, including: enhanced tolerance to environmental conditions including freezing, chilling, heat, drought, water saturation, radiation and ozone; improved tolerance to microbial, fungal or viral diseases; improved tolerance to pest infestations, including insects, nematodes, mollicutes, parasitic higher plants or the like; decreased herbicide sensitivity; improved tolerance of heavy metals or enhanced ability to take up heavy metals; improved growth under poor photoconditions (e.g., low light and/or short day length), or changes in expression levels of genes of interest. Other phenotype that can be modified relate to the production of plant metabolites, such as variations in the production of taxol, tocopherol, tocotrienol, sterols, phytosterols, vitamins, wax monomers, anti-oxidants, amino acids, lignins, cellulose, tannins, prenyllipids (such as chlorophylls and carotenoids), glucosinolates, and terpenoids, enhanced or compositionally altered protein or oil production (especially in seeds), or modified sugar (insoluble or soluble) and/or starch composition. Physical plant characteristics that can be modified include cell development (such as the number of trichomes), fruit and seed size and number, yields of plant parts such as stems, leaves, inflorescences, and roots, the stability of the seeds during storage, characteristics of the seed pod (e.g., susceptibility to shattering), root hair length and quantity, internode distances, or the quality of seed coat. Plant growth characteristics that can be modified include growth rate, germination rate of seeds, vigor of plants and seedlings, leaf and flower senescence, male sterility, apomixis, flowering time, flower abscission, rate of nitrogen uptake, osmotic sensitivity to soluble sugar concentrations, biomass or transpiration characteristics, as well as plant architecture characteristics such as apical dominance, branching patterns, number of organs, organ identity, organ shape or size.

Transcription Factors Modify Expression of Endogenous Genes

Expression of genes that encode transcription factors that modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997, *Genes Development* 11: 3194-3205) and Peng et al. (1999, *Nature,* 400: 256-261). In addition, many others have demonstrated that an *Arabidopsis* transcription factor expressed in an exogenous plant species elicits the same or very similar phenotypic response. See, for example, Fu et al. (2001, *Plant Cell* 13: 1791-1802); Nandi et al. (2000, *Curr. Biol.* 10: 215-218); Coupland (1995, *Nature* 377: 482-483); and Weigel and Nilsson (1995, *Nature* 377: 482-500).

In another example, Mandel et al. (1992, *Cell* 71-133-143) and Suzuki et al. (2001, *Plant J.* 28: 409-418) teach that a transcription factor expressed in another plant species elicits the same or very similar phenotypic response of the endogenous sequence, as often predicted in earlier studies of *Arabidopsis* transcription factors in *Arabidopsis* (see Mandel et al. 1992, supra; Suzuki et al. 2001, supra).

Other examples include Müller et al. (2001, *Plant J.* 28: 169-179); Kim et al. (2001, *Plant J.* 25: 247-259); Kyozuka and Shimamoto (2002, *Plant Cell Physiol.* 43: 130-135); Boss and Thomas (2002, *Nature,* 416: 847-850); He et al. (2000, *Transgenic Res.* 9: 223-227); and Robson et al. (2001, *Plant J.* 28: 619-631).

In yet another example, Gilmour et al. (1998, *Plant J.* 16: 433-442) teach an *Arabidopsis* AP2 transcription factor, CBF1 (SEQ ID NO: 2239), which, when overexpressed in transgenic plants, increases plant freezing tolerance. Jaglo et al. (2001, *Plant Physiol.* 127: 910-917) further identified sequences in *Brassica napus* which encode CBF-like genes and that transcripts for these genes accumulated rapidly in response to low temperature. Transcripts encoding CBF-like proteins were also found to accumulate rapidly in response to low temperature in wheat, as well as in tomato. An alignment of the CBF proteins from *Arabidopsis, B. napus*, wheat, rye, and tomato revealed the presence of conserved consecutive amino acid residues, PKK/RPAGRxKFxETRHP and DSAWR, that bracket the AP2/EREBP DNA binding domains of the proteins and distinguish them from other members of the AP2/EREBP protein family. (See Jaglo et al. supra.)

Transcription factors mediate cellular responses and control traits through altered expression of genes containing cis-acting nucleotide sequences that are targets of the introduced transcription factor. It is well appreciated in the Art that the effect of a transcription factor on cellular responses or a cellular trait is determined by the particular genes whose expression is either directly or indirectly (e.g., by a cascade of transcription factor binding events and transcriptional changes) altered by transcription factor binding. In a global analysis of transcription comparing a standard condition with one in which a transcription factor is overexpressed, the resulting transcript profile associated with transcription factor overexpression is related to the trait or cellular process controlled by that transcription factor. For example, the PAP2 gene (and other genes in the MYB family) have been shown to control anthocyanin biosynthesis through regulation of the expression of genes known to be involved in the anthocyanin biosynthetic pathway (Bruce et al. (2000) *Plant Cell* 12: 65-79; and Borevitz et al. (2000) *Plant Cell* 12: 2383-2393). Further, global transcript profiles have been used successfully as diagnostic tools for specific cellular states (e.g., cancerous vs. non-cancerous; Bhattacharjee et al. (2001) *Proc. Natl. Acad. Sci. USA* 98: 13790-13795; and Xu et al. (2001) *Proc Natl Acad Sci, USA* 98: 15089-15094). Consequently, it is evident to one skilled in the art that similarity of transcript profile upon overexpression of different transcription factors would indicate similarity of transcription factor function.

Polypeptides and Polynucleotides of the Invention

The present invention provides, among other things, transcription factors (TFs), and transcription factor homolog polypeptides, and isolated or recombinant polynucleotides encoding the polypeptides, or novel sequence variant polypeptides or polynucleotides encoding novel variants of transcription factors derived from the specific sequences provided here. These polypeptides and polynucleotides may be employed to modify a plant's characteristics.

Exemplary polynucleotides encoding the polypeptides of the invention were identified in the *Arabidopsis thaliana* GenBank database using publicly available sequence analysis programs and parameters. Sequences initially identified were then further characterized to identify sequences comprising specified sequence strings corresponding to sequence motifs present in families of known transcription factors. In addition, further exemplary polynucleotides encoding the polypeptides of the invention were identified in the plant GenBank database using publicly available sequence analysis programs and parameters. Sequences initially identified were then further characterized to identify sequences comprising specified sequence strings corresponding to sequence motifs present in families of known transcription factors. Polynucleotide sequences meeting such criteria were confirmed as transcription factors.

Additional polynucleotides of the invention were identified by screening *Arabidopsis thaliana* and/or other plant cDNA libraries with probes corresponding to known transcription factors under low stringency hybridization conditions. Additional sequences, including full length coding sequences were subsequently recovered by the rapid amplification of cDNA ends (RACE) procedure, using a commercially available kit according to the manufacturer's instructions. Where necessary, multiple rounds of RACE are performed to isolate 5' and 3' ends. The full-length cDNA was then recovered by a routine end-to-end polymerase chain reaction (PCR) using primers specific to the isolated 5' and 3' ends. Exemplary sequences are provided in the Sequence Listing.

The polynucleotides of the invention can be or were ectopically expressed in overexpressor or knockout plants and the changes in the characteristic(s) or trait(s) of the plants observed. Therefore, the polynucleotides and polypeptides can be employed to improve the characteristics of plants.

The polynucleotides of the invention can be or were ectopically expressed in overexpressor plant cells and the changes in the expression levels of a number of genes, polynucleotides, and/or proteins of the plant cells observed. Therefore, the polynucleotides and polypeptides can be employed to change expression levels of a genes, polynucleotides, and/or proteins of plants.

Producing Polypeptides

The polynucleotides of the invention include sequences that encode transcription factors and transcription factor homolog polypeptides and sequences complementary thereto, as well as unique fragments of coding sequence, or sequence complementary thereto. Such polynucleotides can be, e.g., DNA or RNA, e.g., mRNA, cRNA, synthetic RNA, genomic DNA, cDNA synthetic DNA, oligonucleotides, etc. The polynucleotides are either double-stranded or single-stranded, and include either, or both sense (i.e., coding) sequences and antisense (i.e., non-coding, complementary) sequences. The polynucleotides include the coding sequence of a transcription factor, or transcription factor homolog polypeptide, in isolation, in combination with additional coding sequences (e.g., a purification tag, a localization signal, as a fusion-protein, as a pre-protein, or the like), in combination with non-coding sequences (e.g., introns or inteins, regulatory elements such as promoters, enhancers, terminators, and the like), and/or in a vector or host environment in which the polynucleotide encoding a transcription factor or transcription factor homolog polypeptide is an endogenous or exogenous gene.

A variety of methods exist for producing the polynucleotides of the invention. Procedures for identifying and isolating DNA clones are well known to those of skill in the art, and are described in, e.g., Berger and Kimmel, *Guide to Molecular Cloning Techniques, Methods in Enzymology*, vol. 152 Academic Press, Inc., San Diego, Calif. ("Berger"); Sambrook et al. *Molecular Cloning—A Laboratory Manual* (2nd Ed.), Vol. 1-3, Cold Spring Harbor Laboratory, Cold Spring Harbor, N.Y., 1989 ("Sambrook") and *Current Protocols in Molecular Biology*, Ausubel et al. eds., Current Protocols, a joint venture between Greene Publishing Associates, Inc. and John Wiley & Sons, Inc., (supplemented through 2000) ("Ausubel").

Alternatively, polynucleotides of the invention, can be produced by a variety of in vitro amplification methods adapted to the present invention by appropriate selection of specific or degenerate primers. Examples of protocols sufficient to direct persons of skill through in vitro amplification methods, including the polymerase chain reaction (PCR) the ligase chain reaction (LCR), Qbeta-replicase amplification and other RNA polymerase mediated techniques (e.g., NASBA), e.g., for the production of the homologous nucleic acids of the invention are found in Berger (supra), Sambrook (supra), and Ausubel (supra), as well as Mullis et al. (1987) *PCR Protocols A Guide to Methods and Applications* (Innis et al. eds) Academic Press Inc. San Diego, Calif. (1990) (Innis). Improved methods for cloning in vitro amplified nucleic acids are described in Wallace et al. U.S. Pat. No. 5,426,039. Improved methods for amplifying large nucleic acids by PCR are summarized in Cheng et al. (1994) *Nature* 369: 684-685 and the references cited therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, e.g., Ausubel, Sambrook and Berger, all supra.

Alternatively, polynucleotides and oligonucleotides of the invention can be assembled from fragments produced by solid-phase synthesis methods. Typically, fragments of up to approximately 100 bases are individually synthesized and then enzymatically or chemically ligated to produce a desired sequence, e.g., a polynucleotide encoding all or part of a transcription factor. For example, chemical synthesis using the phosphoramidite method is described, e.g., by Beaucage et al. (1981) *Tetrahedron Letters* 22: 1859-1869; and Matthes et al. (1984) *EMBO J.* 3: 801-805. According to such methods, oligonucleotides are synthesized, purified, annealed to their complementary strand, ligated and then optionally cloned into suitable vectors. And if so desired, the polynucleotides and polypeptides of the invention can be custom ordered from any of a number of commercial suppliers.

Homologous Sequences

Sequences homologous, i.e., that share significant sequence identity or similarity, to those provided in the Sequence Listing, derived from *Arabidopsis thaliana* or from other plants of choice, are also an aspect of the invention. Homologous sequences can be derived from any plant including monocots and dicots and in particular agriculturally important plant species, including but not limited to, crops such as soybean, wheat, corn (maize), potato, cotton, rice, rape, oilseed rape (including canola), sunflower, alfalfa, clover, sugarcane, and turf; or fruits and vegetables, such as banana, blackberry, blueberry, strawberry, and raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, tomatillo, watermelon, rosaceous fruits (such as apple, peach, pear, cherry and plum) and vegetable brassicas (such as broccoli, cabbage, cauliflower, Brussels sprouts, and kohlrabi). Other crops, including fruits and vegetables, whose phenotype can be changed and which comprise homologous sequences include barley; rye; millet; sorghum; currant; avocado; citrus fruits such as oranges, lemons, grapefruit and tangerines, artichoke, cherries; nuts such as the walnut and peanut; endive; leek; roots such as arrowroot, beet, cassava, turnip, radish, yam, and sweet potato; and beans. The homologous sequences may also be derived from woody species, such pine, poplar and eucalyptus, or mint or other labiates. In addition, homologous sequences may be derived from plants that are evolutionarily-related to crop plants, but which may not have yet been used as crop plants. Examples include deadly nightshade (*Atropa belladona*), related to tomato; jimson weed (*Datura strommium*), related to peyote; and teosinte (*Zea* species), related to corn (maize).

Orthologs and Paralogs

Homologous sequences as described above can comprise orthologous or paralogous sequences. Several different methods are known by those of skill in the art for identifying and defining these functionally homologous sequences. Three general methods for defining orthologs and paralogs are described; an ortholog, paralog or homolog may be identified by one or more of the methods described below.

Orthologs and paralogs are evolutionarily related genes that have similar sequence and similar functions. Orthologs are structurally related genes in different species that are derived by a speciation event. Paralogs are structurally related genes within a single species that are derived by a duplication event.

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al. (1994) *Nucleic Acids Res.* 22: 4673-4680; Higgins et al. (1996) *Methods Enzymol.* 266: 383-402). Groups of similar genes can also be identified with pair-wise BLAST analysis (Feng and Doolittle (1987) *J. Mol. Evol.* 25: 351-360). For example, a clade of very similar MADS domain transcription factors from *Arabidopsis* all share a common function in flowering time (Ratcliffe et al. (2001) *Plant Physiol.* 126: 122-132), and a group of very similar AP2 domain transcription factors from *Arabidopsis* are involved in tolerance of plants to freezing (Gilmour et al. (1998) *Plant J.* 16: 433-442). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount (2001), in *Bioinformatics: Sequence and Genome Analysis* Cold Spring Harbor Laboratory Press, Cold Spring Harbor, N.Y., page 543.)

Speciation, the production of new species from a parental species, can also give rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al. (1994) Nucleic Acids Res. 22: 4673-4680; Higgins et al. (1996) supra) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

Transcription factor gene sequences are conserved across diverse eukaryotic species lines (Goodrich et al. (1993) *Cell* 75: 519-530; Lin et al. (1991) *Nature* 353: 569-571; Sadowski et al. (1988) *Nature* 335: 563-564). Plants are no exception to this observation; diverse plant species possess transcription factors that have similar sequences and functions.

Orthologous genes from different organisms have highly conserved functions, and very often essentially identical functions (Lee et al. (2002) *Genome Res.* 12: 493-502; Remm et al. (2001) *J. Mol. Biol.* 314: 1041-1052). Paralogous genes, which have diverged through gene duplication, may retain similar functions of the encoded proteins. In such cases, paralogs can be used interchangeably with respect to certain embodiments of the instant invention (for example, transgenic expression of a coding sequence). An example of such highly related paralogs is the CBF family, with three well-defined members in *Arabidopsis* and at least one ortholog in *Brassica napus* (SEQ ID NOs: 2238, 2240, 2242, and 2244, respectively), all of which control pathways involved in both freezing and drought stress (Gilmour et al. (1998) *Plant J.* 16: 433-442; Jaglo et al. (1998) *Plant Physiol.* 127: 910-917).

The following references represent a small sampling of the many studies that demonstrate that conserved transcription factor genes from diverse species are likely to function similarly (i.e., regulate similar target sequences and control the same traits), and that transcription factors may be transformed into diverse species to confer or improve traits.

(1) The *Arabidopsis* NPR1 gene regulates systemic acquired resistance (SAR); over-expression of NPR1 leads to enhanced resistance in *Arabidopsis*. When either *Arabidopsis* NPR1 or the rice NPR1 ortholog was overexpressed in rice (which, as a monocot, is diverse from *Arabidopsis*), challenge with the rice bacterial blight pathogen *Xanthomonas oryzae* pv. Oryzae, the transgenic plants displayed enhanced resistance (Chem et al. (2001) *Plant J.* 27: 101-113). NPR1 acts through activation of expression of transcription factor genes, such as TGA2 (Fan and Dong (2002) *Plant Cell* 14: 1377-1389).

(2) E2F genes are involved in transcription of plant genes for proliferating cell nuclear antigen (PCNA). Plant E2Fs share a high degree of similarity in amino acid sequence between monocots and dicots, and are even similar to the conserved domains of the animal E2Fs. Such conservation indicates a functional similarity between plant and animal E2Fs. E2F transcription factors that regulate meristem development act through common cis-elements, and regulate related (PCNA) genes (Kosugi and Ohashi, (2002) *Plant J.* 29: 45-59).

(3) The ABI5 gene (ABA insensitive 5) encodes a basic leucine zipper factor required for ABA response in the seed and vegetative tissues. Co-transformation experiments with ABI5 cDNA constructs in rice protoplasts resulted in specific transactivation of the ABA-inducible wheat, *Arabidopsis*, bean, and barley promoters. These results demonstrate that sequentially similar ABI5 transcription factors are key targets of a conserved ABA signaling pathway in diverse plants. (Gampala et al. (2001) *J. Biol. Chem.* 277: 1689-1694).

(4) Sequences of three *Arabidopsis* GAMYB-like genes were obtained on the basis of sequence similarity to GAMYB genes from barley, rice, and *L. temulentum*. These three *Arabadopsis* genes were determined to encode transcription factors (AtMYB33, AtMYB65, and AtMYB101) and could substitute for a barley GAMYB and control alpha-amylase expression (Gocal et al. (2001) *Plant Physiol.* 127: 1682-1693).

(5) The floral control gene LEAFY from *Arabidopsis* can dramatically accelerate flowering in numerous dictoyledonous plants. Constitutive expression of *Arabidopsis* LEAFY also caused early flowering in transgenic rice (a monocot), with a heading date that was 26-34 days earlier than that of wild-type plants. These observations indicate that floral regulatory genes from *Arabidopsis* are useful tools for heading date improvement in cereal crops (He et al. (2000) *Transgenic Res.* 9: 223-227).

(6) Bioactive gibberellins (GAs) are essential endogenous regulators of plant growth. GA signaling tends to be conserved across the plant kingdom. GA signaling is mediated via GAI, a nuclear member of the GRAS family of plant transcription factors. *Arabidopsis* GAI has been shown to function in rice to inhibit gibberellin response pathways (Fu et al. (2001) *Plant Cell* 13: 1791-1802).

(7) The *Arabidopsis* gene SUPERMAN(SUP), encodes a putative transcription factor that maintains the boundary between stamens and carpels. By over-expressing *Arabidopsis* SUP in rice, the effect of the gene's presence on whorl boundaries was shown to be conserved. This demonstrated that SUP is a conserved regulator of floral whorl boundaries and affects cell proliferation (Nandi et al. (2000) *Curr. Biol.* 10: 215-218).

(8) Maize, petunia and *Arabidopsis* myb transcription factors that regulate flavonoid biosynthesis are very genetically similar and affect the same trait in their native species, therefore sequence and function of these myb transcription factors correlate with each other in these diverse species (Borevitz et al. (2000) *Plant Cell* 12: 2383-2394).

(9) Wheat reduced height-1 (Rht-B1/Rht-D1) and maize dwarf-8 (d8) genes are orthologs of the *Arabidopsis* gibberellin insensitive (GAI) gene. Both of these genes have been used to produce dwarf grain varieties that have improved grain yield. These genes encode proteins that resemble nuclear transcription factors and contain an SH2-like domain, indicating that phosphotyrosine may participate in gibberellin signaling. Transgenic rice plants containing a mutant GAI allele from *Arabidopsis* have been shown to produce reduced responses to gibberellin and are dwarfed, indicating that mutant GAI orthologs could be used to increase yield in a wide range of crop species (Peng et al. (1999) *Nature* 400: 256-261).

Transcription factors that are homologous to the listed sequences will typically share, in at least one conserved domain, at least about 70% amino acid sequence identity, and with regard to zinc finger transcription factors, at least about 50% amino acid sequence identity. More closely related transcription factors can share at least about 70%, or about 75% or about 80% or about 90% or about 95% or about 98% or more sequence identity with the listed sequences, or with the listed sequences but excluding or outside a known consensus sequence or consensus DNA-binding site, or with the listed sequences excluding one or all conserved domain. Factors that are most closely related to the listed sequences share, e.g., at least about 85%, about 90% or about 95% or more % sequence identity to the listed sequences, or to the listed sequences but excluding or outside a known consensus sequence or consensus DNA-binding site or outside one or all conserved domain. At the nucleotide level, the sequences will typically share at least about 40% nucleotide sequence identity, preferably at least about 50%, about 60%, about 70% or about 80% sequence identity, and more preferably about 85%, about 90%, about 95% or about 97% or more sequence identity to one or more of the listed sequences, or to a listed sequence but excluding or outside a known consensus sequence or consensus DNA-binding site, or outside one or all conserved domain. The degeneracy of the genetic code enables major variations in the nucleotide sequence of a polynucleotide while maintaining the amino acid sequence of the encoded protein. Conserved domains within a transcription factor family may exhibit a higher degree of sequence homology, such as at least 65% amino acid sequence identity including conservative substitutions, and preferably at least 80% sequence identity, and more preferably at least 85%, or at least 86%, or at least 87%, or at least 88%, or at least 90%, or at least 95%, or at least 98% sequence identity. Transcription factors that are homologous to the listed sequences should share at least 30%, or at least 60%, or at least 75%, or at least 76%, or at least 77%, or at least 78%, or at least 79%, or at least 80%, or at least 85%, or at least 90%, or at least 95% amino acid sequence identity over the entire length of the polypeptide or the homolog.

Percent identity can be determined electronically, e.g., by using the MEGALIGN program (DNASTAR, Inc. Madison, Wis.). The MEGALIGN program can create alignments between two or more sequences according to different methods, for example, the clustal method. (See, for example, Higgins and Sharp (1988) *Gene* 73: 237-244.) The clustal algorithm groups sequences into clusters by examining the distances between all pairs. The clusters are aligned pairwise and then in groups. Other alignment algorithms or programs may be used, including FASTA, BLAST, or ENTREZ, FASTA and BLAST, and which may be used to calculate percent similarity. These are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

Other techniques for alignment are described in Methods in Enzymology, vol. 266, *Computer Methods for Macromolecular Sequence Analysis* (1996), ed. Doolittle, Academic Press, Inc., San Diego, Calif., USA. Preferably, an alignment program that permits gaps in the sequence is utilized to align the sequences. The Smith-Waterman is one type of algorithm that permits gaps in sequence alignments (see Shpaer (1997) *Methods Mol. Biol.* 70: 173-187). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., the Jotun Hein method. (See, e.g., Hein (1990) *Methods Enzymol.* 183: 626-645.) Identity between sequences can also be determined by other methods known in the art, e.g., by varying hybridization conditions (see US Patent Application No. 20010010913).

The percent identity between two conserved domains of a transcription factor DNA-binding domain consensus polypeptide sequence can be as low as 16%, as exemplified in the case of GATA1 family of eukaryotic $Cys_2/Cys_2$-type zinc finger transcription factors. The DNA-binding domain consensus polypeptide sequence of the GATA1 family is $CX_2CX_{17}CX_2C$, where X is any amino acid residue. (See, for example, Takatsuji, supra.) Other examples of such conserved consensus polypeptide sequences with low overall percent sequence identity are well known to those of skill in the art.

Thus, the invention provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an internet or intranet) and a query is made against the sequence database using the relevant sequences herein and associated plant phenotypes or gene functions.

In addition, one or more polynucleotide sequences or one or more polypeptides encoded by the polynucleotide sequences may be used to search against a BLOCKS (Bairoch et al. (1997) *Nucleic Acids*

Res. 25: 217-221), PFAM, and other databases which contain previously identified and annotated motifs, sequences and gene functions. Methods that search for primary sequence patterns with secondary structure gap penalties (Smith et al. (1992) *Protein Engineering* 5: 35-51) as well as algorithms such as Basic Local Alignment Search Tool (BLAST; Altschul (1993) *J. Mol. Evol.* 36: 290-300; Altschul et al. (1990) supra), BLOCKS (Henikoff and Henikoff (1991) *Nucleic Acids Res.* 19: 6565-6572), Hidden Markov Models (HMM; Eddy (1996) *Curr. Opin. Str. Biol.* 6: 361-365; Sonnhammer et al. (1997) *Proteins* 28: 405-420), and the like, can be used to manipulate and analyze polynucleotide and polypeptide sequences encoded by polynucleotides. These databases, algorithms and other methods are well known in the art and are described in Ausubel et al. (1997; *Short Protocols in Molecular Biology*, John Wiley & Sons, New York, N.Y., unit 7.7) and in Meyers (1995; *Molecular Biology and Biotechnology*, Wiley VCH, New York, N.Y., p 856-853).

A further method for identifying or confirming that specific homologous sequences control the same function is by comparison of the transcript profile(s) obtained upon overexpression or knockout of two or more related transcription factors. Since transcript profiles are diagnostic for specific cellular states, one skilled in the art will appreciate that genes that have a highly similar transcript profile (e.g., with greater than 50% regulated transcripts in common, more preferably with greater than 70% regulated transcripts in common, most preferably with greater than 90% regulated transcripts in common) will have highly similar functions. Fowler et al. (2002) *Plant Cell* 14: 1675-79) have shown that three paralogous AP2 family genes (CBF1, CBF2 and CBF3), each of which is induced upon cold treatment, and each of which can condition improved freezing tolerance, have highly similar transcript profiles. Once a transcription factor has been shown to provide a specific function, its transcript profile becomes a diagnostic tool to determine whether putative paralogs or orthologs have the same function.

Furthermore, methods using manual alignment of sequences similar or homologous to one or more polynucleotide sequences or one or more polypeptides encoded by the polynucleotide sequences may be used to identify regions of similarity and conserved domains. Such manual methods are well-known of those of skill in the art and can include, for example, comparisons of tertiary structure between a polypeptide sequence encoded by a polynucleotide which comprises a known function with a polypeptide sequence encoded by a polynucleotide sequence which has a function not yet determined. Such examples of tertiary structure may comprise predicted alpha helices, beta-sheets, amphipathic helices, leucine zipper motifs, zinc finger motifs, proline-rich regions, cysteine repeat motifs, and the like.

Orthologs and paralogs of presently disclosed transcription factors may be cloned using compositions provided by the present invention according to methods well known in the art. cDNAs can be cloned using mRNA from a plant cell or tissue that expresses one of the present transcription factors. Appropriate mRNA sources may be identified by interrogating Northern blots with probes designed from the present transcription factor sequences, after which a library is prepared from the mRNA obtained from a positive cell or tissue. Transcription factor-encoding cDNA is then isolated using, for example, PCR, using primers designed from a presently disclosed transcription factor gene sequence, or by probing with a partial or complete cDNA or with one or more sets of degenerate probes based on the disclosed sequences. The cDNA library may be used to transform plant cells. Expression of the cDNAs of interest is detected using, for example, methods disclosed herein such as microarrays, Northern blots, quantitative PCR, or any other technique for monitoring changes in expression. Genomic clones may be isolated using similar techniques to those.

Identifying Polynucleotides or Nucleic Acids by Hybridization

Polynucleotides homologous to the sequences illustrated in the Sequence Listing and tables can be identified, e.g., by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in the references cited above.

Encompassed by the invention are polynucleotide sequences that are capable of hybridizing to the claimed polynucleotide sequences, including any of the transcription factor polynucleotides within the Sequence Listing, and fragments thereof under various conditions of stringency (See, for example, Wahl and Berger (1987) *Methods Enzymol.* 152: 399-407; and Kimmel (1987) *Methods Enzymol.* 152: 507-511). In addition to the nucleotide sequences listed in Tables 4-9, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

With regard to hybridization, conditions that are highly stringent, and means for achieving them, are well known in the art. See, for example, Sambrook et al. (1989) "*Molecular Cloning: A Laboratory Manual*" (2nd ed., Cold Spring Harbor Laboratory); Berger and Kimmel, eds., (1987) "Guide to Molecular Cloning Techniques", In *Methods in Enzymology*: 152: 467-469; and Anderson and Young (1985) "Quantitative Filter Hybridisation." In: Hames and Higgins, ed., *Nucleic Acid Hybridisation, A Practical Approach*. Oxford, IRL Press, 73-111.

Stability of DNA duplexes is affected by such factors as base composition, length, and degree of base pair mismatch. Hybridization conditions may be adjusted to allow DNAs of different sequence relatedness to hybridize. The melting temperature ($T_m$) is defined as the temperature when 50% of the duplex molecules have dissociated into their constituent single strands. The melting temperature of a perfectly matched duplex, where the hybridization buffer contains formamide as a denaturing agent, may be estimated by the following equations:

(I) DNA-DNA:

$$T_m(°\text{C.})=81.5+16.6(\log[\text{Na}+])+0.41(\%\,G+C)-0.62(\%\,\text{formamide})-500/L$$

(II) DNA-RNA:

$$T_m(°\text{C.})=79.8+18.5(\log[\text{Na}+])+0.58(\%\,G+C)+0.12(\%\,G+C)^2-0.5(\%\,\text{formamide})-820/L$$

(III) RNA-RNA:

$$T_m(°\text{C.})=79.8+18.5(\log[\text{Na}+])+0.58(\%\,G+C)+0.12(\%\,G+C)^2-0.35(\%\,\text{formamide})-820/L$$

where L is the length of the duplex formed, [Na+] is the molar concentration of the sodium ion in the hybridization or washing solution, and % G+C is the percentage of (guanine+cytosine) bases in the hybrid. For imperfectly matched hybrids, approximately 1° C. is required to reduce the melting temperature for each 1% mismatch.

Hybridization experiments are generally conducted in a buffer of pH between 6.8 to 7.4, although the rate of hybridization is nearly independent of pH at ionic strengths likely to be used in the hybridization buffer (Anderson et al. (1985) supra). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guidelines high stringency is typically performed at $T_m-5°$ C. to $T_m-20°$ C., moderate stringency at $T_m-20°$ C. to $T_m-35°$ C. and low stringency at $T_m-35°$ C. to $T_m-50°$ C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or northern blot for hybridization of complementary nucleic acids that have more than 100 complementary residues is about 5° C. to 20° C. lower than the thermal melting point ($T_m$) for the specific sequence at a defined ionic strength and pH. Conditions used for hybridization may include about 0.02 M to about 0.15 M sodium chloride, about 0.5% to about 5% casein, about 0.02% SDS or about 0.1% N-laurylsarcosine, about 0.001 M to about 0.03 M sodium citrate, at hybridization temperatures between about 50° C. and about 70° C. More preferably, high stringency conditions are about 0.02 M sodium chloride, about 0.5% casein, about 0.02% SDS, about 0.001 M sodium citrate, at a temperature of about 50° C. Nucleic acid molecules that hybridize under stringent conditions will typically hybridize to a probe based on either the entire DNA molecule or selected portions, e.g., to a unique subsequence, of the DNA.

Stringent salt concentration will ordinarily be less than about 750 mM NaCl and 75 mM trisodium citrate. Increasingly stringent conditions may be obtained with less than about 500 mM NaCl and 50 mM trisodium citrate, to even greater stringency with less than about 250 mM NaCl and 25 mM trisodium citrate. Low stringency hybridization can be obtained in the absence of organic solvent, e.g., formamide, whereas high stringency hybridization may be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. with formamide present. Varying additional parameters, such as hybridization time, the concentration of detergent, e.g., sodium dodecyl sulfate (SDS) and ionic strength, are well known to those skilled in the art. Various levels of stringency are accomplished by combining these various conditions as needed.

The washing steps that follow hybridization may also vary in stringency; the post-hybridization wash steps primarily determine hybridization specificity, with the most critical factors being temperature and the ionic strength of the final wash solution. Wash stringency can be increased by decreasing salt concentration or by increasing temperature. Stringent salt concentration for the wash steps will preferably be less than about 30 mM NaCl and 3 mM trisodium citrate, and most preferably less than about 15 mM NaCl and 1.5 mM trisodium citrate.

Thus, hybridization and wash conditions that may be used to bind and remove polynucleotides with less than the desired homology to the nucleic acid sequences or their complements that encode the present transcription factors include, for example:

6×SSC at 65° C.;
50% formamide, 4×SSC at 42° C.; or
0.5×SSC, 0.1% SDS at 65° C.;

with, for example, two wash steps of 10-30 minutes each. Useful variations on these conditions will be readily apparent to those skilled in the art.

A person of skill in the art would not expect substantial variation among polynucleotide species encompassed within the scope of the present invention because the highly stringent conditions set forth in the above formulae yield structurally similar polynucleotides.

If desired, one may employ wash steps of even greater stringency, including about 0.2×SSC, 0.1% SDS at 65° C. and washing twice, each wash step being about 30 min, or about 0.1×SSC, 0.1% SDS at 65° C. and washing twice for 30 min. The temperature for the wash solutions will ordinarily be at least about 25° C., and for greater stringency at least about 42° C. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C. For identification of less closely related homologs, wash steps may be performed at a lower temperature, e.g., 50° C.

An example of a low stringency wash step employs a solution and conditions of at least 25° C. in 30 mM NaCl, 3 mM trisodium citrate, and 0.1% SDS over 30 min. Greater stringency may be obtained at 42° C. in 15 mM NaCl, with 1.5 mM trisodium citrate, and 0.1% SDS over 30 min. Even higher stringency wash conditions are obtained at 65° C.-68° C. in a solution of 15 mM NaCl, 1.5 mM trisodium citrate, and 0.1% SDS. Wash procedures will generally employ at least two final wash steps. Additional variations on these conditions will be readily apparent to those skilled in the art (see, for example, US Patent Application No. 20010010913).

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a transcription factor known as of the filing date of the application. It may be desirable to select conditions for a particular assay such that a higher signal to noise ratio, that is, about 15× or more, is obtained. Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, e.g., a fluorescent label, a colorimetric label, a radioactive label, or the like. Labeled hybridization or PCR probes for detecting related polynucleotide sequences may be produced by oligolabeling, nick translation, end-labeling, or PCR amplification using a labeled nucleotide.

Encompassed by the invention are polynucleotide sequences encoding polypeptides capable of regulating transcription, said polynucleotide sequences being capable of hybridizing to the claimed polynucleotide sequences, including those listed in the Sequence Listing, or polynucleotides that encode the polypeptides listed in the Sequence Listing, and specifically SEQ ID NOs: 1-2237, and fragments thereof under various conditions of stringency. (See, e.g., Wahl and Berger (1987) *Methods Enzymol.* 152: 399-407; Kimmel (1987) *Methods Enzymol.* 152: 507-511.) Estimates of homology are provided by either DNA-DNA or DNA-RNA hybridization under conditions of stringency as is well understood by those skilled in the art (Hames and Higgins, Eds. (1985) *Nucleic Acid Hybridisation*, IRL Press, Oxford, U.K.). Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

Identifying Polynucleotides or Nucleic Acids with Expression Libraries

In addition to hybridization methods, transcription factor homolog polypeptides can be obtained by screening an expression library using antibodies specific for one or more transcription factors. With the provision herein of the disclosed transcription factor, and transcription factor homolog nucleic acid sequences, the encoded polypeptide(s) can be expressed and purified in a heterologous expression system (e.g., *E. coli*) and used to raise antibodies (monoclonal or polyclonal) specific for the polypeptide(s) in question. Antibodies can also be raised against synthetic peptides derived from transcription factor, or transcription factor homolog, amino acid sequences. Methods of raising antibodies are well known in the art and are described in Harlow and Lane (1988), *Antibodies: A Laboratory Manual*, Cold Spring Harbor Laboratory, New York. Such antibodies can then be used to screen an expression library produced from the plant from which it is desired to clone additional transcription factor homologs, using the methods described above. The selected cDNAs can be confirmed by sequencing and enzymatic activity.

Sequence Variations

It will readily be appreciated by those of skill in the art, that any of a variety of polynucleotide sequences are capable of encoding the transcription factors and transcription factor homolog polypeptides of the invention. Due to the degeneracy of the genetic code, many different polynucleotides can encode identical and/or substantially similar polypeptides in addition to those sequences illustrated in the Sequence Listing. Nucleic acids having a sequence that differs from the sequences shown in the Sequence Listing, or complementary sequences, that encode functionally equivalent peptides (i.e., peptides having some degree of equivalent or similar biological activity) but differ in sequence from the sequence shown in the Sequence Listing due to degeneracy in the genetic code, are also within the scope of the invention.

Altered polynucleotide sequences encoding polypeptides include those sequences with deletions, insertions, or substitutions of different nucleotides, resulting in a polynucleotide encoding a polypeptide with at least one functional characteristic of the instant polypeptides. Included within this definition are polymorphisms which may or may not be readily detectable using a particular oligonucleotide probe of the polynucleotide encoding the instant polypeptides, and improper or unexpected hybridization to allelic variants, with a locus other than the normal chromosomal locus for the polynucleotide sequence encoding the instant polypeptides.

Allelic variant refers to any of two or more alternative forms of a gene occupying the same chromosomal locus. Allelic variation arises naturally through mutation, and may result in phenotypic polymorphism within populations. Gene mutations can be silent (i.e., no change in the encoded polypeptide) or may encode polypeptides having altered amino acid sequence. The term allelic variant is also used herein to denote a protein encoded by an allelic variant of a gene. Splice variant refers to alternative forms of RNA transcribed from a gene. Splice variation arises naturally through use of alternative splicing sites within a transcribed RNA molecule, or less commonly between separately transcribed RNA molecules, and may result in several mRNAs transcribed from the same gene. Splice variants may encode polypeptides having altered amino acid sequence. The term splice variant is also used herein to denote a protein encoded by a splice variant of an mRNA transcribed from a gene.

Those skilled in the art would recognize that, for example, G47, SEQ ID NO: 12, represents a single transcription factor; allelic variation and alternative splicing may be expected to occur. Allelic variants of SEQ ID NO: 11 can be cloned by probing cDNA or genomic libraries from different individual organisms according to standard procedures. Allelic variants of the DNA sequence shown in SEQ ID NO: 11, including those containing silent mutations and those in which mutations result in amino acid sequence changes, are within the scope of the present invention, as are proteins which are allelic variants of SEQ ID NO: 12. cDNAs generated from alternatively spliced mRNAs, which retain the properties of the transcription factor are included within the scope of the present invention, as are polypeptides encoded by such cDNAs and mRNAs. Allelic variants and splice variants of these sequences can be cloned by probing cDNA or genomic libraries from different individual organisms or tissues according to standard procedures known in the art (see U.S. Pat. No. 6,388,064).

Thus, in addition to the sequences set forth in the Sequence Listing, the invention also encompasses related nucleic acid molecules that include allelic or splice variants of SEQ ID NO: 2N−1, where N=1-335, sequences that are orthologous to SEQ ID NOs: 761-1348, 1557-2101, and 2124-2237), sequences that are orthologous to paralogous to SEQ ID NOs: 1349-1556, variant sequences that have been shown to confer an altered trait listed in Table 4 (SEQ ID NOs: 2102-2123) listed in the Sequence Listing, and sequences that are complementary to any of the above nucleotide sequences. Related nucleic acid molecules also include nucleotide sequences encoding a polypeptide comprising or consisting essentially of a substitution, modification, addition and/or deletion of one or more amino acid residues compared to the polypeptides as set forth in the Sequence Listing. Such related polypeptides may comprise, for example, additions and/or deletions of one or more N-linked or O-linked glycosylation sites, or an addition and/or a deletion of one or more cysteine residues.

For example, Table 1 illustrates, e.g., that the codons AGC, AGT, TCA, TCC, TCG, and TCT all encode the same amino acid: serine. Accordingly, at each position in the sequence where there is a codon encoding serine, any of the above trinucleotide sequences can be used without altering the encoded polypeptide.

TABLE 1

| Amino acid | | | PossibleCodons | | | | | |
|---|---|---|---|---|---|---|---|---|
| Alanine | Ala | A | GCA | GCC | GCG | GCU | | |
| Cysteine | Cys | C | TGC | TGT | | | | |
| Aspartic acid | Asp | D | GAC | GAT | | | | |
| Glutamic acid | Glu | E | GAA | GAG | | | | |
| Phenylalanine | Phe | F | TTC | TTT | | | | |
| Glycine | Gly | G | GGA | GGC | GGG | GGT | | |
| Histidine | His | H | CAC | CAT | | | | |
| Isoleucine | Ile | I | ATA | ATC | ATT | | | |
| Lysine | Lys | K | AAA | AAG | | | | |
| Leucine | Leu | L | TTA | TTG | CTA | CTC | CTG | CTT |
| Methionine | Met | M | ATG | | | | | |
| Asparagine | Asn | N | AAC | AAT | | | | |
| Proline | Pro | P | CCA | CCC | CCG | CCT | | |
| Glutamine | Gln | Q | CAA | CAG | | | | |
| Arginine | Arg | R | AGA | AGG | CGA | CGC | CGG | CGT |
| Serine | Ser | S | AGC | AGT | TCA | TCC | TCG | TCT |
| Threonine | Thr | T | ACA | ACC | ACG | ACT | | |
| Valine | Val | V | GTA | GTC | GTG | GTT | | |
| Tryptophan | Trp | W | TGG | | | | | |
| Tyrosine | Tyr | Y | TAC | TAT | | | | |

Sequence alterations that do not change the amino acid sequence encoded by the polynucleotide are termed "silent" variations. With the exception of the codons ATG and TGG, encoding methionine and tryptophan, respectively, any of the possible codons for the same amino acid can be substituted by a variety of techniques, e.g., site-directed mutagenesis, available in the art. Accordingly, any and all such variations of a sequence selected from the above table are a feature of the invention.

In addition to silent variations, other conservative variations that alter one, or a few amino acids in the encoded polypeptide, can be made without altering the function of the polypeptide, these conservative variants are, likewise, a feature of the invention.

For example, substitutions, deletions and insertions introduced into the sequences provided in the Sequence Listing, are also envisioned by the invention. Such sequence modifications can be engineered into a sequence by site-directed mutagenesis (Wu (ed.) *Methods Enzymol.* (1993) vol. 217, Academic Press) or the other methods noted below Amino acid substitutions are typically of single residues; insertions usually will be on the order of about from 1 to 10 amino acid residues; and deletions will range about from 1 to 30 residues. In preferred embodiments, deletions or insertions are made in adjacent pairs, e.g., a deletion of two residues or insertion of two residues. Substitutions, deletions, insertions or any combination thereof can be combined to arrive at a sequence. The mutations that are made in the polynucleotide encoding the transcription factor should not place the sequence out of reading frame and should not create complementary regions that could produce secondary mRNA structure. Preferably, the polypeptide encoded by the DNA performs the desired function.

Conservative substitutions are those in which at least one residue in the amino acid sequence has been removed and a different residue inserted in its place. Such substitutions generally are made in accordance with the Table 2 when it is desired to maintain the activity of the protein. Table 2 shows amino acids which can be substituted for an amino acid in a protein and which are typically regarded as conservative substitutions.

TABLE 2

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Similar substitutions are those in which at least one residue in the amino acid sequence has been removed and a different residue inserted in its place. Such substitutions generally are made in accordance with the Table 3 when it is desired to maintain the activity of the protein. Table 3 shows amino acids which can be substituted for an amino acid in a protein and which are typically regarded as structural and functional substitutions. For example, a residue in column 1 of Table 3 may be substituted with a residue in column 2; in addition, a residue in column 2 of Table 3 may be substituted with the residue of column 1

TABLE 3

| Residue | Similar Substitutions |
|---|---|
| Ala | Ser; Thr; Gly; Val; Leu; Ile |
| Arg | Lys; His; Gly |
| Asn | Gln; His; Gly; Ser; Thr |
| Asp | Glu, Ser; Thr |
| Gln | Asn; Ala |
| Cys | Ser; Gly |
| Glu | Asp |
| Gly | Pro; Arg |
| His | Asn; Gln; Tyr; Phe; Lys; Arg |
| Ile | Ala; Leu; Val; Gly; Met |
| Leu | Ala; Ile; Val; Gly; Met |
| Lys | Arg; His; Gln; Gly; Pro |
| Met | Leu; Ile; Phe |
| Phe | Met; Leu; Tyr; Trp; His; Val; Ala |
| Ser | Thr; Gly; Asp; Ala; Val; Ile; His |
| Thr | Ser; Val; Ala; Gly |
| Trp | Tyr; Phe; His |
| Tyr | Trp; Phe; His |
| Val | Ala; Ile; Leu; Gly; Thr; Ser; Glu |

Substitutions that are less conservative than those in Table 2 can be selected by picking residues that differ more significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. The substitutions which in general are expected to produce the greatest changes in protein properties will be those in which (a) a hydrophilic residue, e.g., seryl or threonyl, is substituted for (or by) a hydrophobic residue, e.g., leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine.

Further Modifying Sequences of the Invention—Mutation/Forced Evolution

In addition to generating silent or conservative substitutions as noted, above, the present invention optionally includes methods of modifying the sequences of the Sequence Listing. In the methods, nucleic acid or protein modification methods are used to alter the given sequences to produce new sequences and/or to chemically or enzymatically modify given sequences to change the properties of the nucleic acids or proteins.

Thus, in one embodiment, given nucleic acid sequences are modified, e.g., according to standard mutagenesis or artificial evolution methods to produce modified sequences. The modified sequences may be created using purified natural polynucleotides isolated from any organism or may be synthesized from purified compositions and chemicals using chemical means well know to those of skill in the art. For example, Ausubel, supra, provides additional details on mutagenesis methods. Artificial forced evolution methods are described, for example, by Stemmer (1994) *Nature* 370: 389-391, Stemmer (1994) *Proc. Natl. Acad. Sci.* 91: 10747-10751, and U.S. Pat. Nos. 5,811,238, 5,837,500, and 6,242,568.

Methods for engineering synthetic transcription factors and other polypeptides are described, for example, by Zhang et al. (2000) *J. Biol. Chem.* 275: 33850-33860, Liu et al. (2001) *J. Biol. Chem.* 276: 11323-11334, and Isalan et al. (2001) *Nature Biotechnol.* 19: 656-660. Many other mutation and evolution methods are also available and expected to be within the skill of the practitioner.

Similarly, chemical or enzymatic alteration of expressed nucleic acids and polypeptides can be performed by standard methods. For example, sequence can be modified by addition of lipids, sugars, peptides, organic or inorganic compounds, by the inclusion of modified nucleotides or amino acids, or the like. For example, protein modification techniques are illustrated in Ausubel, supra. Further details on chemical and enzymatic modifications can be found herein. These modification methods can be used to modify any given sequence, or to modify any sequence produced by the various mutation and artificial evolution modification methods noted herein.

Accordingly, the invention provides for modification of any given nucleic acid by mutation, evolution, chemical or enzymatic modification, or other available methods, as well as for the products produced by practicing such methods, e.g., using the sequences herein as a starting substrate for the various modification approaches.

For example, optimized coding sequence containing codons preferred by a particular prokaryotic or eukaryotic host can be used e.g., to increase the rate of translation or to produce recombinant RNA transcripts having desirable properties, such as a longer half-life, as compared with transcripts produced using a non-optimized sequence. Translation stop codons can also be modified to reflect host preference. For example, preferred stop codons for *Saccharomyces cerevisiae* and mammals are TAA and TGA, respectively. The preferred stop codon for monocotyledonous plants is TGA, whereas insects and *E. coli* prefer to use TAA as the stop codon.

The polynucleotide sequences of the present invention can also be engineered in order to alter a coding sequence for a variety of reasons, including but not limited to, alterations which modify the sequence to facilitate cloning, processing and/or expression of the gene product. For example, alterations are optionally introduced using techniques which are well known in the art, e.g., site-directed mutagenesis, to insert new restriction sites, to alter glycosylation patterns, to change codon preference, to introduce splice sites, etc.

Furthermore, a fragment or domain derived from any of the polypeptides of the invention can be combined with domains derived from other transcription factors or synthetic domains to modify the biological activity of a transcription factor. For instance, a DNA-binding domain derived from a transcription factor of the invention can be combined with the activation domain of another transcription factor or with a synthetic activation domain. A transcription activation domain assists in initiating transcription from a DNA-binding site. Examples include the transcription activation region of VP16 or GAL4 (Moore et al. (1998) *Proc. Natl. Acad. Sci.* 95: 376-381; Aoyama et al. (1995) *Plant Cell* 7: 1773-1785), peptides derived from bacterial sequences (Ma and Ptashne (1987) *Cell* 51: 113-119) and synthetic peptides (Giniger and Ptashne (1987) *Nature* 330: 670-672).

Expression and Modification of Polypeptides

Typically, polynucleotide sequences of the invention are incorporated into recombinant DNA (or RNA) molecules that direct expression of polypeptides of the invention in appropriate host cells, transgenic plants, in vitro translation systems, or the like. Due to the inherent degeneracy of the genetic code, nucleic acid sequences which encode substantially the same or a functionally equivalent amino acid sequence can be substituted for any listed sequence to provide for cloning and expressing the relevant homolog.

The transgenic plants of the present invention comprising recombinant polynucleotide sequences are generally derived from parental plants, which may themselves be non-transformed (or non-transgenic) plants. These transgenic plants may either have a transcription factor gene "knocked out" (for example, with a genomic insertion by homologous recombination, an antisense or ribozyme construct) or expressed to a normal or wild-type extent. The transgenic plants of the present invention includes, for example, a plant in which a transcription factor gene encoding a transcription factor polypeptide has been eliminated by homologous recombination, said transcription factor polypeptide comprising a HLH/MYC conserved domain that is at least 85% identical to the conserved HLH/MYC domain of SEQ ID NO: 594 (amino acid coordinates 65-137). Overexpressing transgenic "progeny" plants will exhibit greater mRNA levels, wherein the mRNA encodes a transcription factor, that is, a DNA-binding protein that is capable of binding to a DNA regulatory sequence and inducing transcription, and preferably, expression of a plant trait gene. Preferably, the mRNA expression level will be at least three-fold greater than that of the parental plant, or more preferably at least ten-fold greater mRNA levels compared to said parental plant, and most preferably at least fifty-fold greater compared to said parental plant.

Vectors, Promoters, and Expression Systems

The present invention includes recombinant constructs comprising one or more of the nucleic acid sequences herein. The constructs typically comprise a vector, such as a plasmid, a cosmid, a phage, a virus (e.g., a plant virus), a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

General texts that describe molecular biological techniques useful herein, including the use and production of vectors, promoters and many other relevant topics, include Berger, Sambrook, supra and Ausubel, supra. Any of the identified sequences can be incorporated into a cassette or vector, e.g., for expression in plants. A number of expression vectors suitable for stable transformation of plant cells or for the establishment of transgenic plants have been described including those described in Weissbach and Weissbach (1989) *Methods for Plant Molecular Biology*, Academic Press, and Gelvin et al. (1990) *Plant Molecular Biology Manual*, Kluwer Academic Publishers. Specific examples include those derived from a Ti plasmid of *Agrobacterium tumefaciens*, as well as those disclosed by Herrera-Estrella et al. (1983) *Nature* 303: 209, Bevan (1984) *Nucleic Acids Res.* 12: 8711-8721, Klee (1985) *Bio/Technology* 3: 637-642, for dicotyledonous plants.

Alternatively, non-Ti vectors can be used to transfer the DNA into monocotyledonous plants and cells by using free DNA delivery techniques. Such methods can involve, for example, the use of liposomes, electroporation, microprojectile bombardment, silicon carbide whiskers, and viruses. By using these methods transgenic plants such as wheat, rice (Christou (1991) *Bio/Technology* 9: 957-962) and corn (Gordon-Kamm (1990) *Plant Cell* 2: 603-618) can be produced. An immature embryo can also be a good target tissue for monocots for direct DNA delivery techniques by using the particle gun (Weeks et al. (1993) *Plant Physiol.* 102: 1077-1084; Vasil (1993) *Bio/Technology* 10: 667-674; Wan and Lemeaux (1994) *Plant Physiol.* 104: 37-48, and for *Agrobacterium*-mediated DNA transfer (Ishida et al. (1996) *Nature Biotechnol.* 14: 745-750).

Typically, plant transformation vectors include one or more cloned plant coding sequence (genomic or cDNA) under the transcriptional control of 5' and 3' regulatory sequences and a dominant selectable marker. Such plant transformation vectors typically also contain a promoter (e.g., a regulatory region controlling inducible or constitutive, environmentally- or developmentally-regulated, or cell- or tissue-specific expression), a transcription initiation start site, an RNA processing signal (such as intron splice sites), a transcription termination site, and/or a polyadenylation signal.

A potential utility for the transcription factor polynucleotides disclosed herein is the isolation of promoter elements from these genes that can be used to program expression in plants of any genes. Each transcription factor gene disclosed herein is expressed in a unique fashion, as determined by promoter elements located upstream of the start of translation, and additionally within an intron of the transcription factor gene or downstream of the termination codon of the gene. As is well known in the art, for a significant portion of genes, the promoter sequences are located entirely in the region directly upstream of the start of translation. In such cases, typically the promoter sequences are located within 2.0 kb of the start of translation, or within 1.5 kb of the start of translation, frequently within 1.0 kb of the start of translation, and sometimes within 0.5 kb of the start of translation.

The promoter sequences can be isolated according to methods known to one skilled in the art.

Examples of constitutive plant promoters which can be useful for expressing the TF sequence include: the cauliflower mosaic virus (CaMV) 35S promoter, which confers constitutive, high-level expression in most plant tissues (see, e.g., Odell et al. (1985) *Nature* 313: 810-812); the nopaline synthase promoter (An et al. (1988) *Plant Physiol.* 88: 547-552); and the octopine synthase promoter (Fromm et al. (1989) *Plant Cell* 1: 977-984).

A variety of plant gene promoters that regulate gene expression in response to environmental, hormonal, chemical, developmental signals, and in a tissue-active manner can be used for expression of a TF sequence in plants. Choice of a promoter is based largely on the phenotype of interest and is determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like. Numerous known promoters have been characterized and can favorably be employed to promote expression of a polynucleotide of the invention in a transgenic plant or cell of interest. For example, tissue specific promoters include: seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2A11 promoter (U.S. Pat. No. 4,943,674) and the tomato polygalacturonase promoter (Bird et al. (1988) *Plant Mol. Biol.* 11: 651-662), root-specific promoters, such as those disclosed in U.S. Pat. Nos. 5,618,988, 5,837,848 and 5,905,186, pollen-active promoters such as PTA29, PTA26 and PTA13 (U.S. Pat. No. 5,792,929), promoters active in vascular tissue (Ringli and Keller (1998) *Plant Mol. Biol.* 37: 977-988), flower-specific (Kaiser et al. (1995) *Plant Mol. Biol.* 28: 231-243), pollen (Baerson et al. (1994) *Plant Mol. Biol.* 26: 1947-1959), carpels (Ohl et al. (1990) *Plant Cell* 2: 837-848), pollen and ovules (Baerson et al. (1993) *Plant Mol. Biol.* 22: 255-267), auxin-inducible promoters (such as that described in van der Kop et al. (1999) *Plant Mol. Biol.* 39: 979-990 or Baumann et al., (1999) *Plant Cell* 11: 323-334), cytokinin-inducible promoter (Guevara-Garcia (1998) *Plant Mol. Biol.* 38: 743-753), promoters responsive to gibberellin (Shi et al. (1998) *Plant Mol. Biol.* 38: 1053-1060, Willmott et al. (1998) *Plant Molec. Biol.* 38: 817-825) and the like. Additional promoters are those that elicit expression in response to heat (Ainley et al. (1993) *Plant Mol. Biol.* 22: 13-23), light (e.g., the pea rbcS-3A promoter, Kuhlemeier et al. (1989) *Plant Cell* 1: 471-478, and the maize rbcS promoter, Schaffner and Sheen (1991) *Plant Cell* 3: 997-1012); wounding (e.g., wunI, Siebertz et al. (1989) *Plant Cell* 1: 961-968); pathogens (such as the PR-1 promoter described in Buchel et al. (1999) *Plant Mol. Biol.* 40: 387-396, and the PDF1.2 promoter described in Manners et al. (1998) *Plant Mol. Biol.* 38: 1071-1080), and chemicals such as methyl jasmonate or salicylic acid (Gatz (1997) *Annu. Rev. Plant Physiol. Plant Mol. Biol.* 48: 89-108). In addition, the timing of the expression can be controlled by using promoters such as those acting at senescence (Gan and Amasino (1995) *Science* 270: 1986-1988); or late seed development (Odell et al. (1994) *Plant Physiol.* 106: 447-458).

Plant expression vectors can also include RNA processing signals that can be positioned within, upstream or downstream of the coding sequence. In addition, the expression vectors can include additional regulatory sequences from the 3'-untranslated region of plant genes, e.g., a 3' terminator region to increase mRNA stability of the mRNA, such as the PI-II terminator region of potato or the octopine or nopaline synthase 3' terminator regions.

Additional Expression Elements

Specific initiation signals can aid in efficient translation of coding sequences. These signals can include, e.g., the ATG initiation codon and adjacent sequences. In cases where a coding sequence, its initiation codon and upstream sequences are inserted into the appropriate expression vector, no additional translational control signals may be needed. However, in cases where only coding sequence (e.g., a mature protein coding sequence), or a portion thereof, is inserted, exogenous transcriptional control signals including the ATG initiation codon can be separately provided. The initiation codon is provided in the correct reading frame to facilitate transcription. Exogenous transcriptional elements and initiation codons can be of various origins, both natural and synthetic. The efficiency of expression can be enhanced by the inclusion of enhancers appropriate to the cell system in use.

Expression Hosts

The present invention also relates to host cells which are transduced with vectors of the invention, and the production of polypeptides of the invention (including fragments thereof) by recombinant techniques. Host cells are genetically engineered (i.e., nucleic acids are introduced, e.g., transduced, transformed or transfected) with the vectors of this invention, which may be, for example, a cloning vector or an expression vector comprising the relevant nucleic acids herein. The vector is optionally a plasmid, a viral particle, a phage, a naked nucleic acid, etc. The engineered host cells can be cultured in conventional nutrient media modified as appropriate for activating promoters, selecting transformants, or amplifying the relevant gene. The culture conditions, such as temperature, pH and the like, are those previously used with the host cell selected for expression, and will be apparent to those skilled in the art and in the references cited herein, including, Sambrook, supra and Ausubel, supra.

The host cell can be a eukaryotic cell, such as a yeast cell, or a plant cell, or the host cell can be a prokaryotic cell, such as a bacterial cell. Plant protoplasts are also suitable for some applications. For example, the DNA fragments are introduced into plant tissues, cultured plant cells or plant protoplasts by standard methods including electroporation (Fromm et al. (1985) *Proc. Natl. Acad. Sci.* 82: 5824-5828, infection by viral vectors such as cauliflower mosaic virus (CaMV) (Hohn et al. (1982) *Molecular Biology of Plant Tumors Academic Press*, New York, N.Y., pp. 549-560; U.S. Pat. No. 4,407, 956), high velocity ballistic penetration by small particles with the nucleic acid either within the matrix of small beads or particles, or on the surface (Klein et al. (1987) *Nature* 327: 70-73), use of pollen as vector (WO 85/01856), or use of *Agrobacterium tumefaciens* or *A. rhizogenes* carrying a T-DNA plasmid in which DNA fragments are cloned. The T-DNA plasmid is transmitted to plant cells upon infection by *Agrobacterium tumefaciens*, and a portion is stably integrated into the plant genome (Horsch et al. (1984) *Science* 233: 496-498; Fraley et al. (1983) *Proc. Natl. Acad. Sci.* 80: 4803-4807).

The cell can include a nucleic acid of the invention that encodes a polypeptide, wherein the cell expresses a polypeptide of the invention. The cell can also include vector sequences, or the like. Furthermore, cells and transgenic plants that include any polypeptide or nucleic acid above or throughout this specification, e.g., produced by transduction of a vector of the invention, are an additional feature of the invention.

For long-term, high-yield production of recombinant proteins, stable expression can be used. Host cells transformed with a nucleotide sequence encoding a polypeptide of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing polynucleotides encoding mature proteins of the invention can be designed with signal sequences which direct secretion of the mature polypeptides through a prokaryotic or eukaryotic cell membrane.

Modified Amino Acid Residues

Polypeptides of the invention may contain one or more modified amino acid residues. The presence of modified amino acids may be advantageous in, for example, increasing polypeptide half-life, reducing polypeptide antigenicity or toxicity, increasing polypeptide storage stability, or the like Amino acid residue(s) are modified, for example, co-translationally or post-translationally during recombinant production or modified by synthetic or chemical means.

Non-limiting examples of a modified amino acid residue include incorporation or other use of acetylated amino acids, glycosylated amino acids, sulfated amino acids, prenylated (e.g., farnesylated, geranylgeranylated) amino acids, PEG modified (e.g., "PEGylated") amino acids, biotinylated amino acids, carboxylated amino acids, phosphorylated amino acids, etc. References adequate to guide one of skill in the modification of amino acid residues are replete throughout the literature.

The modified amino acid residues may prevent or increase affinity of the polypeptide for another molecule, including, but not limited to, polynucleotide, proteins, carbohydrates, lipids and lipid derivatives, and other organic or synthetic compounds.

Identification of Additional Factors

A transcription factor provided by the present invention can also be used to identify additional endogenous or exogenous molecules that can affect a phentoype or trait of interest. On the one hand, such molecules include organic (small or large molecules) and/or inorganic compounds that affect expression of (i.e., regulate) a particular transcription factor. Alternatively, such molecules include endogenous molecules that are acted upon either at a transcriptional level by a transcription factor of the invention to modify a phenotype as desired. For example, the transcription factors can be employed to identify one or more downstream genes that are subject to a regulatory effect of the transcription factor. In one approach, a transcription factor or transcription factor homolog of the invention is expressed in a host cell, e.g., a transgenic plant cell, tissue or explant, and expression products, either RNA or protein, of likely or random targets are monitored, e.g., by hybridization to a microarray of nucleic acid probes corresponding to genes expressed in a tissue or cell type of interest, by two-dimensional gel electrophoresis of protein products, or by any other method known in the art for assessing expression of gene products at the level of RNA or protein. Alternatively, a transcription factor of the invention can be used to identify promoter sequences (such as binding sites on DNA sequences) involved in the regulation of a downstream target. After identifying a promoter sequence, interactions between the transcription factor and the promoter sequence can be modified by changing specific nucleotides in the promoter sequence or specific amino acids in the transcription factor that interact with the promoter sequence to alter a plant trait. Typically, transcription factor DNA-binding sites are identified by gel shift assays. After identifying the promoter regions, the promoter region sequences can be employed in double-stranded DNA arrays to identify molecules that affect the interactions of the transcription factors with their promoters (Bulyk et al. (1999) *Nature Biotechnol.* 17: 573-577).

The identified transcription factors are also useful to identify proteins that modify the activity of the transcription factor. Such modification can occur by covalent modification, such as by phosphorylation, or by protein-protein (homo or-heteropolymer) interactions. Any method suitable for detecting protein-protein interactions can be employed. Among the methods that can be employed are co-immunoprecipitation, cross-linking and co-purification through gradients or chromatographic columns, and the two-hybrid yeast system.

The two-hybrid system detects protein interactions in vivo and is described in Chien et al. ((1991) *Proc. Natl. Acad. Sci.* 88: 9578-9582) and is commercially available from Clontech (Palo Alto, Calif.). In such a system, plasmids are constructed that encode two hybrid proteins: one consists of the DNA-binding domain of a transcription activator protein fused to the TF polypeptide and the other consists of the transcription activator protein's activation domain fused to an unknown protein that is encoded by a cDNA that has been recombined into the plasmid as part of a cDNA library. The DNA-binding domain fusion plasmid and the cDNA library are transformed into a strain of the yeast *Saccharomyces cerevisiae* that contains a reporter gene (e.g., lacZ) whose regulatory region contains the transcription activator's binding site. Either hybrid protein alone cannot activate transcription of the reporter gene. Interaction of the two hybrid proteins reconstitutes the functional activator protein and results in expression of the reporter gene, which is detected by an assay for the reporter gene product. Then, the library plasmids responsible for reporter gene expression are isolated and sequenced to identify the proteins encoded by the library plasmids. After identifying proteins that interact with the transcription factors, assays for compounds that interfere with the TF protein-protein interactions can be preformed.

Identification of Modulators

In addition to the intracellular molecules described above, extracellular molecules that alter activity or expression of a transcription factor, either directly or indirectly, can be identified. For example, the methods can entail first placing a candidate molecule in contact with a plant or plant cell. The molecule can be introduced by topical administration, such as spraying or soaking of a plant, or incubating a plant in a solution containing the molecule, and then the molecule's effect on the expression or activity of the TF polypeptide or the expression of the polynucleotide monitored. Changes in the expression of the TF polypeptide can be monitored by use of polyclonal or monoclonal antibodies, gel electrophoresis or the like. Changes in the expression of the corresponding polynucleotide sequence can be detected by use of microarrays, Northerns, quantitative PCR, or any other technique for monitoring changes in mRNA expression. These techniques are exemplified in Ausubel et al. (eds.) *Current Protocols in Molecular Biology*, John Wiley & Sons (1998, and supplements through 2001). Changes in the activity of the transcription factor can be monitored, directly or indirectly, by assaying the function of the transcription factor, for example, by measuring the expression of promoters known to be controlled by the transcription factor (using promoter-reporter constructs), measuring the levels of transcripts using microarrays, Northern blots, quantitative PCR, etc. Such changes in the expression levels can be correlated with modified plant traits and thus identified molecules can be useful for soaking or spraying on fruit, vegetable and grain crops to modify traits in plants.

Essentially any available composition can be tested for modulatory activity of expression or activity of any nucleic acid or polypeptide herein. Thus, available libraries of compounds such as chemicals, polypeptides, nucleic acids and the like can be tested for modulatory activity. Often, potential modulator compounds can be dissolved in aqueous or organic (e.g., DMSO-based) solutions for easy delivery to the cell or plant of interest in which the activity of the modulator is to be tested. Optionally, the assays are designed to screen large modulator composition libraries by automating the assay steps and providing compounds from any convenient source to assays, which are typically run in parallel (e.g., in microtiter formats on micrometer plates in robotic assays).

In one embodiment, high throughput screening methods involve providing a combinatorial library containing a large number of potential compounds (potential modulator compounds). Such "combinatorial chemical libraries" are then screened in one or more assays, as described herein, to identify those library members (particular chemical species or subclasses) that display a desired characteristic activity. The compounds thus identified can serve as target compounds.

A combinatorial chemical library can be, e.g., a collection of diverse chemical compounds generated by chemical synthesis or biological synthesis. For example, a combinatorial chemical library such as a polypeptide library is formed by combining a set of chemical building blocks (e.g., in one example, amino acids) in every possible way for a given compound length (i.e., the number of amino acids in a polypeptide compound of a set length). Exemplary libraries include peptide libraries, nucleic acid libraries, antibody libraries (see, e.g., Vaughn et al. (1996) *Nature Biotechnol.* 14: 309-314 and PCT/US96/10287), carbohydrate libraries (see, e.g., Liang et al. Science (1996) 274: 1520-1522 and U.S. Pat. No. 5,593,853), peptide nucleic acid libraries (see, e.g., U.S. Pat. No. 5,539,083), and small organic molecule libraries (see, e.g., benzodiazepines, in Baum *Chem. & Engineering News Jan.* 18, 1993, page 33; isoprenoids, U.S. Pat. No. 5,569,588; thiazolidinones and metathiazanones, U.S. Pat. No. 5,549,974; pyrrolidines, U.S. Pat. Nos. 5,525,735 and 5,519,134; morpholino compounds, U.S. Pat. No. 5,506,337) and the like.

Preparation and screening of combinatorial or other libraries is well known to those of skill in the art. Such combinatorial chemical libraries include, but are not limited to, peptide libraries (see, e.g., U.S. Pat. No. 5,010,175; Furka, (1991) *Int. J. Pept. Prot. Res.* 37: 487-493; and Houghton et al. (1991) *Nature* 354: 84-88). Other chemistries for generating chemical diversity libraries can also be used.

In addition, as noted, compound screening equipment for high-throughput screening is generally available, e.g., using any of a number of well known robotic systems that have also been developed for solution phase chemistries useful in assay systems. These systems include automated workstations including an automated synthesis apparatus and robotic systems utilizing robotic arms. Any of the above devices are suitable for use with the present invention, e.g., for high-throughput screening of potential modulators. The nature and implementation of modifications to these devices (if any) so that they can operate as discussed herein will be apparent to persons skilled in the relevant art.

Indeed, entire high-throughput screening systems are commercially available. These systems typically automate entire procedures including all sample and reagent pipetting, liquid dispensing, timed incubations, and final readings of the microplate in detector(s) appropriate for the assay. These configurable systems provide high throughput and rapid start up as well as a high degree of flexibility and customization. Similarly, microfluidic implementations of screening are also commercially available.

The manufacturers of such systems provide detailed protocols the various high throughput. Thus, for example, Zymark Corp. provides technical bulletins describing screening systems for detecting the modulation of gene transcription, ligand binding, and the like. The integrated systems herein, in addition to providing for sequence alignment and, optionally, synthesis of relevant nucleic acids, can include such screening apparatus to identify modulators that have an effect on one or more polynucleotides or polypeptides according to the present invention.

In some assays it is desirable to have positive controls to ensure that the components of the assays are working properly. At least two types of positive controls are appropriate. That is, known transcriptional activators or inhibitors can be incubated with cells or plants, for example, in one sample of the assay, and the resulting increase/decrease in transcription can be detected by measuring the resulting increase in RNA levels and/or protein expression, for example, according to the methods herein. It will be appreciated that modulators can also be combined with transcriptional activators or inhibitors to find modulators that inhibit transcriptional activation or transcriptional repression. Either expression of the nucleic acids and proteins herein or any additional nucleic acids or proteins activated by the nucleic acids or proteins herein, or both, can be monitored.

In an embodiment, the invention provides a method for identifying compositions that modulate the activity or expression of a polynucleotide or polypeptide of the invention. For example, a test compound, whether a small or large molecule, is placed in contact with a cell, plant (or plant tissue or explant), or composition comprising the polynucleotide or polypeptide of interest and a resulting effect on the cell, plant, (or tissue or explant) or composition is evaluated by monitoring, either directly or indirectly, one or more of: expression level of the polynucleotide or polypeptide, activity (or modulation of the activity) of the polynucleotide or polypeptide. In some cases, an alteration in a plant phenotype can be detected following contact of a plant (or plant cell, or tissue or explant) with the putative modulator, e.g., by modulation of expression or activity of a polynucleotide or polypeptide of the invention. Modulation of expression or activity of a polynucleotide or polypeptide of the invention may also be caused by molecular elements in a signal transduction second messenger pathway and such modulation can affect similar elements in the same or another signal transduction second messenger pathway.

Subsequences

Also contemplated are uses of polynucleotides, also referred to herein as oligonucleotides, typically having at least 12 bases, preferably at least 15, more preferably at least 20, 30, or 50 bases, which hybridize under at least highly stringent (or ultra-high stringent or ultra-ultra-high stringent conditions) conditions to a polynucleotide sequence described above. The polynucleotides may be used as probes, primers, sense and antisense agents, and the like, according to methods as noted supra.

Subsequences of the polynucleotides of the invention, including polynucleotide fragments and oligonucleotides are useful as nucleic acid probes and primers. An oligonucleotide suitable for use as a probe or primer is at least about 15 nucleotides in length, more often at least about 18 nucleotides, often at least about 21 nucleotides, frequently at least about 30 nucleotides, or about 40 nucleotides, or more in length. A nucleic acid probe is useful in hybridization protocols, e.g., to identify additional polypeptide homologs of the invention, including protocols for microarray experiments. Primers can be annealed to a complementary target DNA strand by nucleic acid hybridization to form a hybrid between the primer and the target DNA strand, and then extended along the target DNA strand by a DNA polymerase enzyme. Primer pairs can be used for amplification of a nucleic acid sequence, e.g., by the polymerase chain reaction (PCR) or other nucleic-acid amplification methods. See Sambrook, supra, and Ausubel, supra.

In addition, the invention includes an isolated or recombinant polypeptide including a subsequence of at least about 15 contiguous amino acids encoded by the recombinant or isolated polynucleotides of the invention. For example, such polypeptides, or domains or fragments thereof, can be used as immunogens, e.g., to produce antibodies specific for the polypeptide sequence, or as probes for detecting a sequence of interest. A subsequence can range in size from about 15 amino acids in length up to and including the full length of the polypeptide.

To be encompassed by the present invention, an expressed polypeptide which comprises such a polypeptide subsequence performs at least one biological function of the intact polypeptide in substantially the same manner, or to a similar extent, as does the intact polypeptide. For example, a polypeptide fragment can comprise a recognizable structural motif or functional domain such as a DNA binding domain that activates transcription, e.g., by binding to a specific DNA promoter region an activation domain, or a domain for protein-protein interactions.

Production of Transgenic Plants

Modification of Traits

The polynucleotides of the invention are favorably employed to produce transgenic plants with various traits, or characteristics, that have been modified in a desirable manner, e.g., to improve the seed characteristics of a plant. For example, alteration of expression levels or patterns (e.g., spatial or temporal expression patterns) of one or more of the transcription factors (or transcription factor homologs) of the invention, as compared with the levels of the same protein found in a wild-type plant, can be used to modify a plant's traits. An illustrative example of trait modification, improved characteristics, by altering expression levels of a particular transcription factor is described further in the Examples and the Sequence Listing.

Arabidopsis as a Model System

Arabidopsis thaliana is the object of rapidly growing attention as a model for genetics and metabolism in plants. Arabidopsis has a small genome, and well-documented studies are available. It is easy to grow in large numbers and mutants defining important genetically controlled mechanisms are either available, or can readily be obtained. Various methods to introduce and express isolated homologous genes are available (see Koncz et al., eds., Methods in Arabidopsis Research (1992) World Scientific, New Jersey, N.J., in "Preface"). Because of its small size, short life cycle, obligate autogamy and high fertility, Arabidopsis is also a choice organism for the isolation of mutants and studies in morphogenetic and development pathways, and control of these pathways by transcription factors (Koncz supra, p. 72). A number of studies introducing transcription factors into A. thaliana have demonstrated the utility of this plant for understanding the mechanisms of gene regulation and trait alteration in plants. (See, for example, Koncz supra, and U.S. Pat. No. 6,417,428).

Homologous Genes Introduced into Transgenic Plants.

Homologous genes that may be derived from any plant, or from any source whether natural, synthetic, semi-synthetic or recombinant, and that share significant sequence identity or similarity to those provided by the present invention, may be introduced into plants, for example, crop plants, to confer desirable or improved traits. Consequently, transgenic plants may be produced that comprise a recombinant expression vector or cassette with a promoter operably linked to one or more sequences homologous to presently disclosed sequences. The promoter may be, for example, a plant or viral promoter.

The invention thus provides for methods for preparing transgenic plants, and for modifying plant traits. These methods include introducing into a plant a recombinant expression vector or cassette comprising a functional promoter operably linked to one or more sequences homologous to presently disclosed sequences. Plants and kits for producing these plants that result from the application of these methods are also encompassed by the present invention.

Transcription Factors of Interest for the Modification of Plant Traits

Currently, the existence of a series of maturity groups for different latitudes represents a major barrier to the introduction of new valuable traits. Any trait (e.g. disease resistance) has to be bred into each of the different maturity groups separately, a laborious and costly exercise. The availability of single strain, which could be grown at any latitude, would therefore greatly increase the potential for introducing new traits to crop species such as soybean and cotton.

For many of the specific effects, traits and utilities listed in Table 4 and Table 6 that may be conferred to plants, one or more transcription factor genes may be used to increase or decrease, advance or delay, or improve or prove deleterious to a given trait. For example, overexpression of a transcription factor gene that naturally occurs in a plant may cause early flowering relative to non-transformed or wild-type plants. By knocking out the gene, or suppressing the gene (with, for example, antisense suppression) the plant may experience delayed flowering. Similarly, overexpressing or suppressing one or more genes can impart significant differences in production of plant products, such as different fatty acid ratios. Thus, suppressing a gene that causes a plant to be more sensitive to cold may improve a plant's tolerance of cold. More than one transcription factor gene may be introduced into a plant, either by transforming the plant with one or more vectors comprising two or more transcription factors, or by selective breeding of plants to yield hybrid crosses that comprise more than one introduced transcription factor.

A listing of specific effects and utilities that the presently disclosed transcription factor genes have on plants, as determined by direct observation and assay analysis, is provided in Table 4. Table 4 shows the polynucleotides identified by SEQ ID NO; Gene ID No. (GID); and if the polynucleotide was tested in a transgenic assay. The first column shows the polynucleotide SEQ ID NO; the second column shows the GID; the third column shows whether the gene was overexpressed (OE) or knocked out (KO) in plant studies; the fourth column shows the category of modified trait resulting from the knock out or overexpression of the polynucleotide in the transgenic plant; and the fifth column ("Experimental Observations"), includes specific observations made with respect to the polynucleotide of the respective first column.

TABLE 4

Traits, trait categories, and effects and utilities that transcription factor genes have on plants.

| SEQ ID NO: | GID | OE/ KO | Category | Experimental Observations |
|---|---|---|---|---|
| 7 | G30 | OE | Leaf; altered shape | Long cotyledons, petioles and hypocotyls, dark green, glossy leaves; shade avoidance |
|  |  |  | Leaf; dark green leaves |  |
|  |  |  | Leaf; glossy leaves |  |
|  |  |  | Light response; Long petioles |  |
|  |  |  | Light response; Long hypocotyls |  |
|  |  |  | Light response; Long cotyledons |  |
| 11 | G47 | OE | Flowering time | Late flowering |
|  |  | OE | Abiotic stress; osmotic stress | Better root growth under osmotic stress |
|  |  | OE | Dev and morph; Architecture | Altered architecture and inflorescence development |
|  |  | OE | Dev and morph; stem | Altered structure of vascular tissues |
|  |  | OE | Abiotic stress; drought | Increased tolerance to drought in a soil-based assay |
| 33 | G142 | OE | Flowering time | Early flowering |
| 39 | G148 | OE | Flowering time | Early flowering |
|  |  |  | Inflorescence; terminal flowers | Terminal flower |
| 43 | G153 | OE | Flowering time | Early flowering |
|  |  | OE | Abiotic stress; Nutrient uptake | Altered C/N sensing |
| 65 | G287 | OE | Dev and morph; Size | Increased biomass |
| 105 | G485 | KO | Flowering time | Late flowering |
|  |  | OE | Flowering time | Early flowering |
| 121 | G627 | OE | Flowering time | Early flowering |
| 161 | G975 | OE | Leaf biochemistry; Leaf fatty acids | Increased wax in leaves |
|  |  |  | Abiotic stress; Drought | Increased tolerance to drought in a soil-based assay |
| 163 | G1011 | OE | Morphology; altered flowers | Floral organ abscission was delayed, with stamens, petals, and sepals persisting following pollination; increased trichome density on sepals and ectopic trichomes on carpels; rounded leaves; early flowering |
|  |  |  | Leaf; altered shape |  |
|  |  |  | Flowering time |  |
|  |  |  | Morphology; increased trichome density |  |
| 177 | G1108 | OE | Altered sugar sensing | Less sensitive to glucose |
| 193 | G1274 | OE | Abiotic stress; Cold | More tolerant to cold in a germination assay |
|  |  | OE | Abiotic stress; Chilling | More tolerant to chilling in a seedling growth assay |
|  |  | OE | Abiotic stress; Drought | Increased tolerance to drought in a soil-based assay |
|  |  | OE | Dev and morph; Inflorescence | Altered inflorescence architecture |
|  |  | OE | Abiotic stress; Nutrient uptake | Increased tolerance to low nitrogen |
|  |  | OE | Abiotic stress; Nutrient uptake | Altered C/N sensing |
|  |  | OE | Dev and morph; Leaf | Large leaves |
| 207 | G1357 | OE | Flowering time | Late flowering |
|  |  | OE | Hormone sensitivity | Insensitive to ABA |
|  |  | OE | Abiotic stress; Chilling | More tolerant to chilling stress in a growth assay |
|  |  | OE | Dev and morph; Leaf | Altered leaf shape and dark green leaves |
|  |  | OE | Abiotic stress; Drought | Increased tolerance to drought in a soil-based assay |
| 225 | G1452 | OE | Flowering time | Late flowering |
|  |  | OE | Dev and morph; Leaf | Altered leaf shape, dark green leaves |
|  |  | OE | Abiotic stress; Osmotic stress | Better germination on sucrose and salt |
|  |  |  | Abiotic stress; drought | Increased tolerance to drought in a soil-based assay |
|  |  | OE | Hormone sensitivity | Reduced sensitivity to ABA |
|  |  | OE | Dev and morph; Trichome | Reduced trichome density |
| 233 | G1482 | OE | Increased pigment | Increased anthocyanins in leaf |
| 237 | G1493 | OE | Altered sugar sensing | Seedling vigor on high glucose |
|  |  |  | Leaf; altered shape | Altered leaf shape |
|  |  |  | Flowering time | Late flowering |

TABLE 4-continued

Traits, trait categories, and effects and utilities that transcription factor genes have on plants.

| SEQ ID NO: | GID | OE/KO | Category | Experimental Observations |
|---|---|---|---|---|
| 241 | G1510 | OE | Leaf; dark green leaves<br>Altered light response | Dark green leaves<br>Long hypocolyls |
| 263 | G1660 | OE | Abiotic stress; sodium chloride tolerance | More root growth and seedling vigor in high salt |
| 267 | G1730 | OE | Abiotic stress; osmotic stress tolerance | Large and green seedlings on mannitol and glucose |
| 275 | G1779 | OE | Abiotic stress; chilling | Mature plants have enhanced tolerance to chilling stress for a long time period |
| 277 | G1792 | OE | Disease; *Erysiphe* | Increased resistance to *Erysiphe* |
|  |  | OE | Disease; *Fusarium* | Increased resistance to *Fusarium* |
|  |  | OE | Disease; *Botrytis* | Increased resistance to *Botrytis* |
|  |  | OE | Dev and morph; Leaf | Dark green, shiny leaves |
|  |  | OE | Nutrient uptake; tolerance to low N | Increased tolerance to low nitrogen |
| 281 | G1797 | OE | Abiotic stress; Drought | Increased tolerance to drought in a soil-based assay |
|  |  | OE | Flowering time | Early flowering |
|  |  | OE | Dev and morph Flower | Flower organs persisted following fertilization |
| 283 | G1798 | OE | Flowering time | Early flowering |
|  |  | OE | Dev and morph; Inflorescence | Multiple inflorescence defects |
| 287 | G1816 | OE | Trichome; glabrous leaves | Glabrous leaves |
|  |  |  | Abiotic stress; osmotic stress tolerance | Increased tolerance to high glucose |
|  |  |  | Root; increased hairs | Increased root hairs |
|  |  |  | Altered sugar sensing | Increased tolerance to high glucose |
|  |  |  | Altered C/N sensing | C/N sensing: improved tolerance to low nitrogen |
| 303 | G1863 | KO | Abiotic stress; sodium chloride | Decreased germination under salt stress |
|  |  | OE |  | Altered leaf shape and coloration |
|  |  |  | Leaf; altered shape and coloration | Late flowering |
|  |  |  | Flowering time |  |
| 317 | G1945 | OE | Leaf; altered shape | Altered leaf shape |
|  |  |  | Flowering time | Late flowering |
| 327 | G1988 | OE | Nutrient; Tolerance to low N | Better growth on low nitrogen plus glutamine, better growth on low phosphate; long hypocotyl, long petiole, early flowering |
|  |  |  | Nutrient; Tolerance to low PO$_4$ |  |
|  |  |  | Flowering time |  |
|  |  |  | Light response; Long petiole |  |
|  |  |  | Light response; Long hypocotyl |  |
| 341 and 2110 | G2041 | OE | Abiotic stress; Sodium chloride tolerance | Increased tolerance to sodium chloride |
| 1495 | G2133 | OE | Abiotic stress; drought | Increased tolerance to drought in a soil-based assay |
| 365 | G2142 | OE | Abiotic stress; tolerance to low PO$_4$ | More tolerant to phosphate deprivation in a root growth assay |
|  |  | OE | Flowering time | Accelerated flowering time |
| 371 | G2207 | OE | Hormone sensitivity; altered ABA response Abiotic stress; sodium chloride tolerance | Increased tolerance to osmotic stress under high salt or sucrose and less sensitive to ABA in germination assays; late flowering; narrow dark green leaves |
|  |  |  | Abiotic stress; osmotic tolerance |  |
|  |  |  | Flowering time |  |
|  |  |  | Leaf; altered shape |  |
|  |  |  | Leaf; dark green leaves |  |
| 393 | G2334 | OE | Dev and morph; Size | Increased biomass |
|  |  | OE | Flowering time | Late flowering |
|  |  | OE | Dev and morph; Leaf | Dark green leaves and altered leaf shape |
| 403 | G2394 | OE | Abiotic stress; sodium chloride tolerance | Enhanced germination on high sodium chloride |
| 505 | G2717 | OE | Abiotic stress; Osmotic stress | Increased tolerance to osmotic stress (salt and sucrose) |
|  |  | OE | Abiotic stress; sodium chloride tolerance | Increased tolerance to drought in a soil-based assay |
|  |  |  | Abiotic stress; drought tolerance |  |
|  |  | OE | Hormone sensitivity; altered ABA response | Insensitive to ABA in germination assays |
|  |  | OE | Size; increased plant size | Larger seedlings |
| 507 | G2718 | OE | Dev and morph; Root | Increased root hair density |
|  |  | OE | Dev and morph; Trichome | Reduced trichome density |
|  |  | OE | Abiotic stress; Nutrient uptake | Increased tolerance to low nitrogen |

TABLE 4-continued

Traits, trait categories, and effects and utilities that transcription factor genes have on plants.

| SEQ ID NO: | GID | OE/KO | Category | Experimental Observations |
|---|---|---|---|---|
|  |  | OE | Biochem: misc; Biochemistry: other | Reduced pigment production |
| 511 | G2741 | OE | Flowering time | Late flowering |
|  |  | OE | Dev and morph; Size | Increased biomass |
| 523 | G2765 | OE | Slow growth | Retarded growth at early stages |
| 557 | G2839 | OE | Abiotic stress; osmotic stress tolerance | Better germination on high sucrose; increased resistance to osmotic stress; small, contorted leaves that are upcurled at margins, short petioles; poorly developed flowers with downward-pointing short pedicels |
|  |  | OE | Leaf; altered shape |  |
|  |  | OE | Growth regulator: altered sugar sensing Inflorescence; Architectural change |  |
| 585 | G2898 | OE | Sugar sensing | Better germination on high glucose media |
| 593 | G2933 | OE | Seed; Large seed Abiotic stress; chilling tolerance | Big seeds; larger plants; more tolerant to chilling stress in growth assays |
| 607 | G2979 | OE | Flowering time | Late flowering |
|  |  | OE | Dev and morph; Size | Increased biomass |
|  |  | OE | Dev and morph Flower | Increased flower organ size and number |
| 609 | G2981 | OE | Nutrient; Tolerance to low N | Greener, larger seedlings on low nitrogen medium supplemented with glutamine |
| 611 | G2982 | OE | Abiotic stress; drought tolerance | Plants transformed with this gene displayed increased tolerance to dehydration stress in a soil-based assay |
| 615 | G2990 | OE | Nutrient; tolerance to low N | Altered response to nitrogen deprivation, including more root growth and more anthocyanin production in some lines, more bleaching in others when grown on low nitrogen, indicating this gene is involved in the response to nutrient limitation |
| 623 | G2998 | OE | Abiotic stress; sodium chloride tolerance | Better germination in high NaCl; late flowering |
| 625 | G2999 | OE | Abiotic stress; sodium chloride tolerance | Increased tolerance to high sodium chloride |
|  |  | OE | Abiotic stress: drought tolerance | Increased tolerance to drought in a soil-based assay |
|  |  | OE | Flowering time |  |
| 655 | G3076 | OE | Abiotic stress; Drought | Increased tolerance to drought |
| 657 | G3083 | OE | Abiotic stress; sodium chloride tolerance | Higher germination in high salt |
| 661 | G3086 | OE | Flowering time | Early flowering |
|  |  |  | Abiotic stress: heat tolerance | Increased tolerance to heat |
|  |  |  | Abiotic stress; sodium chloride tolerance | Increased tolerance to high sodium chloride |
|  |  |  | Abiotic stress: drought tolerance | Increased tolerance to drought in a soil-based assay |

Table 5 shows the polypeptides identified by SEQ ID NO; Gene ID (GID) No; the transcription factor family to which the polypeptide belongs, and conserved domains of the polypeptide. The first column shows the polypeptide SEQ ID NO; the third column shows the transcription factor family to which the polynucleotide belongs; and the fourth column shows the amino acid residue positions of the conserved domain in amino acid (AA) coordinates.

TABLE 5

Gene families and conserved domains

| Polypeptide SEQ ID NO: | GID No. | Family | Conserved Domains in Amino Acid Coordinates |
|---|---|---|---|
| 8 | G30 | 17-35 | AP2 |
| 12 | G47 | 11-80 | AP2 |
| 34 | G142 | 2-57 | MADS |
| 40 | G148 | 1-57 | MADS |
| 44 | G153 | 1-57 | MADS |
| 66 | G287 | 293-354 | MISC |
| 106 | G485 | 21-116 | CAAT |
| 122 | G627 | 1-57 | MADS |
| 162 | G975 | 4-71 | AP2 |
| 164 | G1011 | 2-57 | MADS |
| 178 | G1108 | 363-403 | RING/C3H2C3 |
| 194 | G1274 | 111-164 | WRKY |
| 208 | G1357 | 16-153 | NAC |
| 226 | G1452 | 30-177 | NAC |
| 234 | G1482 | 5-63 | Z-CO-like |
| 238 | G1493 | 242-289 | GARP |
| 242 | G1510 | 230-263 | GATA/Zn |
| 264 | G1660 | 362-476 | DBP |
| 268 | G1730 | 103-144 | RING/C3H2C3 |
| 276 | G1779 | 190-239 | GATA/Zn |
| 278 | G1792 | 17-85 | AP2 |
| 282 | G1797 | 1-57 | MADS |
| 284 | G1798 | 1-57 | MADS |
| 288 | G1816 | 31-81 | MYB-related |
| 304 | G1863 | 77-186 | GRF-like |

TABLE 5-continued

Gene families and conserved domains

| Polypeptide SEQ ID NO: | GID No. | Family | Conserved Domains in Amino Acid Coordinates |
|---|---|---|---|
| 318 | G1945 | 49-71 | AT-hook |
| 328 | G1988 | 5-50 | Z-CO-like |
| 342 | G2041 | 670-906, 1090-1175 | SWI/SNF |
| 1496 | G2133 | 11-83 | AP2 |
| 366 | G2142 | 43-120 | HLH/MYC |
| 372 | G2207 | 180-227, 546-627 | bZIP-NIN |
| 394 | G2334 | 82-118, 150-194 | GRF-like |
| 404 | G2394 | 355-395 | RING/C3H2C3 |
| 506 | G2717 | 5-58 | MYB-related |
| 508 | G2718 | 21-76 | MYB-related |
| 512 | G2741 | 140-205 | GARP |
| 524 | G2765 | 124-190 | HLH/MYC |
| 594 | G2933 | 65-137 | HLH/MYC |
| 586 | G2898 | 62-133 | HMG |
| 608 | G2979 | 192-211 | E2F |
| 610 | G2981 | 155-173 | E2F |
| 612 | G2982 | 107-124 | E2F |
| 616 | G2990 | 54-109, 203-263 | ZF-HB |
| 656 | G3076 | 70-100, 182-209 | bZIP-ZW2 |
| 658 | G3083 | 75-105, 188-215 | bZIP-ZW2 |

Examples of some of the utilities that may be desirable in plants, and that may be provided by transforming the plants with the presently disclosed sequences, are listed in Table 6. Many of the transcription factors listed in Table 6 may be operably linked with a specific promoter that causes the transcription factor to be expressed in response to environmental, tissue-specific or temporal signals. For example, G370 induces ectopic trichomes on flowers but also produces small plants. The former may be desirable to produce insect or herbivore resistance, or increased cotton yield, but the latter may be undesirable with respect to yield in that it may reduce biomass. However, by operably linking G370 with a flower-specific promoter, one may achieve the desirable benefits of the gene without affecting overall biomass to a significant degree. For examples of flower specific promoters, see Kaiser et al. (supra). For examples of other tissue-specific, temporal-specific or inducible promoters, see the above discussion under the heading "Vectors, Promoters, and Expression Systems".

TABLE 6

Genes, traits and utilities that affect plant characteristics

| Table 6: Trait Category | Phenotypic alteration(s) | Transcription factor genes that impact traits | Utility |
|---|---|---|---|
| Abiotic stress | Effect of chilling on plants Increased tolerance | G1274; G1357; G1779; G2933 | Improved growth rate, earlier planting, yield |
| | Germination in cold Increased tolerance | G1274 | Temperature stress response manipulation Earlier planting; improved survival, yield |
| | Drought Increased tolerance | G47; G975; G1274; G1357; G1452; G1792; G2133; G2717; G2982; G3076; | Improved survival, vigor, appearance, yield, range |
| | Freezing | G2982 | Improved survival, vigor, appearance, yield |
| | Osmotic stress Increased sensitivity | G1863 | Abiotic stress response manipulation |
| | Increased tolerance | G47; G1452; G1730; G1816; G2207 | Improved germination rate, survival, yield |
| | Salt tolerance Altered response (one line more tolerant, one line more sensitive) | G2394 | Improved germination rate, survival, yield; extended growth range |
| | Increased tolerance | G1660; G2041; G2207; G2394; G2717; G3083; | |
| | Nitrogen stress Sensitivity to N limitation | G2718; G2990; | Improved yield and nutrient stress tolerance, decreased fertilizer usage |
| | Less sensitive to N limitation | G153; G1274; G1792; G1816; G1988; G2718; G2981 | Improved yield and nutrient stress tolerance, decreased fertilizer usage |
| | Phosphate stress Less sensitive to PO$_4$ limitation | G1988; G2142 | |
| | Altered expression Induced by ABA | G1482 | Modification of seed development, seed dormancy, cold and dehydration tolerance |
| | Altered by auxin | G153; G1274; G1482 | Regulation of cell division, growth and maturation, particularly at shoot tips |

TABLE 6-continued

Genes, traits and utilities that affect plant characteristics

| Table 6: Trait Category | Phenotypic alteration(s) | Transcription factor genes that impact traits | Utility |
|---|---|---|---|
| | Induced by salicylic acid | G1274 | Resilience to heat or physiological conditions that result in high levels of salicylic acid |
| | After challenge with *Erysiphe* | G1274 | Yield, appearance, survival, extended range |
| | After challenge with *Fusarium* | G153 | Yield, appearance, survival, extended range |
| | Induced by heat | G153; G1482 | Germination, growth rate, later planting |
| | Cold | G1274; G1730 | Improved growth rate, earlier planting, yield |
| | Osmotic stress | G1274; G1482; G1730 | Abiotic stress response manipulation |
| Herbicide | Glyphosate resistance | G2133 | Generation of glyphosate resistant plants, and increasing plant resistance to oxidative stress |
| Hormone sensitivity | Abscisic acid (ABA) sensitivity | | Modification of seed development, improved seed dormancy, cold and dehydration tolerance |
| | Reduced sensitivity or insensitive to ABA | G1357; G1452; G2207; G2717 | |
| Disease | *Botrytis* | | Improved yield, appearance, survival, extended range |
| | Increased resistance or tolerance | G1792 | |
| | *Fusarium* | | Improved yield, appearance, survival, extended range |
| | Increased resistance or tolerance | G1792 | |
| | *Erysiphe* | | Improved yield, appearance, survival, extended range |
| | Increased resistance or tolerance | G1792 | |
| Growth regulator | Altered sugar sensing | | Alteration of energy balance, photosynthetic rate, carbohydrate accumulation, biomass production, source-sink relationships, senescence; alteration of storage compound accumulation in seeds |
| | Decreased tolerance to sugars | G155; G344; G478; G1420; G2111; G2763 | |
| | Increased tolerance to sugars | G224; G905; G916; G1033; G1108; G1493; G1535; G1753; G1816; G2661; G2776; G2839; G2854; G2898 | |
| | Altered C/N sensing | G153; G200; G581; G707; G916; G1013; G1150; G1274; G1483; G1535; G1816; G1988; G2239; G2604; G2830; G2913; G2981 | Alteration or control of assimilate partitioning |
| Flowering time | Early flowering | G129; G131; G135; G136; G137; G138; G140; G142; G145; G146; G148; G153; G155; G172; G200; G246; G416; G485 (OE); G549; G600; G627; G1011; G1037 (KO); G1142 (KO); G1538; G1797; G1798; G1823; G1825; G1988; G2071; G2129; G2142; G2184; G2311; G2372; G2443; G2515; G2628; G2633; G2639; G2650; G2754; G2777; G2779; G2802 (antisense clone); G2805; G2832; G2967; G2992; G3002; G3032; G3044; G3060; G3061; G3086 | Faster generation time; synchrony of flowering; additional harvests within a growing season, shortening of breeding programs |
| | Late flowering | G2; G15; G47; G173; G309; G319; G324; G372; G380; G434; G485 (KO); G571 (KO); G581; G624; G707; G738; G744; G752; G839; G852; G905; G1113; G1136; G1142; G1150; G1276; G1357; G1361; G1446; G1451; G1452; G1468; G1474; G1493; G1549; | Increased yield or biomass, alleviate risk of transgenic pollen escape, synchrony of flowering |

TABLE 6-continued

Genes, traits and utilities that affect plant characteristics

| Table 6: Trait Category | Phenotypic alteration(s) | Transcription factor genes that impact traits | Utility |
|---|---|---|---|
| | | G1554; G1863; G1945; G1983; G1998; G1999; G2106; G2146; G2207; G2251; G2269; G2319; G2334; G2432; G2559; G2604; G2694; G2723; G2741; G2743; G2763; G2771; G2802 (sense clone); G2838; G2846; G2964; G2979; G2993; G2998; G3003; G3021; G3060; G3111 | |
| Development and morphology | Altered flower structure Stamen | G15; G129; G133; G1420; G2455; G2694; G2768 | Ornamental modification of plant architecture, improved or reduced fertility to mitigate escape of transgenic pollen, improved fruit size, shape, number or yield |
| | Sepal | G129; G134; G140; G1420; G2694; G2979; G3094 | |
| | Petal | G129; G133; G134; G140; G1420; G2768; G3094 | |
| | Pedicel | G1420; G1539; G1591; G2839; G2979; G2983 | |
| | Carpel | G129; G133; G446; G1539; G1591; G1796; G2455; G2579; G2617; G2694; G2768; G2983 | |
| | Multiple alterations | G15; G550; G651; G730; G1013; G1100; G1420; G1549; G1798; G1825; G1995; G2226; G2457; G2455; G2515; G2575; G2616; G2639; G2640; G2649; G2694; G2743; G2826; G2838; G2859; G2884; G3094 | |
| | Changes in organ identity | G129; G133; G134; G140 | |
| | Enlarged floral organs | G15; G2979 | |
| | Increase in flower organ number | G2768; G2979 | |
| | Terminal flowers | G1798; G2515 | |
| | Flower organs persisting following fertilization | G1011; G1797 | |
| | Siliques | G15; G2579; G2884 | |
| | Broad, large rosettes | G1274 | |
| | Loss of flower determinacy | G131; G135; G2768 | |
| | Reduced fertility | G15; G549; G651; G846; G1100; G1798; G2372; G2579; G2616; G2639; G2640; G2649; G2768; G2884 | |
| | Gamete lethal | G846 | |
| | Altered shoot meristem development | G438 (KO); G916; G1585; G1957; G2636; G2650; | Ornamental modification of plant architecture, manipulation of growth and development, increase leaf numbers, modulation of branching patterns to provide improved yield or biomass |
| | Inflorescence architectural change | | Ornamental modification of flower architecture; timing of flowering; altered plant habit for yield or harvestability benefit; reduction in pollen production of genetically modified plants; manipulation of seasonality and annual or perennial habit; manipulation of determinate vs. indeterminate growth |
| | Altered inflorescence branching pattern | G47; G446; G2571; G2146; G2571; G2694; G2784; G2859 | |
| | Short internodes/bushy inflorescences | G47; G253; G1274; G1474; G1593; G1743; G1753; G1796; G2146; G2226; G2550; G2251; G2575; G2616; G2639; G2640; G2649; G2958; G3021 | |
| | Terminal flowers | G131; G135; G137; G145; G148; G155; | |

TABLE 6-continued

Genes, traits and utilities that affect plant characteristics

| Table 6: Trait Category | Phenotypic alteration(s) | Transcription factor genes that impact traits | Utility |
|---|---|---|---|
| | | G549; G1798; G2372; G2515 | |
| | Altered inflorescence determinacy | G131; G135; G549; G2372; G2515 | |
| | Aerial rosette development | G1985; G1995; G2826; G2838 | |
| | Downward pedicels | G2839 | |
| | Homeotic transformation | G129, G133, G134; G140 | |
| | Multiple inflorescence alterations | G446; G549; G1798; G2616; G2694; G2784; G2839; G3059 | |
| | Altered branching pattern | G47; G438 (KO) | Ornamental modification of plant architecture, improved lodging resistance |
| | Stem morphology and altered vascular tissue structure | G47 | Modulation of lignin content; improvement of wood, palatability of fruits and vegetables |
| | Apical dominance | | Ornamental modification of |
| | Reduced apical dominance | G47 | plant architecture;, improved lodging resistance |
| | Altered trichome density; development, or structure | | Ornamental modification of plant architecture, increased |
| | Ectopic trichomes | G370; G2826 | plant product (e.g., diterpenes, |
| | Altered trichome development | G1539; G2983 | cotton) productivity, insect |
| | Increased trichome number or density | G370; G1995; G2085; G2826; G2838 | and herbivore resistance |
| | Reduced or no trichomes | G1452; G1816; G2718 | |
| | Root development | | |
| | Decreased root growth or secondary root development | G651; G730; G2655; G2747; G2992; G2993 | Modification of root architecture and mass |
| | Decreased root branching | G651; G2993 | Influence uptake of water and nutrients |
| | Increased root branching | G2747; G2992 | Improved anchorage |
| | Abnormal gravitropic response | G2983 | Manipulation of root development |
| | Increased root hairs | G1816; G2718; G2983 | Improved yield, stress tolerance; anchorage |
| | Altered cotyledon shape | G916; G1420; G1893; G2432; G2636; G2859; G3059 | Ornamental applications |
| | Altered hypocotyl shape, color, development | G807; G916; G1510; G1988; G2771; G2859; G2884; G2993 | Ornamental applications; altered light response (see "Light Response", below) |
| | Altered seed development, ripening and germination | G961 | Modification of seed germination properties and performance |
| | Slow growth | G652; G1013; G1100; G1468; G1535; G1549; G1779; G1938; G2765; G2784; G2826; G2834; G2851; G3091; G3095 | Ornamental applications |
| | Fast growth | G807; G1476; G2617 | Appearance, biomass, yield |
| | Cell differentiation and cell proliferation | G1539; G1585; G1591; G2983 | Increase in carpel or fruit development; improve regeneration of shoots from callus in transformation or micro-propagation systems |
| | Cell expansion | G521 | Control of cell elongation |
| | Phase change and floral reversion | G370; G1985; G1995; G2826; G2838 | Improved yield, biomass, manipulation of seasonality and annual or perennial habit, developmental plasticity in response to environmental stress |
| | Senescence | | |
| | Accelerated or premature senescence | G652; G1033; G1772; G2467; G2574; G2783; G2907; G3059; G3111 | Improvement in response to disease, fruit ripening |
| | Reduced or delayed senescence | G571; G652 (KO); G2536 | |
| | Abnormal embryo development | G2884 | |
| | Embryo lethal when knocked out | G374 | Herbicide target |

TABLE 6-continued

Genes, traits and utilities that affect plant characteristics

| Table 6: Trait Category | Phenotypic alteration(s) | Transcription factor genes that impact traits | Utility |
|---|---|---|---|
| | Gamete lethal | G846 | Potential to prevent escape of GMO pollen |
| | Altered programmed cell death | G12 | |
| | Lethality when overexpressed | G366; G1384; G1556; G1832; G1850; G1957; G1990; G2213; G2298; G2505; G2570; G2587; G2869; G2887 | Herbicide target; ablation of specific tissues or organs such as stamen to prevent pollen escape |
| | Necrosis, formation of necrotic lesions | G12; G1840 | Disease resistance |
| Plant size | Increased plant size or biomass | G46; G268; G287; G314; G319; G324; G438; G624; G852; G1113; G1150; G1451; G1468; G2334; G2536; G2650; G2741; G2979 | Improved yield, biomass, appearance |
| | Large seedlings | G1313; G2679; G2694; G2838 | Increased survival and vigor of seedlings, yield |
| | Dwarfed or more compact plants | G131; G136; G253; G309; G370; G386; G549; G550; G600; G651; G652; G707; G738; G811; G1011; G1100; G1247; G1289; G1340; G1423; G1474; G1483; G1549; G1554; G1593; G1753; G1772; G1779; G1798; G1938; G1983; G1993; G2085; G2226; G2227; G2251; G2372; G2375; G2453; G2456; G2459; G2492; G2515; G2550; G2565; G2574; G2575; G2579; G2616; G2628; G2640; G2649; G2682; G2702; G2757; G2783; G2839; G2846; G2847; G2850; G2884; G2934; G2958; G2979; G2992; G3017; G3059; G3091; G3111 | Dwarfism, lodging resistance, manipulation of gibberellin responses |
| Leaf morphology | Dark green leaves | G30; G253; G309; G707; G811; G957; G1100; G1327; G1341; G1357; G1389; G1420; g1423; G1452; G1482; G1510; G1535; G1549; G1554; G1593; G1743; G1792; G1796; G1846; G1863; G1932; G1938; G1983; G2085; G2146; G2207; G2226; G2251; G2334; G2371; G2372; G2453; G2456; G2457; G2459; G2550; G2640; G2649; G2661; G2690; G2694; G2771; G2763; G2784; G2837; G2838; G2846; G2847; G2850; G2851; G2958; G2993; G3021; G3059; G3091; G3095; G3111 | Increased photosynthesis, biomass, appearance, yield; nutritional value |
| | Change in leaf shape | G30; G129; G131; G135; G136; G137; G140; G148; G200; G224; G253; G319; G370; G372; G438; G446; G468; G600; G646; G651; G707; G905; G957; G1011; G1013; G1100; G1113; G1142; G1247; G1341; G1357; G1361; G1389; G1420; G1452; G1468; G1474; G1476; G1493; | Ornamental applications |

TABLE 6-continued

Genes, traits and utilities that affect plant characteristics

| Table 6: Trait Category | Phenotypic alteration(s) | Transcription factor genes that impact traits | Utility |
|---|---|---|---|
| | | G1535; G1538; G1549; G1557; G1585; G1593; G1743; G1796; G1798; G1825; G1846; G1863; G1893; G1917; G1932; G1938; G1945; G1983; G1993; G2084; G2085; G2207; G2226; G2227; G2251; G2334; G2375; G2432; G2453; G2455; G2456; G2457; G2536; G2550; G2565; G2575; G2579; G2604; G2617; G2628; G2636; G2639; G2640; G2649; G2682; G2686; G2690; G2694; G2699; G2702; G2747; G2768; G2771; G2784; G2837; G2839; G2846; G2850; G2851; G2859; G2866; G2888; G2958; G2992; G3021; G3044; G3059; G3084; G3091; G3094; G3095; G3111 | |
| | Increased leaf size and mass | G268; G324; G438; G852; G1113; G1274; G1451; G2536; G2699; G2768; G3008 | Increased yield, ornamental applications |
| | Light green or gray leaves | G351; G600; G651; G1468; G1718; G2565; G2604; G2779; G2859; G3044; G3070 | Ornamental applications |
| | Glossy leaves | G30; G370 (KO); G975; G1792; G2640; G2649 | Ornamental applications, manipulation of wax composition, amount, or distribution |
| | Altered abaxial/adaxial polarity | G730 | Modification of plant growth and form |
| Seed morphology | Altered seed coloration | G581; G961; G2085; G2371 | Appearance |
| | Seed size and shape | | |
| | Large seed | G151; G581; G2085; G2585; G2933 | |
| Leaf biochemistry | Increased leaf wax | G975 | Insect, pathogen resistance |
| | Leaf fatty acids | | |
| | Increase in leaf fatty acids | G975 | |
| Light response/shade avoidance | Altered cotyledon | G30 | Increased planting densities and yield enhancement |
| | Altered hypocotyl | G30; G1510; G1988 | |
| | Altered petiole | G478; G807; G1988; G2650; G2694; G2754 | |
| | Shade avoidance | G30 | |
| Pigment | Increased anthocyanin levels | G1482 | Enhanced health benefits, improved ornamental appearance, increased stress resistance, attraction of pollinating and seed-dispersing animals |
| | Decreased anthocyanin levels | G2718 | |

Abbreviations:
N = nitrogen
P = phosphate
ABA = abscisic acid
C/N = carbon/nitrogen balance Detailed Description of Genes, Traits and Utilities that Affect Plant Characteristics The following descriptions of traits and utilities associated with the present transcription factors offer a more comprehensive description than that provided in Table 6.

Abiotic Stress, General Considerations

Plant transcription factors can modulate gene expression, and, in turn, be modulated by the environmental experience of a plant. Significant alterations in a plant's environment invariably result in a change in the plant's transcription factor gene expression pattern. Altered transcription factor expression patterns generally result in phenotypic changes in the plant. Transcription factor gene product(s) in transgenic plants then differ(s) in amounts or proportions from that found in wild-type or non-transformed plants, and those transcription factors likely represent polypeptides that are used to alter the response to the environmental change. By way of example, it is well accepted in the art that analytical methods based on altered expression patterns may be used to screen for phenotypic changes in a plant far more effectively than can be achieved using traditional methods.

Abiotic stress: adult stage chilling. Enhanced chilling tolerance produced by modifying expression levels of transcription factors such as G1274, G1357, G1779, G1928, G2063, G2567, G2579, G2650, G2771, G2930, or G2933, for example, in plants may extend the effective growth range of chilling sensitive crop species by allowing earlier planting or later harvest during a growing season. Improved chilling tolerance may be conferred by increased expression of glycerol-3-phosphate acetyltransferase in chloroplasts (see, for example, Wolter et al. (1992) *EMBO J.* 4685-4692, and Murata et al. (1992) *Nature* 356: 710-713).

Chilling tolerance could also serve as a model for understanding how plants adapt to water deficit. Both chilling and water stress share similar signal transduction pathways and tolerance/adaptation mechanisms. For example, acclimation to chilling temperatures can be induced by water stress or treatment with abscisic acid. Genes induced by low temperature include dehydrins (or LEA proteins). Dehydrins are also induced by salinity, abscisic acid, water stress and during the late stages of embryogenesis.

Another large impact of chilling occurs during post-harvest storage. For example, some fruits and vegetables do not store well at low temperatures (for example, bananas, avocados, melons, and tomatoes). The normal ripening process of the tomato is impaired if it is exposed to cool temperatures. Genes conferring resistance to chilling temperatures may enhance tolerance during post-harvest storage.

Abiotic stress: cold germination. The potential utility of presently disclosed transcription factor genes that increase tolerance to cold is to confer better germination and growth in cold conditions. Plants with modified expression levels of G224, G728, G807, G1274, G1837, G2051, G2317, G2603, or G2784 show less sensitivity to germination in cold conditions, indicating a role in regulation of cold responses. These genes might be engineered to manipulate the response to low temperature stress. Genes that would allow germination and seedling vigor in the cold would have highly significant utility in allowing seeds to be planted earlier in the season with a high rate of survival. Transcription factor genes that confer better survival in cooler climates allow a grower to move up planting time in the spring and extend the growing season further into autumn for higher crop yields. Germination of seeds and survival at temperatures significantly below that of the mean temperature required for germination of seeds and survival of non-transformed plants would increase the potential range of a crop plant into regions in which it would otherwise fail to thrive.

Abiotic Stress: Salt and Drought Tolerance

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. In a recent review, Zhu notes that (Zhu (2002) *Ann. Rev. Plant Biol.* 53: 247-273) "most studies on water stress signaling have focused on salt stress primarily because plant responses to salt and drought are closely related and the mechanisms overlap". Many examples of similar responses (i.e., genetic pathways to this set of stresses have been documented. For example, the CBF transcription factors have been shown to condition resistance to salt, freezing and drought (Kasuga et al. (1999) *Nature Biotech.* 17: 287-291). The *Arabidopsis* rd29B gene is induced in response to both salt and dehydration stress, a process that is mediated largely through an ABA signal transduction process (Uno et al. (2000) *Proc. Natl. Acad. Sci. USA* 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) *Plant J.* 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) *Plant J.* 23: 319-327).

Exposure to dehydration invokes similar survival strategies in plants as does freezing stress (see, for example, Yelenosky (1989) *Plant Physiol* 89: 444-451) and drought stress induces freezing tolerance (see, for example, Siminovitch et al. (1982) *Plant Physiol* 69: 250-255; and Guy et al. (1992) *Planta* 188: 265-270). In addition to the induction of cold-acclimation proteins, strategies that allow plants to survive in low water conditions may include, for example, reduced surface area, or surface oil or wax production.

Consequently, one skilled in the art would expect that some pathways involved in resistance to one of these stresses, and hence regulated by an individual transcription factor, will also be involved in resistance to another of these stresses, regulated by the same or homologous transcription factors. Of course, the overall resistance pathways are related, not identical, and therefore not all transcription factors controlling resistance to one stress will control resistance to the other stresses. Nonetheless, if a transcription factor conditions resistance to one of these stresses, it would be apparent to one skilled in the art to test for resistance to these related stresses. Modifying the expression of a number of presently disclosed transcription factor genes shown to confer increased tolerance to drought, e.g., G46, G47, G926, G975, G1206, G1274, G1357, G1452, G1792, G2133, G2505, G2717, G2982, G2999, G3076, and G3086, and increased tolerance to salt, e.g., G355, G624, G1017, G1037, G1538, G1557, G1660, G1837, G2035, G2041, G2060, G2207, G2317, G2319, G2404, G2453, G2457, G2691, G2717, G2992, G2998, G2999, G3083, and G3086, during germination, the seedling stage, and throughout a plant's life cycle, may thus be used to increase a plant's tolerance to low water conditions and provide the benefits of improved survival, increased yield and an extended geographic and temporal planting range.

Abiotic stress: freezing tolerance and osmotic stress. Modification of the expression of a number of presently disclosed transcription factor genes, G47, G916, G926, G1033, G1206, G1412, G1452, G1730, G1753, G1816, G2207, G2661, G2717, G2776, G2839, G2854, G2969, or G2982, for example, may be used to increase germination rate or growth under adverse osmotic conditions, which could impact survival and yield of seeds and plants. Osmotic stresses may be regulated by specific molecular control mechanisms that include genes controlling water and ion movements, functional and structural stress-induced proteins, signal perception and transduction, and free radical scavenging, and many others (Wang et al. (2001) *Acta Hort.* (ISHS) 560: 285-292). Instigators of osmotic stress include freezing, drought and high salinity, each of which are discussed in more detail below.

In many ways, freezing, high salt and drought have similar effects on plants, not the least of which is the induction of common polypeptides that respond to these different stresses. For example, freezing is similar to water deficit in that freezing reduces the amount of water available to a plant. Exposure to freezing temperatures may lead to cellular dehydration as water leaves cells and forms ice crystals in intercellular spaces (Buchanan, supra). As with high salt concentration and freezing, the problems for plants caused by low water availability include mechanical stresses caused by the withdrawal of cellular water. Thus, the incorporation of transcription factors that modify a plant's response to osmotic stress into, for example, a crop or ornamental plant, may be useful in reducing damage or loss. Specific effects caused by freezing, high salt and drought are addressed below.

Abiotic stress: heat stress tolerance. The germination of many crops is also sensitive to high temperatures. Presently disclosed transcription factor genes, including, for example, G3086, that provide increased heat tolerance, are generally useful in producing plants that germinate and grow in hot conditions, may find particular use for crops that are planted late in the season, or extend the range of a plant by allowing growth in relatively hot climates.

Nutrient uptake and utilization: nitrogen and phosphorus. Presently disclosed transcription factor genes introduced into plants provide a means to improve uptake of essential nutrients, including nitrogenous compounds, phosphates, potassium, and trace minerals. The enhanced performance of, for example, G153, G200, G581, G839, G916, G1013, G1150, G1274, G1792, G1816, G1988, G2239, G2604, G2718, G2830, G2913, and G2981, and other overexpressing lines under low nitrogen conditions or G355, G624, G1988, G2142, and G2972 under low phosphorus conditions indicate that these genes and their homologs could be used to engineer crops that could thrive under conditions of reduced nutrient availability. Phosphorus, in particular, tends to be a limiting nutrient in soils and is generally added as a component in fertilizers. Young plants have a rapid intake of phosphate and sufficient phosphate is important for yield of root crops such as carrot, potato and parsnip.

The effect of these modifications is to increase the seedling germination and range of ornamental and crop plants. The utilities of presently disclosed transcription factor genes conferring tolerance to conditions of low nutrients also include cost savings to the grower by reducing the amounts of fertilizer needed, environmental benefits of reduced fertilizer runoff into watersheds; and improved yield and stress tolerance. In addition, by providing improved nitrogen uptake capability, these genes can be used to alter seed protein amounts and/or composition in such a way that could impact yield as well as the nutritional value and production of various food products.

Decreased herbicide sensitivity. Presently disclosed transcription factor genes, including G2133 and its equivalogs that confer resistance or tolerance to herbicides (e.g., glyphosate) will find use in providing means to increase herbicide applications without detriment to desirable plants. This would allow for the increased use of a particular herbicide in a local environment, with the effect of increased detriment to undesirable species and less harm to transgenic, desirable cultivars.

Knockouts of a number of the presently disclosed transcription factor genes have been shown to be lethal to developing embryos. Thus, these genes are potentially useful as herbicide targets.

Altered expression and hormone sensitivity: abscisic acid and auxin. Altering the expression levels of a number of the presently disclosed transcription factor genes, including G12, G224, G244, G355, G571, G926, G1037, G1357, G1412, G1452, G1482, G1507, G1893, G2070, G2085, G2109, G2146, G2207, G2382, G2617, G2717, G2854, G2865, G2969, G2992, G3054, G3055, or G3067, may be used to reduce a plant's sensitivity to ABA or render a plant insensitive to ABA exposure. ABA plays regulatory roles in a host of physiological processes in all higher as well as in lower plants (Davies et al. (1991) *Abscisic Acid: Physiology and Biochemistry*. Bios Scientific Publishers, Oxford, UK; Zeevaart et al. (1988) *Ann. Rev. Plant Physiol*. Plant Mol. Biol. 49: 439-473; Shimizu-Sato et al. (2001) *Plant Physiol* 127: 1405-1413). ABA mediates stress tolerance responses in higher plants, is a key signal compound that regulates stomatal aperture and, in concert with other plant signaling compounds, is implicated in mediating responses to pathogens and wounding or oxidative damage (for example, see Larkindale et al. (2002) *Plant Physiol*. 128: 682-695). In seeds, ABA promotes seed development, embryo maturation, synthesis of storage products (proteins and lipids), desiccation tolerance, and is involved in maintenance of dormancy (inhibition of germination), and apoptosis (Zeevaart et al. (1988) *Ann. Rev. Plant Physiol. Plant Mol. Biol*. 49: 439-473; Davies (1991), supra; Thomas (1993) *Plant Cell* 5: 1401-1410; and Bethke et al. (1999) *Plant Cell* 11: 1033-1046). ABA also affects plant architecture, including root growth and morphology and root-to-shoot ratios. ABA action and metabolism is modulated not only by environmental signals but also by endogenous signals generated by metabolic feedback, transport, hormonal cross-talk and developmental stage. Manipulation of ABA levels, and hence by extension the sensitivity to ABA, has been described as a very promising means to improve productivity, performance and architecture in plants Zeevaart (1999) in: *Biochemistry and Molecular Biology of Plant Hormones*, Hooykaas et al. eds, Elsevier Science pp 189-207; and Cutler et al. (1999) *Trends Plant Sci*. 4: 472-478).

A number of genes have been shown to be induced by cold acclimation in higher plants, including, for example, G171, G224, G1274, G1730, G2085, and G2597, and the proteins encoded by these genes are thought to play a role in protecting plant cells from injury, including freezing (Nagao et al. (2002) *Plant Cell Physiol*. 43: S168-S168). Since ABA mediates conversion of apical meristems into dormant buds, altered expression to ABA may increase protection of the buds from mechanical damage during winter. A plant's response to ABA also affects sprouting inhibition during premature warm spells. ABA is also important in protecting plants from drought tolerance. Thus, by affecting ABA sensitivity, introduced transcription factor genes may affect cold sensitivity, yield and survival, and plants with G12 knocked-out or plants overexpressing G926, G1357, G1412, G1452, G1893, G2109, G2146, G2207, G2382, G2617, G2717, G2854, G2865, G2969, G2992, G3054, G3055, and G3067, may have modified ABA responses that influence seed development and dormancy, as well as cold and dehydration tolerance, and survival.

"Auxin" refers to a class of plant hormones, including indoleacetic acid (IAA), having a variety of effects, such as phototropic response through the stimulation of cell elongation, stimulation of secondary growth, and the development of leaf traces and fruit. Specifically, auxin is involved in the regulation of cell division, particularly at shoot tips. Transcription factors genes that regulate a plant's response to auxin thus provide a means for controlling shoot tip development and secondary growth, which in turn can be used to manipulate plant growth and development.

Disease resistance or tolerance: *Erysiphe, Fusarium, Botrytis*, and other pathogens. A number of the presently disclosed transcription factor genes have been induced to be expressed (e.g., G140, G171, G224, G434, G571, G1100, G1274, G1384, G1507, G1538, G1923, and G2085), or have been shown to provide resistance or tolerance (e.g., G1792) after challenge with more than one pathogen, including fungal pathogens *Fusarium oxysporum, Botrytis cinerea* and *Erysiphe orontii*. Modification of the expression levels of one or more transcription factor genes may provide some benefit to the plant to help prevent or overcome infestation. The mechanisms by which the transcription factors work could include changing surface characteristics such as waxes, oils, or cell wall composition and thickness, or by the activation of signal transduction pathways that regulate plant defenses in response to attacks by pathogens (including, for example, reactive oxygen species, anti-fungal proteins, defensins, thionins, glucanases, and chitinases). Another means to combat fungal and other pathogens is by accelerating local cell death or senescence, mechanisms used to impair the spread of pathogenic microorganisms throughout a plant. For instance, the best known example of accelerated cell death is the resistance gene-mediated hypersensitive response, which causes localized cell death at an infection site and initiates a systemic defense response. Because many defenses, signaling molecules, and signal transduction pathways are common to defense against different pathogens and pests, such as fungal, bacterial, oomycete, nematode, and insect, transcription factors that are implicated in defense responses against the fungal pathogens tested may also function in defense against other pathogens and pests.

Growth Regulator: Sugar Sensing.

In addition to their important role as an energy source and structural component of the plant cell, sugars are central regulatory molecules that control several aspects of plant physiology, metabolism and development (Hsieh et al. (1998) *Proc. Natl. Acad. Sci.* 95: 13965-13970). It is thought that this control is achieved by regulating gene expression and, in higher plants, sugars have been shown to repress or activate plant genes involved in many essential processes such as photosynthesis, glyoxylate metabolism, respiration, starch and sucrose synthesis and degradation, pathogen response, wounding response, cell cycle regulation, pigmentation, flowering and senescence. The mechanisms by which sugars control gene expression are not understood.

Several sugar-sensing mutants have turned out to be allelic to abscisic acid (ABA) and ethylene mutants. ABA is found in all photosynthetic organisms and acts as a key regulator of transpiration, stress responses, embryogenesis, and seed germination. Most ABA effects are related to the compound acting as a signal of decreased water availability, whereby it triggers a reduction in water loss, slows growth, and mediates adaptive responses. However, ABA also influences plant growth and development via interactions with other phytohormones. Physiological and molecular studies indicate that maize and *Arabidopsis* have almost identical pathways with regard to ABA biosynthesis and signal transduction. For further review, see Finkelstein and Rock ((2002) Abscisic acid biosynthesis and response (In *The Arabidopsis Book*, Editors: Somerville and Meyerowitz (American Society of Plant Biologists, Rockville, Md.).

This potentially implicates G155, G224, G344, G478, G905, G916, G1033, G1108, G1420, G1493, G1535, G1753, G1816, G2111, G2661, G2763, G2776, G2839, G2854, G2898 and related transcription factors in hormone signaling based on the sucrose sugar sensing phenotype of transgenic lines overexpressing these polypeptides. On the other hand, the sucrose treatment used in these experiments (9.5% w/v) could also be an osmotic stress. Therefore, one could interpret these data as an indication that these transgenic lines overexpressing are more tolerant to osmotic stress. However, it is well known that plant responses to ABA, osmotic and other stress may be linked, and these different treatments may even act in a synergistic manner to increase the degree of a response. For example, Xiong, Ishitani, and Zhu ((1999) *Plant Physiol.* 119: 205-212) have shown that genetic and molecular studies may be used to show extensive interaction between osmotic stress, temperature stress, and ABA responses in plants. These investigators analyzed the expression of RD29A-LUC in response to various treatment regimes in *Arabidopsis*. The RD29A promoter contains both the ABA-responsive and the dehydration-responsive element—also termed the C-repeat—and can be activated by osmotic stress, low temperature, or ABA treatment; transcription of the RD29A gene in response to osmotic and cold stresses is mediated by both ABA-dependent and ABA-independent pathways (Xiong, Ishitani, and Zhu (1999) supra). LUC refers to the firefly luciferase coding sequence, which, in this case, was driven by the stress responsive RD29A promoter. The results revealed both positive and negative interactions, depending on the nature and duration of the treatments. Low temperature stress was found to impair osmotic signaling but moderate heat stress strongly enhanced osmotic stress induction, thus acting synergistically with osmotic signaling pathways. In this study, the authors reported that osmotic stress and ABA could act synergistically by showing that the treatments simultaneously induced transgene and endogenous gene expression. Similar results were reported by Bostock and Quatrano ((1992) *Plant Physiol.* 98: 1356-1363), who found that osmotic stress and ABA act synergistically and induce maize Em gene expression. Ishitani et al (1997) *Plant Cell* 9: 1935-1949) isolated a group of *Arabidopsis* single-gene mutations that confer enhanced responses to both osmotic stress and ABA. The nature of the recovery of these mutants from osmotic stress and ABA treatment indicated that although separate signaling pathways exist for osmotic stress and ABA, the pathways share a number of components; these common components may mediate synergistic interactions between osmotic stress and ABA. Thus, contrary to the previously held belief that ABA-dependent and ABA-independent stress signaling pathways act in a parallel manner, our data reveal that these pathways cross talk and converge to activate stress gene expression.

Because sugars are important signaling molecules, the ability to control either the concentration of a signaling sugar or how the plant perceives or responds to a signaling sugar could be used to control plant development, physiology or metabolism. For example, the flux of sucrose (a disaccharide sugar used for systemically transporting carbon and energy in most plants) has been shown to affect gene expression and alter storage compound accumulation in seeds. Manipulation of the sucrose-signaling pathway in seeds may therefore cause seeds to have more protein, oil or carbohydrate, depending on the type of manipulation. Similarly, in tubers, sucrose is converted to starch which is used as an energy store. It is thought that sugar signaling pathways may partially determine the levels of starch synthesized in the tubers. The manipulation of sugar signaling in tubers could lead to tubers with a higher starch content.

Thus, the presently disclosed transcription factor genes that manipulate the sugar signal transduction pathway may lead to altered gene expression to produce plants with desirable traits. In particular, manipulation of sugar signal transduction pathways could be used to alter source-sink relationships in seeds, tubers, roots and other storage organs leading to increase in yield.

Growth regulator: carbon and nitrogen balance. A number of the transcription factor-overexpressing lines, including G153, G200, G581, G707, G916, G1013, G1150, G1274, G1483, G1535, G1816, G1988, G2239, G2604, G2830, G2913, and G2981, may be used to produce plants with altered C/N sensing. These plants may, for example, make less anthocyanin on high sucrose plus glutamine, indicating that these genes can be used to modify carbon and nitrogen status, and hence assimilate partitioning (assimilate partitioning refers to the manner in which an essential element, such as nitrogen, is distributed among different pools inside a plant, generally in a reduced form, for the purpose of transport to various tissues).

Flowering time: early and late flowering. Presently disclosed transcription factor genes that accelerate flowering, which include G129, G131, G135, G136, G137, G138, G140, G142, G145, G146, G148, G153, G155, G172, G200, G246, G416, G485, G549, G600, G627, G1011, G1037, G1142, G1538, G1797, G1798, G1823, G1825, G1988, G2071, G2129, G2142, G2184, G2311, G2372, G2443, G2515, G2628, G2633, G2639, G2650, G2754, G2777, G2779, G2802, G2805, G2832, G2967, G2992, G3002, G3032, G3044, G3060, G3061, and G3086, could have valuable applications in such programs, since they allow much faster generation times. In a number of species, for example, broccoli, cauliflower, where the reproductive parts of the plants constitute the crop and the vegetative tissues are discarded, it would be advantageous to accelerate time to flowering. Accelerating flowering could shorten crop and tree breeding programs. Additionally, in some instances, a faster generation time would allow additional harvests of a crop to be made within a given growing season. A number of *Arabidopsis* genes have already been shown to accelerate flowering when constitutively expressed. These include LEAFY, APETALA1 and CONSTANS (Mandel et al. (1995) *Nature* 377: 522-524; Weigel and Nilsson (1995) *Nature* 377: 495-500; Simon et al. (1996) *Nature* 384: 59-62).

By regulating the expression of potential flowering using inducible promoters, flowering could be triggered by application of an inducer chemical. This would allow flowering to be synchronized across a crop and facilitate more efficient harvesting. Such inducible systems could also be used to tune the flowering of crop varieties to different latitudes. At present, species such as soybean and cotton are available as a series of maturity groups that are suitable for different latitudes on the basis of their flowering time (which is governed by day-length). A system in which flowering could be chemically controlled would allow a single high-yielding northern maturity group to be grown at any latitude. In southern regions such plants could be grown for longer periods before flowering was induced, thereby increasing yields. In more northern areas, the induction would be used to ensure that the crop flowers prior to the first winter frosts.

In a sizeable number of species, for example, root crops, where the vegetative parts of the plants constitute the crop and the reproductive tissues are discarded, it is advantageous to identify and incorporate transcription factor genes that delay or prevent flowering in order to prevent resources being diverted into reproductive development. For example, G2, G15, G47, G173, G309, G319, G324, G372, G380, G434, G485, G571, G581, G624, G707, G738, G744, G752, G839, G852, G905, G1113, G1136, G1142, G1150, G1276, G1357, G1361, G1446, G1451, G1452, G1468, G1474, G1493, G1549, G1554, G1863, G1945, G1983, G1998, G1999, G2106, G2146, G2207, G2251, G2269, G2319, G2334, G2432, G2559, G2604, G2694, G2723, G2741, G2743, G2763, G2771, G2802, G2838, G2846, G2964, G2979, G2993, G2998, G3003, G3021, G3060, and G3111 have been shown to delay flowering time in plants. Extending vegetative development with presently disclosed transcription factor genes could thus bring about large increases in yields. Prevention of flowering can help maximize vegetative yields and prevent escape of genetically modified organism (GMO) pollen.

Presently disclosed transcription factors that extend flowering time have utility in engineering plants with longer-lasting flowers for the horticulture industry, and for extending the time in which the plant is fertile.

Altered flower structure and inflorescence: aerial rosettes, architecture, branching, short internodes, terminal flowers and phase change. Presently disclosed transgenic transcription factors such as G15, G129, G131, G133, G134, G135, G140, G446, G549, G550, G651, G730, G846, G1011, G1013, G1100, G1274, G1420, G1539, G1549, G1591, G1796, G1797, G1798, G1825, G1995, G2226, G2372, G2455, G2457, G2515, G2575, G2579, G2616, G2617, G2639, G2640, G2649, G2694, G2743, G2768, G2826, G2838, G2839, G2859, G2884, G2979, G2983, and G3094 have been used to create plants with larger flowers or arrangements of flowers that are distinct from wild-type or non-transformed cultivars. This would likely have the most value for the ornamental horticulture industry, where larger flowers or interesting floral configurations are generally preferred and command the highest prices.

Flower structure may have advantageous or deleterious effects on fertility, and could be used, for example, to decrease fertility by the absence, reduction or screening of reproductive components. In fact, plants that overexpress a sizable number of the presently disclosed transcription factor genes, including G15, G549, G651, G846, G1100, G1798, G2372, G2579, G2616, G2639, G2640, G2649, G2768, and G2884, have been shown to possess reduced fertility compared with control plants. These could be desirable traits, as low fertility could be exploited to prevent or minimize the escape of the pollen of genetically modified organisms (GMOs) into the environment.

The alterations in shoot architecture seen in the lines in which the expression G47, G446, G2571, G2146, G2571, G2694, G2784, or G2859, for example, was modified indicates that these genes can be used to manipulate inflorescence branching patterns. This could influence yield and offer the potential for more effective harvesting techniques. For example, a "self pruning" mutation of tomato results in a determinate growth pattern and facilitates mechanical harvesting (Pnueli et al. (2001) *Plant Cell* 13(12): 2687-702).

Although the fertility of plants overexpressing some of the lines in which the present transcription factors (e.g., G2579) expression levels were poor, siliques of these plants appeared to grow out fairly extensively in many instances, indication that these genes may be producing parthenocarpic effects (fruit development in the absence of seed set), and may have utility in producing seedless fruit.

One interesting application for manipulation of flower structure, for example, by introduced transcription factors could be in the increased production of edible flowers or flower parts, including saffron, which is derived from the stigmas of *Crocus sativus*.

A number of the presently disclosed transcription factors may affect the timing of phase changes in plants (e.g., G370, G1985, G1995, G2826, and G2838). Since the timing or phase changes generally affects a plant's eventual size, these genes may prove beneficial by providing means for improving yield and biomass.

General development and morphology: shoot meristem and branching patterns. Presently disclosed transcription factor genes, when introduced into plants, may be used to modify branching patterns (e.g., by knocking-out G438, and overexpression of G916, G1585, G1957, G2636, and G2650), for example, by causing stem bifurcations in developing shoots in which the shoot meristems split to form two or three separate shoots. These transcription factors and their functional equivalogs may thus be used to manipulate branching. This would provide a unique appearance, which may be desirable in ornamental applications, and may be used to modify lateral branching for use in the forestry industry. A reduction in the formation of lateral branches could reduce knot formation. Conversely, increasing the number of lateral branches could provide utility when a plant is used as a view- or windscreen. Transcription factors that cause primary shoots to become linked at each coflorescence node (e.g., G47) may be used to manipulate plant structure and provide for a unique ornamental appearance.

General development and morphology: apical dominance: The modified expression of presently disclosed transcription factors (e.g., G47, and its equivalogs) that reduce apical dominance could be used in ornamental horticulture, for example, to modify plant architecture, for example, to produce a shorter, more bushy stature than wild type. The latter form would have ornamental utility as well as provide increased resistance to lodging.

Development and morphology: trichomes. Several of the presently disclosed transcription factor genes have been used to modify trichome number, density, trichome cell fate or amount of trichome products produced by plants. These include G370, G1452, G1539, G1816, G1995, G2085, G2718, G2826, G2838, and G2983. In most cases where the metabolic pathways are impossible to engineer, increasing trichome density or size on leaves may be the only way to increase plant productivity. Thus, by increasing trichome density, size or type, trichome-affecting genes and their homologs would have profound utilities in molecular farming practices and increasing the yield of cotton fibers.

If the effects on trichome patterning reflect a general change in heterochronic processes, trichome-affecting transcription factors or their homologs can be used to modify the way meristems and/or cells develop during different phases of the plant life cycle. In particular, altering the timing of phase changes could afford positive effects on yield and biomass production.

General development and morphology: stem morphology and altered vascular tissue structure. Plants in which expression of transcription factor gene that modify stem morphology or lignin content is modified may be used to affect overall plant architecture and the distribution of lignified fiber cells within the stem.

Modulating lignin content might allow the quality of wood used for furniture or construction to be improved. Lignin is energy rich; increasing lignin composition could therefore be valuable in raising the energy content of wood used for fuel. Conversely, the pulp and paper industries seek wood with a reduced lignin content. Currently, lignin must be removed in a costly process that involves the use of many polluting chemicals. Consequently, lignin is a serious barrier to efficient pulp and paper production (Tzfira et al. (1998) *TIBTECH* 16: 439-446; Robinson (1999) *Nature Biotechnology* 17: 27-30). In addition to forest biotechnology applications, changing lignin content by selectively expressing or repressing transcription factors in fruits and vegetables might increase their palatability.

Transcription factors that modify stem structure, including G47 and its equivalogs, may also be used to achieve reduction of higher-order shoot development, resulting in significant plant architecture modification. Overexpression of the genes that encode these transcription factors in woody plants might result in trees that lack side branches, and have fewer knots in the wood. Altering branching patterns could also have applications amongst ornamental and agricultural crops. For example, applications might exist in any species where secondary shoots currently have to be removed manually, or where changes in branching pattern could increase yield or facilitate more efficient harvesting.

General development and morphology: altered root development. By modifying the structure or development of roots by modifying expression levels of one or more of the presently disclosed transcription factor genes, including G651, G730, G1816, G2655, G2718, G2747, G2983, G2992, G2993, and their equivalogs, plants may be produced that have the capacity to thrive in otherwise unproductive soils. For example, grape roots extending further into rocky soils would provide greater anchorage, greater coverage with increased branching, or would remain viable in waterlogged soils, thus increasing the effective planting range of the crop and/or increasing yield and survival. It may be advantageous to manipulate a plant to produce short roots, as when a soil in which the plant will be growing is occasionally flooded, or when pathogenic fungi or disease-causing nematodes are prevalent.

In addition, presently disclosed transcription factors including G1816, G2718, G2983 and their equivalogs, may be used to increase root hair density and thus increase tolerance to abiotic stresses, thereby improving yield and quality.

Development and morphology: cotyledon, hypocotyl. The morphological phenotypes shown by plants overexpressing several of the transcription factor genes in Table 6 indicate that these genes, including those that produce altered cotyledons (e.g., G916, G1420, G1893, G2432, G2636, G2859, and G3059) and hypocotyls (G807, G916, G1510, G1988, G2771, G2859, G2884, G2993), can be used to manipulate light responses such as shade avoidance. As these genes also alter plant architecture, they may find use in the ornamental horticulture industry.

Development and morphology: seed development, ripening and germination rate. A number of the presently disclosed transcription factor genes (e.g., G961) have been shown to modify seed development and germination rate, including when the seeds are in conditions normally unfavorable for germination (e.g., cold, heat or salt stress, or in the presence of ABA), and may, along with functional equivalogs, thus be used to modify and improve germination rates under adverse conditions.

Growth rate and development: fast growth. A number of the presently disclosed transcription factor genes, including G807, G1476, and G2617, could be used to accelerate seedling growth, and thereby allow a crop to become established faster. This would minimize exposure to stress conditions at early stages of growth when the plants are most sensitive. Additionally, it can allow a crop to grow faster than competing weed species.

A number of these transcription factors have also been shown to increase growth rate of mature plants to a significant extent, including more rapid growth and development of reproductive organs. This provides utility for regions with short growing seasons. Accelerating plant growth would also improve early yield or increase biomass at an earlier stage, when such is desirable (for example, in producing vegetable crops or forestry products).

General development and morphology: slow growth rate. A number of the presently disclosed transcription factor genes, including G652, G1013, G1100, G1468, G1535, G1549, G1779, G1938, G2765, G2784, G2826, G2834, G2851, G3091, and G3095, have been shown to have significant effects on retarding plant growth rate and development. These observations have included, for example, delayed growth and development of reproductive organs. Slow growing plants may be highly desirable to ornamental horticulturists, both for providing house plants that display little change in their appearance over time, or outdoor plants for which wild-type or rapid growth is undesirable (e.g., ornamental palm trees). Slow growth may also provide for a prolonged fruiting period, thus extending the harvesting season, particularly in regions with long growing seasons. Slow growth could also provide a prolonged period in which pollen is available for improved self- or cross-fertilization, or cross-fertilization of cultivars that normally flower over non-overlapping time periods. The latter aspect may be particularly useful to plants comprising two or more distinct grafted cultivars (e.g., fruit trees) with normally non-overlapping flowering periods.

General development and morphology: senescence. Presently disclosed transcription factor genes may be used to alter senescence responses in plants. Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. In an experimental setting, tobacco plants engineered to inhibit leaf senescence had a longer photosynthetic lifespan, and produced a 50% increase in dry weight and seed yield (Gan and Amasino (1995) *Science* 270: 1986-1988). Delayed flower senescence caused by knocking out G652 or overexpressing G571, G2536, for example, may generate plants that retain their blossoms longer and this may be of potential interest to the ornamental horticulture industry, and delayed foliar and fruit senescence could improve post-harvest shelf-life of produce.

Premature senescence caused by, for example, G652, G1033, G1772, G2467, G2574, G2783, G2907, G3059, G3111 and their equivalogs may be used to improve a plant's response to disease and hasten fruit ripening.

Growth rate and development: lethality and necrosis. Overexpression of transcription factors, for example, G12, G366, G1384, G1556, G1840, G1832, G1840, G1850, G1957, G1990, G2213, G2298, G2505, G2570, G2587, G2869, G2887 and their equivalogs that have a role in regulating cell death may be used to induce lethality in specific tissues or necrosis in response to pathogen attack. For example, if a transcription factor gene inducing lethality or necrosis was specifically active in gametes (e.g., (G846), embryos (e.g., G374 knockouts) or reproductive organs, its expression in these tissues would lead to ablation and subsequent male or female sterility. Alternatively, under pathogen-regulated expression, a necrosis-inducing transcription factor can restrict the spread of a pathogen infection through a plant.

Plant Size: Large Plants and Increased Biomass.

Plants overexpressing G46, G268, G287, G314, G319, G324, G438, G624, G852, G1113, G1150, G1451, G1468, G2334, G2536, G2650, G2741, and G2979, for example, have been shown to be larger than controls. For some ornamental plants, the ability to provide larger varieties with these genes or their equivalogs may be highly desirable. More significantly, crop species overexpressing these genes from diverse species would also produce higher yields on larger cultivars, particularly those in which the vegetative portion of the plant is edible.

Overexpression of these genes can confer increased stress tolerance as well as increased biomass, and the increased biomass appears to be related to the particular mechanism of stress tolerance exhibited by these genes. The decision for a lateral organ to continue growth and expansion versus entering late development phases (growth cessation and senescence) is controlled genetically and hormonally, including regulation at an organ size checkpoint (e.g., Mizukami (1001) *Curr Opinion Plant Biol* 4: 533-39; Mizukami and Fisher (2000) *Proc. Natl. Acad. Sci.* 97: 942-47; Hu et al. *Plant Cell* 15: 1591)). Organ size is controlled by the meristematic competence of organ cells, with increased meristematic competence leading to increased organ size (both leaves and stems). Plant hormones can impact plant organ size, with ethylene pathway overexpression leading to reduced organ size. There are also suggestions that auxin plays a determinative role in organ size. Stress responses can impact hormone levels in plant tissues, including ABA and ethylene levels. Thus, overexpression of G1073 appears to alter environmental (e.g., stress) inputs to the organ size checkpoint, thus enhancing organ size Plant size: large seedlings. Presently disclosed transcription factor genes, that produce large seedlings can be used to produce crops that become established faster. Large seedlings are generally hardier, less vulnerable to stress, and better able to out-compete weed species. Seedlings in which expression of some of the presently disclosed transcription factors, including G1313, G2679, G2694, and G2838, for example, was modified, have been shown to possess larger cotyledons and/or were more developmentally advanced than control plants. Rapid seedling development made possible by manipulating expression of these genes or their equivalogs is likely to reduce loss due to diseases particularly prevalent at the seedling stage (e.g., damping off) and is thus important for survivability of plants germinating in the field or in controlled environments.

Plant size: dwarfed plants. Presently disclosed transcription factor genes, including G131, G136, G253, G309, G370, G386, G549, G550, G600, G651, G652, G707, G738, G811, G1011, G1100, G1247, G1289, G1340, G1423, G1474, G1483, G1549, G1554, G1593, G1753, G1772, G1779, G1798, G1938, G1983, G1993, G2085, G2226, G2227, G2251, G2372, G2375, G2453, G2456, G2459, G2492, G2515, G2550, G2565, G2574, G2575, G2579, G2616, G2628, G2640, G2649, G2682, G2702, G2757, G2783, G2839, G2846, G2847, G2850, G2884, G2934, G2958, G2979, G2992, G3017, G3059, G3091, and G3111 and their equivalogs can be used to decrease plant stature and may produce plants that are more resistant to damage by wind and rain, have improved lodging resistance, or more resistant to heat or low humidity or water deficit. Dwarf plants are also of significant interest to the ornamental horticulture industry, and particularly for home garden applications for which space availability may be limited.

Growth rate and development: Cell proliferation and differentiation. Transcription factors may be used regulate cell proliferation and/or differentiation in plants. Control of these processes could have valuable applications in plant transformation, cell culture or micro-propagation systems, as well as in control of the proliferation of particular useful tissues or cell types. Transcription factors that induce the proliferation of undifferentiated cells, such as G1539, G1585, G1591, and G2983, can be operably linked with an inducible promoter to promote the formation of callus that can be used for transformation or production of cell suspension cultures. Transcription factors that promote differentiation of shoots could be used in transformation or micro-propagation systems, where regeneration of shoots from callus is currently problematic. In addition, transcription factors that regulate the differentiation of specific tissues could be used to increase the proportion of these tissues in a plant. Transcription factors may promote the differentiation of carpel tissue, and these genes could be applied to commercial species to induce formation of increased numbers of carpels or fruits. A particular application might exist in saffron, one of the world's most expensive spices. Saffron filaments, or threads, are actually the dried stigmas of the saffron flower, Crocus sativus Linneaus. Each flower contains only three stigmas, and more than 75,000 of these flowers are needed to produce just one pound of saffron filaments. An increase in carpel number would increase the quantity of stigmatic tissue and improve yield.

Growth rate and development: cell expansion. Plant growth results from a combination of cell division and cell expansion. Transcription factors may be useful in regulation of cell expansion. Altered regulation of cell expansion (for example, by G521) could affect stem length, an important agronomic characteristic. For instance, short cultivars of wheat contributed to the Green Revolution, because plants that put fewer resources into stem elongation allocate more resources into developing seed and produce higher yield. These plants are also less vulnerable to wind and rain damage. These cultivars were found to be altered in their sensitivity to gibberellins, hormones that regulate stem elongation through control of both cell expansion and cell division. Altered cell expansion in leaves could also produce novel and ornamental plant forms.

Leaf morphology: dark leaves. Color-affecting components in leaves include chlorophylls (generally green), anthocyanins (generally red to blue) and carotenoids (generally yellow to red). Transcription factor genes that increase these pigments in leaves, including G30, G253, G309, G707, G811, G957, G1100, G1327, G1341, G1357, G1389, G1420, g1423, G1452, G1482, G1510, G1535, G1549, G1554, G1593, G1743, G1792, G1796, G1846, G1863, G1932, G1938, G1983, G2085, G2146, G2207, G2226, G2251, G2334, G2371, G2372, G2453, G2456, G2457, G2459, G2550, G2640, G2649, G2661, G2690, G2694, G2771, G2763, G2784, G2837, G2838, G2846, G2847, G2850, G2851, G2958, G2993, G3021, G3059, G3091, G3095, and G3111, may positively affect a plant's value to the ornamental horticulture industry. Variegated varieties, in particular, would show improved contrast. Other uses that result from overexpression of transcription factor genes include improvements in the nutritional value of foodstuffs. For example, lutein is an important nutraceutical; lutein-rich diets have been shown to help prevent age-related macular degeneration (ARMD), the leading cause of blindness in elderly people. Consumption of dark green leafy vegetables has been shown in clinical studies to reduce the risk of ARMD.

Enhanced chlorophyll and carotenoid levels could also improve yield in crop plants. Lutein, like other xanthophylls such as zeaxanthin and violaxanthin, is an essential component in the protection of the plant against the damaging effects of excessive light. Specifically, lutein contributes, directly or indirectly, to the rapid rise of non-photochemical quenching in plants exposed to high light. Crop plants engineered to contain higher levels of lutein could therefore have improved photo-protection, leading to less oxidative damage and better growth under high light (e.g., during long summer days, or at higher altitudes or lower latitudes than those at which a non-transformed plant would thrive). Additionally, elevated chlorophyll levels increases photosynthetic capacity.

Leaf morphology: changes in leaf shape. Presently disclosed transcription factors produce marked and diverse effects on leaf development and shape, and include G30 and many others (see Table 6, "Change in leaf shape"). At early stages of growth, transgenic seedlings have developed narrow, upward pointing leaves with long petioles, possibly indicating a disruption in circadian-clock controlled processes or nyctinastic movements. Other transcription factor genes can be used to alter leaf shape in a significant manner from wild-type, some of which may find use in ornamental applications.

Leaf morphology: altered leaf size. Large leaves, such as those produced in plants overexpressing G268, G324, G438, G852, G1113, G1274, G1451, G2536, G2699, G2768, and G3008, generally increase plant biomass. This provides benefit for crops where the vegetative portion of the plant is the marketable portion.

Leaf morphology: light green and gray leaves. Transcription factor genes such as G351, G600, G651, G1468, G1718, G2565, G2604, G2779, G2859, G3044, and G3070 that provide an altered appearance may positively affect a plant's value to the ornamental horticulture industry.

Leaf morphology: glossy leaves. Transcription factor genes such as G30, G370 (when knocked-out), G975, G1792, G2640, G2649 and their equivalogs that induce the formation of glossy leaves generally do so by elevating levels of epidermal wax. Thus, the genes could be used to engineer changes in the composition and amount of leaf surface components, including waxes. The ability to manipulate wax composition, amount, or distribution could modify plant tolerance to drought and low humidity, or resistance to insects or pathogens. Additionally, wax may be a valuable commodity in some species, and altering its accumulation and/or composition could enhance yield.

Seed morphology: altered seed coloration. Presently disclosed transcription factor genes, including G581, G961, G2085, and G2371, have been used to modify seed color, which, along with the equivalogs of these genes, could provide added appeal to seeds or seed products.

Seed morphology: altered seed size and shape. The introduction of presently disclosed transcription factor genes, including G151, G581, G2085, G2585, or G2933, into plants that increase the size of seeds may have a significant impact on yield and appearance, particularly when the product is the seed itself (e.g., in the case of grains, legumes, nuts, etc.). Seed size, in addition to seed coat integrity, thickness and permeability, seed water content and a number of other components including antioxidants and oligosaccharides, also affects affect seed longevity in storage, with larger seeds often being more desirable for prolonged storage.

Transcription factor genes that alter seed shape, including G652, G916, G961 and their equivalogs may have both ornamental applications and improve or broaden the appeal of seed products.

Leaf and seed biochemistry. Overexpression of transcription factors genes, including G975 and its equivalogs, which results in increased leaf wax could be used to manipulate wax composition, amount, or distribution. These transcription factors can improve yield in those plants and crops from which wax is a valuable product. The genes may also be used to modify plant tolerance to drought and/or low humidity or resistance to insects, as well as plant appearance (glossy leaves). The effect of increased wax deposition on leaves of a plant like may improve water use efficiency. Manipulation of these genes may reduce the wax coating on sunflower seeds; this wax fouls the oil extraction system during sunflower seed processing for oil. For the latter purpose or any other where wax reduction is valuable, antisense or co-suppression of the transcription factor genes in a tissue-specific manner would be valuable.

Prenyl lipids play a role in anchoring proteins in membranes or membranous organelles. Thus modifying the prenyl lipid content of seeds and leaves could affect membrane integrity and function. One important group of prenyl lipids, the tocopherols, have both anti-oxidant and vitamin E activity. Transcription factor genes (e.g., a G652 knockout) have been shown to modify the prenyl lipid content of leaves in plants, and these genes and their equivalogs may thus be used to alter prenyl lipid content of leaves.

Overexpression of transcription factors have resulted in plants with altered leaf insoluble sugar content. These transcription factors and their equivalogs that alter plant cell wall composition have several potential applications including altering food digestibility, plant tensile strength, wood quality, pathogen resistance and in pulp production. In particular, hemicellulose is not desirable in paper pulps because of its lack of strength compared with cellulose. Thus modulating the amounts of cellulose vs. hemicellulose in the plant cell wall is desirable for the paper/lumber industry. Increasing the insoluble carbohydrate content in various fruits, vegetables, and other edible consumer products will result in enhanced fiber content. Increased fiber content would not only provide health benefits in food products, but might also increase digestibility of forage crops. In addition, the hemicellulose and pectin content of fruits and berries affects the quality of jam and catsup made from them. Changes in hemicellulose and pectin content could result in a superior consumer product.

A number of the presently disclosed transcription factor genes have been shown to alter the fatty acid composition in plants (e.g., G975), and seeds and leaves in particular. This modification suggests several utilities, including improving the nutritional value of seeds or whole plants. Dietary fatty acids ratios have been shown to have an effect on, for example, bone integrity and remodeling (see, for example, Weiler (2000) *Pediatr. Res.* 47:5 692-697). The ratio of dietary fatty acids may alter the precursor pools of long-chain polyunsaturated fatty acids that serve as precursors for prostaglandin synthesis. In mammalian connective tissue, prostaglandins serve as important signals regulating the balance between resorption and formation in bone and cartilage. Thus dietary fatty acid ratios altered in seeds may affect the etiology and outcome of bone loss.

Transcription factors that reduce leaf fatty acids, for example, 16:3 fatty acids, may be used to control thylakoid membrane development, including proplastid to chloroplast development. The genes that encode these transcription factors might thus be useful for controlling the transition from proplastid to chromoplast in fruits and vegetables. It may also be desirable to change the expression of these genes to prevent cotyledon greening in *Brassica napus* or *B. campestris* to avoid green oil due to early frost.

Transcription factor genes that increase leaf fatty acid production, including G975 and its equivalogs could potentially be used to manipulate seed composition, which is very important for the nutritional value and production of various food products. A number of transcription factor genes are involved in mediating an aspect of the regulatory response to temperature. These genes may be used to alter the expression of desaturases that lead to production of 18:3 and 16:3 fatty acids, the balance of which affects membrane fluidity and mitigates damage to cell membranes and photosynthetic structures at high and low temperatures.

The G652 knockout line had a reproducible increase in the leaf glucosinolate M39480. It also showed a reproducible increase in seed alpha-tocopherol. A number of glucosinolates have been shown to have anti-cancer activity; thus, increasing the levels or composition of these compounds by modifying the expression of transcription factors (e.g., G652), can have a beneficial effect on human diet.

Glucosinolates are undesirable components of the oilseeds used in animal feed since they produce toxic effects. Low-glucosinolate varieties of canola, for example, have been developed to combat this problem. Glucosinolates form part of a plant's natural defense against insects. Modification of glucosinolate composition or quantity by introducing transcription factors that affect these characteristics can therefore afford increased protection from herbivores. Furthermore, in edible crops, tissue specific promoters can be used to ensure that these compounds accumulate specifically in tissues, such as the epidermis, which are not taken for consumption.

Presently disclosed transcription factor genes that modify levels of phytosterols in plants may have at least two utilities. First, phytosterols are an important source of precursors for the manufacture of human steroid hormones. Thus, regulation of transcription factor expression or activity could lead to elevated levels of important human steroid precursors for steroid semi-synthesis. For example, transcription factors that cause elevated levels of campesterol in leaves, or sitosterols and stigmasterols in seed crops, would be useful for this purpose. Phytosterols and their hydrogenated derivatives phytostanols also have proven cholesterol-lowering properties, and transcription factor genes that modify the expression of these compounds in plants would thus provide health benefits.

The composition of seeds, particularly with respect to seed oil amounts and/or composition, is very important for the nutritional and caloric value and production of various food and feed products. Modifying the expression of transcription factor genes that alter seed oil content could be used to improve the heat stability of oils or to improve the nutritional quality of seed oil, by, for example, reducing the number of calories in seed by decreasing oil or fatty acid content, OR increasing the number of calories in animal feeds by increasing fatty acid or seed oil content (e.g., by knocking out G961, G1451, or G2830).

As with seed oils, the composition of seeds, particularly with respect to protein amounts and/or composition, is very important for the nutritional value and production of various food and feed products. Transcription factor genes may be used to modify protein concentrations in seeds, which would modify the caloric content of seeds or provide nutritional benefits, and may be used to prolong storage, increase seed pest or disease resistance, or modify germination rates.

Prenyl lipids play a role in anchoring proteins in membranes or membranous organelles. Thus, presently disclosed transcription factor genes, including G652 and equivalogs, that modify the prenyl lipid content of seeds and leaves (in the case of G652, when this gene is knocked out) could affect membrane integrity and function. Transcription factor genes have been shown to modify the tocopherol composition of plants. α-Tocopherol is better known as vitamin E. Tocopherols such as α- and γ-tocopherol both have anti-oxidant activity.

Light response/shade avoidance: altered cotyledon, hypocotyl, petiole development, altered leaf orientation, constitutive photomorphogenesis, photomorphogenesis in low light. Presently disclosed transcription factor genes, including G30; G246; G351, G478, G807, G916, G1013, G1082, G1510, G1988, G2432; G2650; G2694, G2754, G2771, G2859, G2884, G2993, G3032 and their equivalogs that can modify a plant's response to light may be useful for modifying plant growth or development, for example, photomorphogenesis in poor light, or accelerating flowering time in response to various light intensities, quality or duration to which a non-transformed plant would not similarly respond. Examples of such responses that have been demonstrated include leaf number and arrangement, and early flower bud appearances. Elimination of shading responses may lead to increased planting densities with subsequent yield enhancement. As these genes may also alter plant architecture, they may find use in the ornamental horticulture industry.

Pigment: Increased Anthocyanin Level in Various Plant Organs and Tissues.

G253, G386, G581, G707, G1482, G2453, G2456, G2459, G2604, G2718 and equivalogs can be used to alter anthocyanin levels in one or more tissues, depending on the organ in which these genes are expressed may be used to alter anthocyanin production in numerous plant species. Expression of presently disclosed transcription factor genes that increase flavonoid production in plants, including anthocyanins and condensed tannins, may be used to alter in pigment production for horticultural purposes, and possibly increasing stress resistance. A number of flavonoids have been shown to have antimicrobial activity and could be used to engineer pathogen resistance. Several flavonoid compounds have health promoting effects such as inhibition of tumor growth, prevention of bone loss and prevention of the oxidation of lipids. Increased levels of condensed tannins, in forage legumes would be an important agronomic trait because they prevent pasture bloat by collapsing protein foams within the rumen. For a review on the utilities of flavonoids and their derivatives, refer to Dixon et al. (1999) *Trends Plant Sci.* 4: 394-400.

Antisense and Co-suppression

In addition to expression of the nucleic acids of the invention as gene replacement or plant phenotype modification nucleic acids, the nucleic acids are also useful for sense and anti-sense suppression of expression, e.g. to down-regulate expression of a nucleic acid of the invention, e.g. as a further mechanism for modulating plant phenotype. That is, the nucleic acids of the invention, or subsequences or anti-sense sequences thereof, can be used to block expression of naturally occurring homologous nucleic acids. A variety of sense and anti-sense technologies are known in the art, e.g. as set forth in Lichtenstein and Nellen (1997) *Antisense Technology: A Practical Approach* IRL Press at Oxford University Press, Oxford, U.K. Antisense regulation is also described in Crowley et al. (1985) *Cell* 43: 633-641; Rosenberg et al. (1985) *Nature* 313: 703-706; Preiss et al. (1985) *Nature* 313: 27-32; Melton (1985) *Proc. Natl. Acad. Sci.* 82: 144-148; Izant and Weintraub (1985) *Science* 229: 345-352; and Kim and Wold (1985) *Cell* 42: 129-138. Additional methods for antisense regulation are known in the art. Antisense regulation has been used to reduce or inhibit expression of plant genes in, for example in European Patent Publication No. 271988. Antisense RNA may be used to reduce gene expression to produce a visible or biochemical phenotypic change in a plant (Smith et al. (1988) *Nature,* 334: 724-726; Smith et al. (1990) *Plant Mol. Biol.* 14: 369-379). In general, sense or anti-sense sequences are introduced into a cell, where they are optionally amplified, e.g. by transcription. Such sequences include both simple oligonucleotide sequences and catalytic sequences such as ribozymes.

For example, a reduction or elimination of expression (i.e., a "knock-out") of a transcription factor or transcription factor homolog polypeptide in a transgenic plant, e.g., to modify a plant trait, can be obtained by introducing an antisense construct corresponding to the polypeptide of interest as a cDNA. For antisense suppression, the transcription factor or homolog cDNA is arranged in reverse orientation (with respect to the coding sequence) relative to the promoter sequence in the expression vector. The introduced sequence need not be the full length cDNA or gene, and need not be identical to the cDNA or gene found in the plant type to be transformed. Typically, the antisense sequence need only be capable of hybridizing to the target gene or RNA of interest. Thus, where the introduced sequence is of shorter length, a higher degree of homology to the endogenous transcription factor sequence will be needed for effective antisense suppression. While antisense sequences of various lengths can be utilized, preferably, the introduced antisense sequence in the vector will be at least 30 nucleotides in length, and improved antisense suppression will typically be observed as the length of the antisense sequence increases. Preferably, the length of the antisense sequence in the vector will be greater than 100 nucleotides. Transcription of an antisense construct as described results in the production of RNA molecules that are the reverse complement of mRNA molecules transcribed from the endogenous transcription factor gene in the plant cell.

Suppression of endogenous transcription factor gene expression can also be achieved using RNA interference, or RNAi. RNAi is a post-transcriptional, targeted gene-silencing technique that uses double-stranded RNA (dsRNA) to incite degradation of messenger RNA (mRNA) containing the same sequence as the dsRNA (Constans, (2002) *The Scientist* 16:36). Small interfering RNAs, or siRNAs are produced in at least two steps: an endogenous ribonuclease cleaves longer dsRNA into shorter, 21-23 nucleotide-long RNAs. The siRNA segments then mediate the degradation of the target mRNA (Zamore, (2001) *Nature Struct. Biol.,* 8:746-50). RNAi has been used for gene function determination in a manner similar to antisense oligonucleotides (Constans, (2002) *The Scientist* 16:36). Expression vectors that continually express siRNAs in transiently and stably transfected have been engineered to express small hairpin RNAs (shRNAs), which get processed in vivo into siRNAs-like molecules capable of carrying out gene-specific silencing (Brummelkamp et al., (2002) *Science* 296:550-553, and Paddison, et al. (2002) *Genes & Dev.* 16:948-958). Post-transcriptional gene silencing by double-stranded RNA is discussed in further detail by Hammond et al. (2001) *Nature Rev Gen* 2: 110-119, Fire et al. (1998) *Nature* 391: 806-811 and Timmons and Fire (1998) *Nature* 395: 854. Vectors in which RNA encoded by a transcription factor or transcription factor homolog cDNA is over-expressed can also be used to obtain co-suppression of a corresponding endogenous gene, e.g., in the manner described in U.S. Pat. No. 5,231,020 to Jorgensen. Such co-suppression (also termed sense suppression) does not require that the entire transcription factor cDNA be introduced into the plant cells, nor does it require that the introduced sequence be exactly identical to the endogenous transcription factor gene of interest. However, as with antisense suppression, the suppressive efficiency will be enhanced as specificity of hybridization is increased, e.g., as the introduced sequence is lengthened, and/or as the sequence similarity between the introduced sequence and the endogenous transcription factor gene is increased.

Vectors expressing an untranslatable form of the transcription factor mRNA, e.g., sequences comprising one or more stop codon, or nonsense mutation) can also be used to suppress expression of an endogenous transcription factor, thereby reducing or eliminating its activity and modifying one or more traits. Methods for producing such constructs are described in U.S. Pat. No. 5,583,021. Preferably, such constructs are made by introducing a premature stop codon into the transcription factor gene. Alternatively, a plant trait can be modified by gene silencing using double-strand RNA (Sharp (1999) *Genes and Development* 13: 139-141). Another method for abolishing the expression of a gene is by insertion mutagenesis using the T-DNA of *Agrobacterium tumefaciens*. After generating the insertion mutants, the mutants can be screened to identify those containing the insertion in a transcription factor or transcription factor homolog gene. Plants containing a single transgene insertion event at the desired gene can be crossed to generate homozygous plants for the mutation. Such methods are well known to those of skill in the art (See for example Koncz et al. (1992) *Methods in Arabidopsis Research*, World Scientific Publishing Co. Pte. Ltd., River Edge, N.J.).

Alternatively, a plant phenotype can be altered by eliminating an endogenous gene, such as a transcription factor or transcription factor homolog, e.g., by homologous recombination (Kempin et al. (1997) *Nature* 389: 802-803).

A plant trait can also be modified by using the Cre-lox system (for example, as described in U.S. Pat. No. 5,658,772). A plant genome can be modified to include first and second lox sites that are then contacted with a Cre recombinase. If the lox sites are in the same orientation, the intervening DNA sequence between the two sites is excised. If the lox sites are in the opposite orientation, the intervening sequence is inverted.

The polynucleotides and polypeptides of this invention can also be expressed in a plant in the absence of an expression cassette by manipulating the activity or expression level of the endogenous gene by other means, such as, for example, by ectopically expressing a gene by T-DNA activation tagging (Ichikawa et al. (1997) *Nature* 390 698-701; Kakimoto et al. (1996) *Science* 274: 982-985). This method entails transforming a plant with a gene tag containing multiple transcriptional enhancers and once the tag has inserted into the genome, expression of a flanking gene coding sequence becomes deregulated. In another example, the transcriptional machinery in a plant can be modified so as to increase transcription levels of a polynucleotide of the invention (See, e.g., PCT Publications WO 96/06166 and WO 98/53057 which describe the modification of the DNA-binding specificity of zinc finger proteins by changing particular amino acids in the DNA-binding motif).

The transgenic plant can also include the machinery necessary for expressing or altering the activity of a polypeptide encoded by an endogenous gene, for example, by altering the phosphorylation state of the polypeptide to maintain it in an activated state.

Transgenic plants (or plant cells, or plant explants, or plant tissues) incorporating the polynucleotides of the invention and/or expressing the polypeptides of the invention can be produced by a variety of well established techniques as described above. Following construction of a vector, most typically an expression cassette, including a polynucleotide, e.g., encoding a transcription factor or transcription factor homolog, of the invention, standard techniques can be used to introduce the polynucleotide into a plant, a plant cell, a plant explant or a plant tissue of interest. Optionally, the plant cell, explant or tissue can be regenerated to produce a transgenic plant.

The plant can be any higher plant, including gymnosperms, monocotyledonous and dicotyledenous plants. Suitable protocols are available for Leguminosae (alfalfa, soybean, clover, etc.), Umbelliferae (carrot, celery, parsnip), Cruciferae (cabbage, radish, rapeseed, broccoli, etc.), Curcurbitaceae (melons and cucumber), Gramineae (wheat, corn, rice, barley, millet, etc.), Solanaceae (potato, tomato, tobacco, peppers, etc.), and various other crops. See protocols described in Ammirato et al., eds., (1984) *Handbook of Plant Cell Culture—Crop Species*, Macmillan Publ. Co., New York, N.Y.; Shimamoto et al. (1989) *Nature* 338: 274-276; Fromm et al. (1990) *Bio/Technol.* 8: 833-839; and Vasil et al. (1990) *Bio/Technol.* 8: 429-434.

Transformation and regeneration of both monocotyledonous and dicotyledonous plant cells is now routine, and the selection of the most appropriate transformation technique will be determined by the practitioner. The choice of method will vary with the type of plant to be transformed; those skilled in the art will recognize the suitability of particular methods for given plant types. Suitable methods can include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and *Agrobacterium tumefaciens* mediated transformation. Transformation means introducing a nucleotide sequence into a plant in a manner to cause stable or transient expression of the sequence.

Successful examples of the modification of plant characteristics by transformation with cloned sequences which serve to illustrate the current knowledge in this field of technology, and which are herein incorporated by reference, include: U.S. Pat. Nos. 5,571,706; 5,677,175; 5,510,471; 5,750,386; 5,597,945; 5,589,615; 5,750,871; 5,268,526; 5,780,708; 5,538,880; 5,773,269; 5,736,369 and 5,610,042.

Following transformation, plants are preferably selected using a dominant selectable marker incorporated into the transformation vector. Typically, such a marker will confer antibiotic or herbicide resistance on the transformed plants, and selection of transformants can be accomplished by exposing the plants to appropriate concentrations of the antibiotic or herbicide.

After transformed plants are selected and grown to maturity, those plants showing a modified trait are identified. The modified trait can be any of those traits described above. Additionally, to confirm that the modified trait is due to changes in expression levels or activity of the polypeptide or polynucleotide of the invention can be determined by analyzing mRNA expression using Northern blots, RT-PCR or microarrays, or protein expression using immunoblots or Western blots or gel shift assays.

Integrated Systems—Sequence Identity

Additionally, the present invention may be an integrated system, computer or computer readable medium that comprises an instruction set for determining the identity of one or more sequences in a database. In addition, the instruction set can be used to generate or identify sequences that meet any specified criteria. Furthermore, the instruction set may be used to associate or link certain functional benefits, such improved characteristics, with one or more identified sequence.

For example, the instruction set can include, e.g., a sequence comparison or other alignment program, e.g., an available program such as, for example, the Wisconsin Package Version 10.0, such as BLAST, FASTA, PILEUP, FINDPATTERNS or the like (GCG, Madison, Wis.). Public sequence databases such as GenBank, EMBL, Swiss-Prot and PIR or private sequence databases such as PHYTOSEQ sequence database (Incyte Genomics, Palo Alto, Calif.) can be searched.

Alignment of sequences for comparison can be conducted by the local homology algorithm of Smith and Waterman (1981) *Adv. Appl. Math.* 2: 482-489, by the homology alignment algorithm of Needleman and Wunsch (1970) *J. Mol. Biol.* 48: 443-453, by the search for similarity method of Pearson and Lipman (1988) *Proc. Natl. Acad. Sci.* 85: 2444-2448, by computerized implementations of these algorithms. After alignment, sequence comparisons between two (or more) polynucleotides or polypeptides are typically performed by comparing sequences of the two sequences over a comparison window to identify and compare local regions of sequence similarity. The comparison window can be a segment of at least about 20 contiguous positions, usually about 50 to about 200, more usually about 100 to about 150 contiguous positions. A description of the method is provided in Ausubel et al. supra.

A variety of methods for determining sequence relationships can be used, including manual alignment and computer assisted sequence alignment and analysis. This later approach is a preferred approach in the present invention, due to the increased throughput afforded by computer assisted methods. As noted above, a variety of computer programs for performing sequence alignment are available, or can be produced by one of skill.

One example algorithm that is suitable for determining percent sequence identity and sequence similarity is the BLAST algorithm, which is described in Altschul et al. (1990) *J. Mol. Biol.* 215: 403-410. Software for performing BLAST analyses is publicly available, e.g., through the National Library of Medicine's National Center for Biotechnology Information (ncbi.nlm.nih; see at world wide web (www) National Institutes of Health US government (gov) website). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al. supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff (1992) *Proc. Natl. Acad. Sci.* 89: 10915-10919). Unless otherwise indicated, "sequence identity" here refers to the % sequence identity generated from a tblastx using the NCBI version of the algorithm at the default settings using gapped alignments with the filter "off" (see, for example, NIH NLM NCBI website at ncbi.nlm.nih, supra).

The percent identity between two polypeptide sequences can also be determined using Accelrys Gene v2.5 (2006) with default parameters: Pairwise Matrix: GONNET; Align Speed: Slow; Open Gap Penalty: 10.000; Extended Gap Penalty: 0.100; Multiple Matrix: GONNET; Multiple Open Gap Penalty: 10.000; Multiple Extended Gap Penalty: 0.05; Delay Divergent: 30; Gap Separation Distance: 8; End Gap Separation: false; Residue Specific Penalties: false; Hydrophilic Penalties: false; Hydrophilic Residues: G, P, S, N, D, Q, E, K, and R. The default parameters for determining percent identity between two polynucleotide sequences using Accelrys Gene are: Align Speed: Slow; Open Gap Penalty: 10.000; Extended Gap Penalty: 5.000; Multiple Open Gap Penalty: 10.000; Multiple Extended Gap Penalty: 5.000; Delay Divergent: 40; Transition: Weighted.

In addition to calculating percent sequence identity, the BLAST algorithm also performs a statistical analysis of the similarity between two sequences (see, e.g. Karlin and Altschul (1993) *Proc. Natl. Acad. Sci.* 90: 5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence (and, therefore, in this context, homologous) if the smallest sum probability in a comparison of the test nucleic acid to the reference nucleic acid is less than about 0.1, or less than about 0.01, and or even less than about 0.001. An additional example of a useful sequence alignment algorithm is PILEUP. PILEUP creates a multiple sequence alignment from a group of related sequences using progressive, pairwise alignments. The program can align, e.g., up to 300 sequences of a maximum length of 5,000 letters.

The integrated system, or computer typically includes a user input interface allowing a user to selectively view one or more sequence records corresponding to the one or more character strings, as well as an instruction set which aligns the one or more character strings with each other or with an additional character string to identify one or more region of sequence similarity. The system may include a link of one or more character strings with a particular phenotype or gene function. Typically, the system includes a user readable output element that displays an alignment produced by the alignment instruction set.

The methods of this invention can be implemented in a localized or distributed computing environment. In a distributed environment, the methods may implemented on a single computer comprising multiple processors or on a multiplicity of computers. The computers can be linked, e.g. through a common bus, but more preferably the computer(s) are nodes on a network. The network can be a generalized or a dedicated local or wide-area network and, in certain preferred embodiments, the computers may be components of an intra-net or an internet.

Thus, the invention provides methods for identifying a sequence similar or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an inter or intra net) and a query is made against the sequence database using the relevant sequences herein and associated plant phenotypes or gene functions.

Any sequence herein can be entered into the database, before or after querying the database. This provides for both expansion of the database and, if done before the querying step, for insertion of control sequences into the database. The control sequences can be detected by the query to ensure the general integrity of both the database and the query. As noted, the query can be performed using a web browser based interface. For example, the database can be a centralized public database such as those noted herein, and the querying can be done from a remote terminal or computer across an internet or intranet.

Any sequence herein can be used to identify a similar, homologous, paralogous, or orthologous sequence in another plant. This provides means for identifying endogenous sequences in other plants that may be useful to alter a trait of progeny plants, which results from crossing two plants of different strain. For example, sequences that encode an ortholog of any of the sequences herein that naturally occur in a plant with a desired trait can be identified using the sequences disclosed herein. The plant is then crossed with a second plant of the same species but which does not have the desired trait to produce progeny which can then be used in further crossing experiments to produce the desired trait in the second plant. Therefore the resulting progeny plant contains no transgenes; expression of the endogenous sequence may also be regulated by treatment with a particular chemical or other means, such as EMR. Some examples of such compounds well known in the art include: ethylene; cytokinins; phenolic compounds, which stimulate the transcription of the genes needed for infection; specific monosaccharides and acidic environments which potentiate vir gene induction; acidic polysaccharides which induce one or more chromosomal genes; and opines; other mechanisms include light or dark treatment (for a review of examples of such treatments, see, Winans (1992) *Microbiol. Rev.* 56: 12-31; Eyal et al. (1992) *Plant Mol. Biol.* 19: 589-599; Chrispeels et al. (2000) *Plant Mol. Biol.* 42: 279-290; Piazza et al. (2002) *Plant Physiol.* 128: 1077-1086).

Table 7 lists sequences discovered to be orthologous to a number of representative transcription factors of the present invention. The column headings include the transcription factors listed by (a) the SEQ ID NO: of the *Arabidopsis* sequence that was used to discover the non-*Arabidopsis* orthologous sequence; (b) the GID sequence identifier of the *Arabidopsis* sequence; (c) the Sequence Identifier or GenBank Accession Number of the orthologous sequence; (d) the species from which the orthologous sequence is derived; (e) the SEQ ID NO: of the non-*Arabidopsis* orthologous sequence, and (e) the smallest sum probability pairwise comparison of each orthologous sequence to the similar *Arabidopsis* sequence determined by BLAST analysis.

TABLE 7

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 7 | G30 | *Oryza sativa* | G3381 | 2126 | 5.00E−33 |
| 7 | G30 | *Glycine max* | AW308784.1 | 685 | |
| 7 | G30 | *Glycine max* | BG790680.1 | 686 | |
| 7 | G30 | *Glycine max* | GLYMA-28NOV01-CLUSTER602185_1 | 687 | |
| 7 | G30 | *Glycine max* | GLYMA-28NOV01-CLUSTER91218_1 | 688 | |
| 7 | G30 | *Glycine max* | LIB5118-009-Q1-PF1-F2 | 689 | |
| 7 | G30 | *Oryza sativa* | OSC20174.C1.p2.fg | 690 | |
| 7 | G30 | *Zea mays* | LIB4756-134-A1-K1-G10 | 691 | |
| 7 | G30 | *Oryza sativa* | Os_S102414 | 1559 | |
| 7 | G30 | *Glycine max* | Gma_S5001644 | 1633 | |
| 7 | G30 | *Zea mays* | Zm_S11513768 | 1754 | |
| 7 | G30 | *Triticum aestivum* | Ta_S274849 | 1834 | |
| 8 | G30 | *Brassica oleracea* | BH517030 | | 1.00E−37 |
| 8 | G30 | *Lycopersicon esculentum* | AI776626 | | 2.00E−35 |
| 8 | G30 | *Triticum aestivum* | BT009060 | | 2.00E−33 |
| 8 | G30 | *Sorghum bicolor* | BZ337899 | | 1.00E−32 |
| 8 | G30 | *Eucalyptus grandis* | CB967722 | | 1.00E−31 |
| 8 | G30 | *Zea mays* | CC349655 | | 1.00E−31 |
| 8 | G30 | *Oryza sativa* (*japonica* cultivar-group) | AP004623 | | 3.00E−31 |
| 8 | G30 | *Oryza sativa* (*indica* cultivar-group) | AAAA01005323 | | 3.00E−31 |
| 8 | G30 | *Oryza sativa* | AP003891 | | 3.00E−31 |
| 8 | G30 | *Glycine max* | BG790680 | | 4.00E−29 |
| 8 | G30 | *Oryza sativa* (*japonica* cultivar-group) | gi28071302 | | 3.60E−32 |
| 8 | G30 | *Lycopersicon esculentum* | gi2213783 | | 7.90E−26 |
| 8 | G30 | *Catharanthus roseus* | gi8980313 | | 4.70E−24 |
| 8 | G30 | *Matricaria chamomilla* | gi17385636 | | 1.10E−23 |
| 8 | G30 | *Oryza sativa* | gi12597874 | | 1.80E−23 |
| 8 | G30 | *Mesembryanthemum crystallinum* | gi32401273 | | 3.70E−23 |
| 8 | G30 | *Nicotiana tabacum* | gi1732406 | | 5.20E−23 |
| 8 | G30 | *Nicotiana sylvestris* | gi8809571 | | 8.70E−22 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 8 | G30 | *Cicer arietinum* | gi24817250 | | 1.10E−21 |
| 8 | G30 | *Glycine max* | gi21304712 | | 1.40E−21 |
| 11 | G47 | *Glycine max* | G3643 | 2225 | 2.00E−29 |
| 11 | G47 | *Oryza sativa* | G3644 | 2227 | 3.00E−25 |
| 11 | G47 | *Brassica rapa* | G3645 | 2229 | 1.00E−63 |
| 11 | G47 | *Brassica oleracea* | G3646 | 2231 | 2.00E−46 |
| 11 | G47 | *Zinnia elegans* | G3647 | 2233 | 3.00E−33 |
| 11 | G47 | *Oryza sativa* | G3649 | 2235 | 4.00E−23 |
| 11 | G47 | *Oryza sativa* | G3651 | 2237 | 3.00E−20 |
| 11 | G47 | *Glycine max* | GLYMA-28NOV01-CLUSTER115749_1 | 702 | |
| 11 | G47 | *Oryza sativa* | OSC21268.C1.p12.fg | 703 | |
| 11 | G47 | *Hordeum vulgare* | Hv_S7318 | 1718 | |
| 12 | G47 | *Brassica rapa* subsp. *pekinensis* | BG543936 | | 2.00E−60 |
| 12 | G47 | *Brassica oleracea* | BH420519 | | 4.00E−43 |
| 12 | G47 | *Zinnia elegans* | AU292603 | | 5.00E−30 |
| 12 | G47 | *Medicago truncatula* | BE320193 | | 2.00E−24 |
| 12 | G47 | *Oryza sativa* (*indica* cultivar-group) | AAAA01000718 | | 2.00E−22 |
| 12 | G47 | *Oryza sativa* | AP003379 | | 2.00E−22 |
| 12 | G47 | *Oryza sativa* (*japonica* cultivar-group) | AC124836 | | 1.00E−20 |
| 12 | G47 | *Zea mays* | BZ403609 | | 2.00E−20 |
| 12 | G47 | *Solanum tuberosum* | BQ513932 | | 7.00E−17 |
| 12 | G47 | *Pinus taeda* | BQ698717 | | 1.00E−16 |
| 12 | G47 | *Oryza sativa* (*japonica* cultivar-group) | gi20161239 | | 8.50E−24 |
| 12 | G47 | *Oryza sativa* | gi14140155 | | 8.30E−17 |
| 12 | G47 | *Lycopersicon esculentum* | gi25992102 | | 2.80E−16 |
| 12 | G47 | *Glycine max* | gi31324058 | | 2.80E−16 |
| 12 | G47 | *Zea mays* | gi21908034 | | 8.60E−15 |
| 12 | G47 | *Brassica napus* | gi20303011 | | 2.30E−14 |
| 12 | G47 | *Atriplex hortensis* | gi8571476 | | 3.70E−14 |
| 12 | G47 | *Catharanthus roseus* | gi8980313 | | 2.60E−13 |
| 12 | G47 | *Hordeum vulgare* | gi19071243 | | 5.40E−13 |
| 12 | G47 | *Matricaria chamomilla* | gi17385636 | | 1.40E−12 |
| 34 | G142 | *Brassica oleracea* var. *botrytis* | BOL508409 | | 1.00E−127 |
| 34 | G142 | *Vitis vinifera* | AF373602 | | 1.00E−88 |
| 34 | G142 | *Malus domestica* | MDAJ763 | | 3.00E−84 |
| 34 | G142 | *Petunia* x *hybrida* | AB031035 | | 2.00E−77 |
| 34 | G142 | *Agapanthus praecox* | AB079261 | | 1.00E−76 |
| 34 | G142 | *Chrysanthemum* x *morifolium* | AY173062 | | 8.00E−75 |
| 34 | G142 | *Oryza sativa* | OSU78782 | | 6.00E−74 |
| 34 | G142 | *Oryza sativa* (*japonica* cultivar-group) | AK069103 | | 6.00E−74 |
| 34 | G142 | *Zea mays* | MZEMADSB | | 3.00E−73 |
| 34 | G142 | *Triticum aestivum* | AB007505 | | 3.00E−72 |
| 34 | G142 | *Brassica oleracea* var. *botrytis* | gi23304710 | | 6.50E−120 |
| 34 | G142 | *Vitis vinifera* | gi20385586 | | 3.30E−86 |
| 34 | G142 | *Malus domestica* | gi3646340 | | 1.20E−81 |
| 34 | G142 | *Petunia* x *hybrida* | gi7544096 | | 1.60E−75 |
| 34 | G142 | *Agapanthus praecox* | gi29467050 | | 1.50E−74 |
| 34 | G142 | *Oryza sativa* | gi2286109 | | 2.20E−73 |
| 34 | G142 | *Chrysanthemum* x *morifolium* | gi27804371 | | 4.50E−73 |
| 34 | G142 | *Zea mays* | gi7446515 | | 1.50E−72 |
| 34 | G142 | *Lolium perenne* | gi28630959 | | 8.40E−72 |
| 34 | G142 | *Triticum aestivum* | gi3688591 | | 2.20E−71 |
| 39 | G148 | *Glycine max* | GLYMA-28NOV01-CLUSTER24877_1 | 704 | |
| 39 | G148 | *Glycine max* | GLYMA-28NOV01-CLUSTER99362_1 | 705 | |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 39 | G148 | *Oryza sativa* | ORYSA-22JAN02-CLUSTER865_1 | 706 | |
| 39 | G148 | *Oryza sativa* | OSC101589.C1.p14.fg | 707 | |
| 39 | G148 | *Zea mays* | LIB4766-083-R1-K1-A9 | 708 | |
| 39 | G148 | *Zea mays* | ZEAMA-08NOV01-CLUSTER914_1 | 709 | |
| 39 | G148 | *Zea mays* | ZEAMA-08NOV01-CLUSTER914_14 | 710 | |
| 39 | G148 | *Zea mays* | ZEAMA-08NOV01-CLUSTER914_2 | 711 | |
| 39 | G148 | *Zea mays* | ZEAMA-08NOV01-CLUSTER914_3 | 712 | |
| 39 | G148 | *Oryza sativa* | Os_S31752 | 1560 | |
| 39 | G148 | *Oryza sativa* | Os_S63871 | 1561 | |
| 39 | G148 | *Oryza sativa* | Os_S65486 | 1562 | |
| 39 | G148 | *Zea mays* | Zm_S11418374 | 1755 | |
| 39 | G148 | *Zea mays* | Zm_S11418375 | 1756 | |
| 39 | G148 | *Triticum aestivum* | Ta_S66204 | 1835 | |
| 39 | G148 | *Lycopersicon esculentum* | SGN-UNIGENE-44128 | 1943 | |
| 39 | G148 | *Lycopersicon esculentum* | SGN-UNIGENE-SINGLET-42436 | 1944 | |
| 40 | G148 | *Brassica oleracea* var. *botrytis* | BOL508409 | | 3.00E−74 |
| 40 | G148 | *Malus domestica* | MDAJ763 | | 2.00E−65 |
| 40 | G148 | *Vitis vinifera* | AF373602 | | 3.00E−64 |
| 40 | G148 | *Petunia* x *hybrida* | AB031035 | | 1.00E−59 |
| 40 | G148 | *Chrysanthemum* x *morifolium* | AY173062 | | 1.00E−58 |
| 40 | G148 | *Oryza sativa* | OSU78782 | | 3.00E−57 |
| 40 | G148 | *Oryza sativa* (*japonica* cultivar-group) | AK069103 | | 3.00E−57 |
| 40 | G148 | *Triticum aestivum* | AB007505 | | 1.00E−56 |
| 40 | G148 | *Lolium perenne* | AY198329 | | 1.00E−55 |
| 40 | G148 | *Poa annua* | AF372840 | | 5.00E−55 |
| 40 | G148 | *Brassica oleracea* var. *botrytis* | gi23304710 | | 1.70E−73 |
| 40 | G148 | *Malus domestica* | gi3646340 | | 6.50E−65 |
| 40 | G148 | *Vitis vinifera* | gi20385586 | | 7.40E−64 |
| 40 | G148 | *Petunia* x *hybrida* | gi7544096 | | 7.10E−59 |
| 40 | G148 | *Chrysanthemum* x *morifolium* | gi27804371 | | 2.20E−57 |
| 40 | G148 | *Triticum aestivum* | gi3688591 | | 3.50E−57 |
| 40 | G148 | *Oryza sativa* | gi2286109 | | 4.50E−57 |
| 40 | G148 | *Lolium perenne* | gi28630959 | | 5.20E−56 |
| 40 | G148 | *Poa annua* | gi13958339 | | 8.40E−56 |
| 40 | G148 | *Agapanthus praecox* | gi29467050 | | 9.70E−55 |
| 43 | G153 | *Oryza sativa* | G3479 | 2189 | 2.00E−59 |
| 43 | G153 | *Glycine max* | G3484 | 2191 | 3.00E−77 |
| 43 | G153 | *Glycine max* | G3485 | 2193 | 9.00E−63 |
| 43 | G153 | *Zea mays* | G3487 | 2195 | 5.00E−63 |
| 43 | G153 | *Zea mays* | G3488 | 2197 | 2.00E−61 |
| 43 | G153 | *Zea mays* | G3489 | 2199 | 6.00E−66 |
| 43 | G153 | *Glycine max* | GLYMA-28NOV01-CLUSTER393266_1 | 713 | |
| 43 | G153 | *Glycine max* | GLYMA-28NOV01-CLUSTER84992_1 | 714 | |
| 43 | G153 | *Oryza sativa* | OSC19180.C1.p14.fg | 715 | |
| 43 | G153 | *Zea mays* | ZEAMA-08NOV01-CLUSTER124_1 | 716 | |
| 43 | G153 | *Zea mays* | ZEAMA-08NOV01-CLUSTER226078_2 | 717 | |
| 43 | G153 | *Zea mays* | uC-zmflMo17202h01 | 718 | |
| 43 | G153 | *Glycine max* | Gma_S5139103 | 1634 | |
| 43 | G153 | *Zea mays* | Zm_S11418691 | 1757 | |
| 43 | G153 | *Zea mays* | Zm_S11433900 | 1758 | |
| 43 | G153 | *Lycopersicon esculentum* | SGN-UNIGENE-SINGLET-362903 | 1945 | |
| 43 | G153 | *Lycopersicon esculentum* | SGN-UNIGENE-SINGLET-8562 | 1946 | |
| 44 | G153 | *Antirrhinum majus* | AMDEFH125 | | 1.00E−67 |
| 44 | G153 | *Zea mays* | AF112149 | | 8.00E−63 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 44 | G153 | *Oryza sativa* (*japonica* cultivar-group) | AY177696 | | 1.00E−62 |
| 44 | G153 | *Glycine max* | AW706936 | | 5.00E−59 |
| 44 | G153 | *Medicago truncatula* | BQ164807 | | 5.00E−59 |
| 44 | G153 | *Lycopersicon esculentum* | AW218280 | | 5.00E−56 |
| 44 | G153 | *Solanum tuberosum* | BM405213 | | 2.00E−55 |
| 44 | G153 | *Medicago sativa* | MSU91964 | | 6.00E−54 |
| 44 | G153 | *Triticum aestivum* | AX658813 | | 3.00E−49 |
| 44 | G153 | *Mesembryanthemum crystallinum* | BE034403 | | 3.00E−48 |
| 44 | G153 | *Antirrhinum majus* | gi1816459 | | 2.10E−66 |
| 44 | G153 | *Oryza sativa* (*japonica* cultivar-group) | gi30313677 | | 2.90E−62 |
| 44 | G153 | *Zea mays* | gi29611976 | | 7.70E−62 |
| 44 | G153 | *Medicago sativa* | gi1928874 | | 1.30E−52 |
| 44 | G153 | *Ipomoea batatas* | gi15081463 | | 6.90E−45 |
| 44 | G153 | *Oryza sativa* | gi7592642 | | 9.10E−43 |
| 44 | G153 | *Lolium perenne* | gi28630953 | | 8.20E−42 |
| 44 | G153 | *Lolium temulentum* | gi4204232 | | 1.70E−41 |
| 44 | G153 | *Triticum aestivum* | gi30721847 | | 2.80E−41 |
| 44 | G153 | *Hordeum vulgare* | gi9367313 | | 2.80E−41 |
| 66 | G287 | *Vicia faba* | VFPTF2 | | 5.00E−99 |
| 66 | G287 | *Oryza sativa* (*japonica* cultivar-group) | AK069464 | | 1.00E−80 |
| 66 | G287 | *Brassica oleracea* | BZ074994 | | 6.00E−63 |
| 66 | G287 | *Lactuca sativa* | BQ869065 | | 1.00E−61 |
| 66 | G287 | *Oryza sativa* (*indica* cultivar-group) | CB620939 | | 1.00E−58 |
| 66 | G287 | *Amborella trichopoda* | CD482217 | | 2.00E−52 |
| 66 | G287 | *Solanum tuberosum* | BG599712 | | 1.00E−40 |
| 66 | G287 | *Medicago truncatula* | BG648535 | | 2.00E−32 |
| 66 | G287 | *Triticum aestivum* | CD897359 | | 1.00E−29 |
| 66 | G287 | *Oryza sativa* | AP002536 | | 2.00E−14 |
| 66 | G287 | *Vicia faba* | gi2104683 | | 5.80E−99 |
| 66 | G287 | *Oryza sativa* (*japonica* cultivar-group) | gi28301944 | | 3.90E−09 |
| 66 | G287 | *Oryza sativa* | gi15451572 | | 0.004 |
| 66 | G287 | *Lycopersicon esculentum* | gi13620220 | | 0.47 |
| 66 | G287 | *Brassica nigra* | gi20148766 | | 0.47 |
| 66 | G287 | *Nicotiana tabacum* | gi119714 | | 0.57 |
| 66 | G287 | *Spermatozopsis similis* | gi4584086 | | 0.75 |
| 66 | G287 | *Prunus armeniaca* | gi2688826 | | 0.99 |
| 66 | G287 | *Petunia x hybrida* | gi21105740 | | 1 |
| 105 | G485 | *Oryza sativa* | G3394 | 2135 | 2.00E−50 |
| 105 | G485 | *Oryza sativa* | G3395 | 2137 | 3.00E−46 |
| 105 | G485 | *Oryza sativa* | G3396 | 2139 | 2.00E−42 |
| 105 | G485 | *Oryza sativa* | G3397 | 2141 | 1.00E−55 |
| 105 | G485 | *Oryza sativa* | G3398 | 2143 | 3.00E−60 |
| 105 | G485 | *Oryza sativa* | G3429 | 2145 | 3.00E−18 |
| 105 | G485 | *Zea mays* | G3434 | 2149 | 1.00E−49 |
| 105 | G485 | *Zea mays* | G3435 | 2151 | 1.00E−57 |
| 105 | G485 | *Zea mays* | G3436 | 2153 | 9.00E−60 |
| 105 | G485 | *Zea mays* | G3437 | 2155 | 3.00E−53 |
| 105 | G485 | *Glycine max* | G3470 | 2171 | 7.00E−46 |
| 105 | G485 | *Glycine max* | G3471 | 2173 | 1.00E−46 |
| 105 | G485 | *Glycine max* | G3472 | 2175 | 3.00E−57 |
| 105 | G485 | *Glycine max* | G3473 | 2177 | 2.00E−53 |
| 105 | G485 | *Glycine max* | G3474 | 2179 | 5.00E−58 |
| 105 | G485 | *Glycine max* | G3475 | 2181 | 5.00E−56 |
| 105 | G485 | *Glycine max* | G3476 | 2183 | 9.00E−57 |
| 105 | G485 | *Glycine max* | G3477 | 2185 | 7.00E−46 |
| 105 | G485 | *Glycine max* | G3478 | 2187 | 3.00E−56 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 105 | G485 | *Glycine max* | GLYMA-28NOV01-CLUSTER24839_1 | 798 | |
| 105 | G485 | *Glycine max* | GLYMA-28NOV01-CLUSTER31103_1 | 799 | |
| 105 | G485 | *Glycine max* | GLYMA-28NOV01-CLUSTER33504_1 | 800 | |
| 105 | G485 | *Glycine max* | GLYMA-28NOV01-CLUSTER33504_3 | 801 | |
| 105 | G485 | *Glycine max* | GLYMA-28NOV01-CLUSTER33504_4 | 802 | |
| 105 | G485 | *Glycine max* | GLYMA-28NOV01-CLUSTER33504_5 | 803 | |
| 105 | G485 | *Glycine max* | GLYMA-28NOV01-CLUSTER33504_6 | 804 | |
| 105 | G485 | *Glycine max* | GLYMA-28NOV01-CLUSTER4778_1 | 805 | |
| 105 | G485 | *Glycine max* | GLYMA-28NOV01-CLUSTER4778_3 | 806 | |
| 105 | G485 | *Oryza sativa* | OSC12630.C1.p5.fg | 807 | |
| 105 | G485 | *Oryza sativa* | OSC1404.C1.p3.fg | 808 | |
| 105 | G485 | *Oryza sativa* | OSC30077.C1.p6.fg | 809 | |
| 105 | G485 | *Oryza sativa* | OSC512.C1.p2.fg | 810 | |
| 105 | G485 | *Oryza sativa* | OSC5489.C1.p2.fg | 811 | |
| 105 | G485 | *Oryza sativa* | sicef_0681.z1.abd | 812 | |
| 105 | G485 | *Zea mays* | LIB3732-044-Q6-K6-C4 | 813 | |
| 105 | G485 | *Zea mays* | ZEAMA-08NOV01-CLUSTER719_1 | 814 | |
| 105 | G485 | *Zea mays* | ZEAMA-08NOV01-CLUSTER719_10 | 815 | |
| 105 | G485 | *Zea mays* | ZEAMA-08NOV01-CLUSTER719_2 | 816 | |
| 105 | G485 | *Zea mays* | ZEAMA-08NOV01-CLUSTER719_3 | 817 | |
| 105 | G485 | *Zea mays* | ZEAMA-08NOV01-CLUSTER719_4 | 818 | |
| 105 | G485 | *Zea mays* | ZEAMA-08NOV01-CLUSTER719_5 | 819 | |
| 105 | G485 | *Zea mays* | ZEAMA-08NOV01-CLUSTER90408_1 | 820 | |
| 105 | G485 | *Zea mays* | ZEAMA-08NOV01-CLUSTER90408_2 | 821 | |
| 105 | G485 | *Glycine max* | Gma_S4904793 | 1641 | |
| 105 | G485 | *Hordeum vulgare* | Hv_S138973 | 1725 | |
| 105 | G485 | *Hordeum vulgare* | Hv_S17617 | 1726 | |
| 105 | G485 | *Zea mays* | Zm_S11418173 | 1776 | |
| 105 | G485 | *Zea mays* | Zm_S11434692 | 1777 | |
| 105 | G485 | *Zea mays* | Zm_S11509886 | 1778 | |
| 105 | G485 | *Triticum aestivum* | Ta_S198814 | 1846 | |
| 105 | G485 | *Triticum aestivum* | Ta_S45374 | 1847 | |
| 105 | G485 | *Triticum aestivum* | Ta_S50443 | 1848 | |
| 105 | G485 | *Triticum aestivum* | Ta_S93629 | 1849 | |
| 105 | G485 | *Lycopersicon esculentum* | SGN-UNIGENE-46859 | 1980 | |
| 105 | G485 | *Lycopersicon esculentum* | SGN-UNIGENE-47447 | 1981 | |
| 106 | G485 | *Poncirus trifoliata* | CD574709 | | 9.00E−62 |
| 106 | G485 | *Solanum tuberosum* | BQ505706 | | 4.00E−60 |
| 106 | G485 | *Lactuca sativa* | BQ996905 | | 2.00E−58 |
| 106 | G485 | *Oryza sativa* (*indica* cultivar-group) | AAAA01003638 | | 3.00E−57 |
| 106 | G485 | *Oryza sativa* (*japonica* cultivar-group) | AP005193 | | 3.00E−57 |
| 106 | G485 | *Beta vulgaris* | BQ592365 | | 9.00E−57 |
| 106 | G485 | *Zea mays* | CD438068 | | 9.00E−57 |
| 106 | G485 | *Physcomitrella patens* | AX288144 | | 3.00E−56 |
| 106 | G485 | *Populus balsamifera* subsp. *trichocarpa* | BU880488 | | 1.00E−55 |
| 106 | G485 | *Glycine max* | AX584277 | | 6.00E−55 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 106 | G485 | *Oryza sativa* (*japonica* cultivar-group) | gi30409461 | | 4.60E−48 |
| 106 | G485 | *Zea mays* | gi115840 | | 9.50E−48 |
| 106 | G485 | *Oryza sativa* (*indica* cultivar-group) | gi30349365 | | 1.10E−39 |
| 106 | G485 | *Oryza sativa* | gi15408794 | | 1.60E−38 |
| 106 | G485 | *Phaseolus coccineus* | gi22536010 | | 2.90E−37 |
| 106 | G485 | *Gossypium barbadense* | gi28274147 | | 6.30E−35 |
| 106 | G485 | *Vernonia galamensis* | gi16902054 | | 2.70E−34 |
| 106 | G485 | *Glycine max* | gi16902050 | | 1.20E−33 |
| 106 | G485 | *Argemone mexicana* | gi16902056 | | 1.10E−32 |
| 106 | G485 | *Triticum aestivum* | gi16902058 | | 2.90E−30 |
| 121 | G627 | *Glycine max* | GLYMA-28NOV01-CLUSTER65192_1 | 822 | |
| 121 | G627 | *Glycine max* | GLYMA-28NOV01-CLUSTER65192_2 | 823 | |
| 121 | G627 | *Oryza sativa* | ORYSA-22JAN02-CLUSTER495_1 | 824 | |
| 121 | G627 | *Oryza sativa* | Os_S65371 | 1575 | |
| 121 | G627 | *Medicago truncatula* | Mtr_S5455444 | 1695 | |
| 121 | G627 | *Hordeum vulgare* | Hv_S12327 | 1727 | |
| 121 | G627 | *Triticum aestivum* | Ta_S329524 | 1850 | |
| 121 | G627 | *Lycopersicon esculentum* | SGN-UNIGENE-58075 | 1982 | |
| 122 | G627 | *Populus tremuloides* | AF377868 | | 3.00E−60 |
| 122 | G627 | *Eucalyptus globulus* subsp. *globulus* | AF086642 | | 1.00E−59 |
| 122 | G627 | *Petunia* x *hybrida* | AF335239 | | 1.00E−58 |
| 122 | G627 | *Pimpinella brachycarpa* | AF082531 | | 1.00E−58 |
| 122 | G627 | *Populus tremula* x *Populus tremuloides* | BU896825 | | 3.00E−58 |
| 122 | G627 | *Cardamine flexuosa* | AY257542 | | 2.00E−57 |
| 122 | G627 | *Nicotiana tabacum* | NTTOB | | 3.00E−57 |
| 122 | G627 | *Sinapis alba* | SAU25696 | | 4.00E−57 |
| 122 | G627 | *Brassica rapa* subsp. *pekinensis* | AY257541 | | 7.00E−57 |
| 122 | G627 | *Oryza sativa* | AF141965 | | 3.00E−55 |
| 122 | G627 | *Populus tremuloides* | gi31295609 | | 1.00E−59 |
| 122 | G627 | *Eucalyptus globulus* subsp. *globulus* | gi4322475 | | 2.70E−59 |
| 122 | G627 | *Pimpinella brachycarpa* | gi3493647 | | 8.20E−58 |
| 122 | G627 | *Petunia* x *hybrida* | gi13384056 | | 1.00E−57 |
| 122 | G627 | *Sinapis alba* | gi1049022 | | 2.50E−56 |
| 122 | G627 | *Nicotiana tabacum* | gi1076646 | | 2.50E−56 |
| 122 | G627 | *Cardamine flexuosa* | gi30171309 | | 2.50E−56 |
| 122 | G627 | *Brassica rapa* subsp. *pekinensis* | gi30171307 | | 3.20E−56 |
| 122 | G627 | *Elaeis guineensis* | gi6635740 | | 2.00E−54 |
| 122 | G627 | *Oryza sativa* | gi5295990 | | 5.30E−54 |
| 161 | G975 | *Glycine max* | AW705973.1 | 902 | |
| 161 | G975 | *Glycine max* | BE610471.1 | 903 | |
| 161 | G975 | *Glycine max* | GLYMA-28NOV01-CLUSTER232634_1 | 904 | |
| 161 | G975 | *Glycine max* | GLYMA-28NOV01-CLUSTER8245_1 | 905 | |
| 161 | G975 | *Glycine max* | GLYMA-28NOV01-CLUSTER84865_1 | 906 | |
| 161 | G975 | *Oryza sativa* | ORYSA-22JAN02-CLUSTER256875_1 | 907 | |
| 161 | G975 | *Oryza sativa* | OSC33871.C1.p4.fg | 908 | |
| 161 | G975 | *Oryza sativa* | rsicek_16488.y1.abd | 909 | |
| 161 | G975 | *Zea mays* | BG874224.1 | 910 | |
| 161 | G975 | *Zea mays* | ZEAMA-08NOV01-CLUSTER277338_1 | 911 | |
| 161 | G975 | *Hordeum vulgare* | Hv_S31912 | 1733 | |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 161 | G975 | *Lycopersicon esculentum* | SGN-UNIGENE-52816 | 2003 | |
| 161 | G975 | *Lycopersicon esculentum* | SGN-UNIGENE-SINGLET-14957 | 2004 | |
| 161 | G975 | *Lycopersicon esculentum* | SGN-UNIGENE-SINGLET-330976 | 2005 | |
| 161 | G975 | *Lycopersicon esculentum* | SGN-UNIGENE-SINGLET-335836 | 2006 | |
| 162 | G975 | *Brassica napus* | CD838135 | | 2.00E−91 |
| 162 | G975 | *Brassica oleracea* | BH477624 | | 2.00E−69 |
| 162 | G975 | *Triticum aestivum* | CA486875 | | 4.00E−64 |
| 162 | G975 | *Oryza sativa* (*japonica* cultivar-group) | AK061163 | | 3.00E−62 |
| 162 | G975 | *Oryza sativa* | AX699685 | | 2.00E−61 |
| 162 | G975 | *Rosa chinensis* | BI978981 | | 3.00E−60 |
| 162 | G975 | *Amborella trichopoda* | CD484088 | | 3.00E−59 |
| 162 | G975 | *Hordeum vulgare* subsp. *vulgare* | BU978490 | | 2.00E−58 |
| 162 | G975 | *Vitis aestivalis* | CB289393 | | 7.00E−58 |
| 162 | G975 | *Lycopersicon esculentum* | BG642554 | | 1.00E−56 |
| 162 | G975 | *Oryza sativa* (*japonica* cultivar-group) | gi32479658 | | 2.20E−30 |
| 162 | G975 | *Lycopersicon esculentum* | gi18650662 | | 2.20E−25 |
| 162 | G975 | *Lupinus polyphyllus* | gi131754 | | 2.60E−22 |
| 162 | G975 | *Nicotiana tabacum* | gi3065895 | | 1.10E−19 |
| 162 | G975 | *Atriplex hortensis* | gi8571476 | | 1.10E−19 |
| 162 | G975 | *Zea mays* | gi21908036 | | 1.00E−18 |
| 162 | G975 | *Stylosanthes hamata* | gi4099914 | | 1.30E−18 |
| 162 | G975 | *Hordeum vulgare* | gi27960757 | | 1.70E−18 |
| 162 | G975 | *Oryza sativa* | gi10567106 | | 2.00E−18 |
| 162 | G975 | *Nicotiana sylvestris* | gi8809573 | | 1.20E−17 |
| 163 | G1011 | *Glycine max* | GLYMA-28NOV01-CLUSTER36089_1 | 912 | |
| 163 | G1011 | *Glycine max* | GLYMA-28NOV01-CLUSTER36089_2 | 913 | |
| 163 | G1011 | *Glycine max* | GLYMA-28NOV01-CLUSTER36089_3 | 914 | |
| 163 | G1011 | *Glycine max* | GLYMA-28NOV01-CLUSTER36089_4 | 915 | |
| 163 | G1011 | *Glycine max* | GLYMA-28NOV01-CLUSTER36089_6 | 916 | |
| 163 | G1011 | *Glycine max* | GLYMA-28NOV01-CLUSTER475715_2 | 917 | |
| 163 | G1011 | *Oryza sativa* | ORYSA-22JAN02-CLUSTER475_3 | 918 | |
| 163 | G1011 | *Oryza sativa* | OSC101782.C1.p2.fg | 919 | |
| 163 | G1011 | *Zea mays* | ZEAMA-08NOV01-CLUSTER48_1 | 920 | |
| 163 | G1011 | *Zea mays* | ZEAMA-08NOV01-CLUSTER48_2 | 921 | |
| 163 | G1011 | *Zea mays* | ZEAMA-08NOV01-CLUSTER48_4 | 922 | |
| 163 | G1011 | *Zea mays* | ZEAMA-08NOV01-CLUSTER48_5 | 923 | |
| 163 | G1011 | *Zea mays* | ZEAMA-08NOV01-CLUSTER8143_1 | 924 | |
| 163 | G1011 | *Oryza sativa* | Os_S60918 | 1581 | |
| 163 | G1011 | *Glycine max* | Gma_S5094568 | 1651 | |
| 163 | G1011 | *Medicago truncatula* | Mtr_S5357829 | 1696 | |
| 163 | G1011 | *Zea mays* | Zm_S11418746 | 1786 | |
| 163 | G1011 | *Zea mays* | Zm_S11527819 | 1787 | |
| 163 | G1011 | *Triticum aestivum* | Ta_S203038 | 1858 | |
| 163 | G1011 | *Triticum aestivum* | Ta_S304256 | 1859 | |
| 163 | G1011 | *Triticum aestivum* | Ta_S424724 | 1860 | |
| 163 | G1011 | *Lycopersicon esculentum* | Les_S5295933 | 1929 | |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 163 | G1011 | *Lycopersicon esculentum* | SGN-UNIGENE-50586 | 2007 | |
| 163 | G1011 | *Lycopersicon esculentum* | SGN-UNIGENE-52410 | 2008 | |
| 163 | G1011 | *Lycopersicon esculentum* | SGN-UNIGENE-SINGLET-366830 | 2009 | |
| 163 | G1011 | *Lycopersicon esculentum* | SGN-UNIGENE-SINGLET-394847 | 2010 | |
| 164 | G1011 | *Petunia* x *hybrida* | AF335240 | | 1.00E−58 |
| 164 | G1011 | *Sinapis alba* | SAU25696 | | 5.00E−58 |
| 164 | G1011 | *Brassica rapa* subsp. *pekinensis* | AY257541 | | 1.00E−57 |
| 164 | G1011 | *Lycopersicon esculentum* | AI486684 | | 1.00E−57 |
| 164 | G1011 | *Cardamine flexuosa* | AY257542 | | 2.00E−57 |
| 164 | G1011 | *Vitis vinifera* | CA808988 | | 3.00E−57 |
| 164 | G1011 | *Populus tremuloides* | AF377868 | | 9.00E−57 |
| 164 | G1011 | *Pimpinella brachycarpa* | AF082531 | | 8.00E−56 |
| 164 | G1011 | *Eucalyptus grandis* | AY263808 | | 2.00E−55 |
| 164 | G1011 | *Draba nemorosa* var. *hebecarpa* | AY257543 | | 8.00E−55 |
| 164 | G1011 | *Petunia* x *hybrida* | gi13384058 | | 3.90E−58 |
| 164 | G1011 | *Sinapis alba* | gi1049022 | | 4.50E−57 |
| 164 | G1011 | *Brassica rapa* subsp. *pekinensis* | gi30171307 | | 5.70E−57 |
| 164 | G1011 | *Cardamine flexuosa* | gi30171309 | | 1.90E−56 |
| 164 | G1011 | *Populus tremuloides* | gi31295609 | | 1.40E−55 |
| 164 | G1011 | *Pimpinella brachycarpa* | gi3493647 | | 7.60E−55 |
| 164 | G1011 | *Nicotiana tabacum* | gi1076646 | | 1.60E−54 |
| 164 | G1011 | *Eucalyptus grandis* | gi30575600 | | 1.60E−54 |
| 164 | G1011 | *Draba nemorosa* var. *hebecarpa* | gi30171311 | | 1.10E−53 |
| 164 | G1011 | *Eucalyptus occidentalis* | gi30983946 | | 1.10E−53 |
| 178 | G1108 | *Oryza sativa* (*japonica* cultivar-group) | AK066424 | | 1.00E−113 |
| 178 | G1108 | *Zea mays* | BG837939 | | 1.00E−91 |
| 178 | G1108 | *Brassica oleracea* | BZ486328 | | 1.00E−89 |
| 178 | G1108 | *Lactuca sativa* | BQ852089 | | 3.00E−80 |
| 178 | G1108 | *Triticum aestivum* | BJ319065 | | 2.00E−78 |
| 178 | G1108 | *Oryza sativa* (*indica* cultivar-group) | CB634885 | | 5.00E−78 |
| 178 | G1108 | *Lycopersicon esculentum* | BI921710 | | 1.00E−75 |
| 178 | G1108 | *Oryza sativa* | AX699700 | | 1.00E−73 |
| 178 | G1108 | *Hordeum vulgare* subsp. *vulgare* | AL505242 | | 8.00E−71 |
| 178 | G1108 | *Solanum tuberosum* | BQ512426 | | 6.00E−69 |
| 178 | G1108 | *Oryza sativa* (*japonica* cultivar-group) | gi15289774 | | 6.00E−78 |
| 178 | G1108 | *Phacelia tanacetifolia* | gi5002214 | | 1.40E−28 |
| 178 | G1108 | *Medicago sativa* | gi23451086 | | 5.10E−12 |
| 178 | G1108 | *Oryza sativa* | gi14164470 | | 1.10E−11 |
| 178 | G1108 | *Cicer arietinum* | gi4651204 | | 2.60E−10 |
| 178 | G1108 | *Nicotiana tabacum* | gi12003386 | | 1.40E−09 |
| 178 | G1108 | *Thellungiella halophila* | gi20340241 | | 1.50E−09 |
| 178 | G1108 | *Hordeum vulgare* | gi2894379 | | 2.80E−09 |
| 178 | G1108 | *Cucumis melo* | gi17016985 | | 2.30E−08 |
| 178 | G1108 | *Hordeum vulgare* subsp. *vulgare* | gi20152976 | | 3.10E−08 |
| 193 | G1274 | *Glycine max* | GLYMA-28NOV01-CLUSTER16030_1 | 968 | |
| 193 | G1274 | *Glycine max* | GLYMA-28NOV01-CLUSTER305171_1 | 969 | |
| 193 | G1274 | *Oryza sativa* | OSC100386.C1.p11.fg | 970 | |
| 193 | G1274 | *Oryza sativa* | OSC100526.C1.p1.fg | 971 | |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 193 | G1274 | *Zea mays* | ZEAMA-08NOV01-CLUSTER139642_1 | 972 | |
| 193 | G1274 | *Zea mays* | ZEAMA-08NOV01-CLUSTER139642_2 | 973 | |
| 193 | G1274 | *Zea mays* | ZEAMA-08NOV01-CLUSTER2967_14 | 974 | |
| 193 | G1274 | *Zea mays* | ZEAMA-08NOV01-CLUSTER452657_1 | 975 | |
| 193 | G1274 | *Lycopersicon esculentum* | SGN-UNIGENE-51404 | 2017 | |
| 193 | G1274 | *Lycopersicon esculentum* | SGN-UNIGENE-57064 | 2018 | |
| 194 | G1274 | *Glycine max* | BQ742659 | | 1.00E−33 |
| 194 | G1274 | *Solanum tuberosum* | BQ516647 | | 2.00E−32 |
| 194 | G1274 | *Lycopersicon esculentum* | BI209002 | | 2.00E−32 |
| 194 | G1274 | *Hordeum vulgare* | BE216050 | | 4.00E−31 |
| 194 | G1274 | *Capsicum annuum* | CA524920 | | 2.00E−30 |
| 194 | G1274 | *Stevia rebaudiana* | BG525040 | | 3.00E−30 |
| 194 | G1274 | *Sorghum bicolor* | CD233113 | | 3.00E−29 |
| 194 | G1274 | *Zea mays* | BM334368 | | 2.00E−28 |
| 194 | G1274 | *Hordeum vulgare* subsp. *spontaneum* | BJ478103 | | 3.00E−28 |
| 194 | G1274 | *Hordeum vulgare* subsp. *vulgare* | BJ456908 | | 3.00E−28 |
| 194 | G1274 | *Oryza sativa* | gi9558431 | | 1.10E−28 |
| 194 | G1274 | *Oryza sativa* (*japonica* cultivar-group) | gi21104763 | | 4.90E−28 |
| 194 | G1274 | *Nicotiana tabacum* | gi29536791 | | 6.00E−23 |
| 194 | G1274 | *Capsella rubella* | gi32454266 | | 1.70E−22 |
| 194 | G1274 | *Solanum tuberosum* | gi24745606 | | 8.70E−22 |
| 194 | G1274 | *Oryza sativa* (*indica* cultivar-group) | gi23305051 | | 1.40E−21 |
| 194 | G1274 | *Pimpinella brachycarpa* | gi3420906 | | 1.70E−21 |
| 194 | G1274 | *Lycopersicon esculentum* | gi13620227 | | 3.90E−21 |
| 194 | G1274 | *Cucumis sativus* | gi7484759 | | 5.70E−21 |
| 194 | G1274 | *Ipomoea batatas* | gi1076685 | | 7.00E−21 |
| 207 | G1357 | *Glycine max* | GLYMA-28NOV01-CLUSTER80398_1 | 982 | |
| 207 | G1357 | *Lycopersicon esculentum* | SGN-UNIGENE-52387 | 2020 | |
| 208 | G1357 | *Brassica oleracea* | BH590226 | | 3.00E−94 |
| 208 | G1357 | *Medicago truncatula* | BF645605 | | 5.00E−59 |
| 208 | G1357 | *Sorghum bicolor* | BI140703 | | 8.00E−44 |
| 208 | G1357 | *Hordeum vulgare* subsp. *spontaneum* | BJ481205 | | 8.00E−44 |
| 208 | G1357 | *Hordeum vulgare* subsp. *vulgare* | BU967516 | | 8.00E−44 |
| 208 | G1357 | *Hordeum vulgare* | BQ469035 | | 8.00E−44 |
| 208 | G1357 | *Petunia* x *hybrida* | AF509874 | | 9.00E−42 |
| 208 | G1357 | *Triticum aestivum* | BJ257015 | | 9.00E−42 |
| 208 | G1357 | *Oryza sativa* | AX654515 | | 3.00E−41 |
| 208 | G1357 | *Oryza sativa* (*japonica* cultivar-group) | AK099540 | | 5.00E−41 |
| 208 | G1357 | *Oryza sativa* (*japonica* cultivar-group) | gi19225018 | | 1.50E−42 |
| 208 | G1357 | *Petunia* x *hybrida* | gi21105751 | | 2.40E−42 |
| 208 | G1357 | *Medicago truncatula* | gi7716952 | | 7.20E−42 |
| 208 | G1357 | *Oryza sativa* | gi6730946 | | 3.50E−41 |
| 208 | G1357 | *Glycine max* | gi22597158 | | 1.10E−37 |
| 208 | G1357 | *Brassica napus* | gi31322582 | | 4.30E−36 |
| 208 | G1357 | *Phaseolus vulgaris* | gi15148914 | | 7.00E−36 |
| 208 | G1357 | *Lycopersicon esculentum* | gi6175246 | | 2.20E−32 |
| 208 | G1357 | *Triticum* sp. | gi4218537 | | 2.80E−32 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 208 | G1357 | *Triticum monococcum* | gi6732160 | | 2.80E−32 |
| 225 | G1452 | *Glycine max* | GLYMA-28NOV01-CLUSTER80398_1 | 982 | |
| 225 | G1452 | *Lycopersicon esculentum* | SGN-UNIGENE-52387 | 2020 | |
| 226 | G1452 | *Medicago truncatula* | BF645605 | | 5.00E−65 |
| 226 | G1452 | *Sorghum bicolor* | BI140703 | | 7.00E−43 |
| 226 | G1452 | *Hordeum vulgare* | BQ469035 | | 1.00E−42 |
| 226 | G1452 | *Hordeum vulgare* subsp. *vulgare* | BU967516 | | 1.00E−42 |
| 226 | G1452 | *Hordeum vulgare* subsp. *spontaneum* | BJ481205 | | 1.00E−42 |
| 226 | G1452 | *Triticum aestivum* | BQ620568 | | 3.00E−42 |
| 226 | G1452 | *Oryza sativa* (*indica* cultivar-group) | CB630990 | | 3.00E−42 |
| 226 | G1452 | *Oryza sativa* | AX654172 | | 8.00E−42 |
| 226 | G1452 | *Oryza sativa* (*japonica* cultivar-group) | CB657109 | | 1.00E−41 |
| 226 | G1452 | *Lactuca sativa* | BQ997138 | | 4.00E−41 |
| 226 | G1452 | *Oryza sativa* | gi6730946 | | 1.30E−44 |
| 226 | G1452 | *Petunia* x *hybrida* | gi21105746 | | 1.20E−41 |
| 226 | G1452 | *Oryza sativa* (*japonica* cultivar-group) | gi27452910 | | 5.10E−41 |
| 226 | G1452 | *Medicago truncatula* | gi7716952 | | 5.80E−41 |
| 226 | G1452 | *Glycine max* | gi22597158 | | 5.30E−38 |
| 226 | G1452 | *Phaseolus vulgaris* | gi15148914 | | 7.00E−36 |
| 226 | G1452 | *Brassica napus* | gi31322578 | | 2.30E−35 |
| 226 | G1452 | *Triticum* sp. | gi4218537 | | 3.90E−35 |
| 226 | G1452 | *Triticum monococcum* | gi6732160 | | 3.90E−35 |
| 226 | G1452 | *Lycopersicon esculentum* | gi6175246 | | 7.20E−34 |
| 233 | G1482 | *Glycine max* | GLYMA-28NOV01-CLUSTER228559_1 | 1014 | |
| 233 | G1482 | *Glycine max* | GLYMA-28NOV01-CLUSTER228559_2 | 1015 | |
| 233 | G1482 | *Glycine max* | GLYMA-28NOV01-CLUSTER38097_1 | 1016 | |
| 233 | G1482 | *Glycine max* | GLYMA-28NOV01-CLUSTER39971_1 | 1017 | |
| 233 | G1482 | *Glycine max* | GLYMA-28NOV01-CLUSTER39971_2 | 1018 | |
| 233 | G1482 | *Oryza sativa* | ORYSA-22JAN02-CLUSTER17570_1 | 1019 | |
| 233 | G1482 | *Oryza sativa* | ORYSA-22JAN02-CLUSTER17570_2 | 1020 | |
| 233 | G1482 | *Oryza sativa* | ORYSA-22JAN02-CLUSTER687_1 | 1021 | |
| 233 | G1482 | *Oryza sativa* | ORYSA-22JAN02-CLUSTER99743_1 | 1022 | |
| 233 | G1482 | *Oryza sativa* | OSC101266.C1.p1.fg | 1023 | |
| 233 | G1482 | *Oryza sativa* | OSC15654.C1.p3.fg | 1024 | |
| 233 | G1482 | *Zea mays* | 15631093 | 1025 | |
| 233 | G1482 | *Zea mays* | ZEAMA-08NOV01-CLUSTER35072_1 | 1026 | |
| 233 | G1482 | *Zea mays* | ZEAMA-08NOV01-CLUSTER35072_2 | 1027 | |
| 233 | G1482 | *Zea mays* | ZEAMA-08NOV01-CLUSTER366705_1 | 1028 | |
| 233 | G1482 | *Zea mays* | ZEAMA-08NOV01-CLUSTER439033_1 | 1029 | |
| 233 | G1482 | *Zea mays* | ZEAMA-08NOV01-CLUSTER439033_2 | 1030 | |
| 233 | G1482 | *Oryza sativa* | Os_S60490 | 1592 | |
| 233 | G1482 | *Medicago truncatula* | Mtr_S10820905 | 1703 | |
| 233 | G1482 | *Zea mays* | Zm_S11432778 | 1802 | |
| 233 | G1482 | *Triticum aestivum* | Ta_S288030 | 1879 | |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 233 | G1482 | *Lycopersicon esculentum* | SGN-UNIGENE-47593 | 2032 | |
| 234 | G1482 | *Solanum tuberosum* | BM406201 | | 1.00E−60 |
| 234 | G1482 | *Medicago truncatula* | CB894280 | | 2.00E−57 |
| 234 | G1482 | *Robinia pseudoacacia* | BI678186 | | 1.00E−52 |
| 234 | G1482 | *Glycine max* | BM954087 | | 6.00E−52 |
| 234 | G1482 | *Lotus japonicus* | BI420251 | | 1.00E−48 |
| 234 | G1482 | *Zinnia elegans* | AU288043 | | 2.00E−45 |
| 234 | G1482 | *Populus tremula* | BU892726 | | 2.00E−45 |
| 234 | G1482 | *Lycopersicon esculentum* | BM409788 | | 2.00E−44 |
| 234 | G1482 | *Oryza sativa* (*japonica* cultivar-group) | AK071507 | | 1.00E−43 |
| 234 | G1482 | *Oryza sativa* | AB001884 | | 5.00E−43 |
| 234 | G1482 | *Oryza sativa* | gi3618312 | | 1.90E−45 |
| 234 | G1482 | *Oryza sativa* (*japonica* cultivar-group) | gi32488104 | | 2.00E−38 |
| 234 | G1482 | *Brassica nigra* | gi11037311 | | 4.90E−18 |
| 234 | G1482 | *Raphanus sativus* | gi3341723 | | 8.00E−17 |
| 234 | G1482 | *Brassica napus* | gi30984027 | | 2.70E−15 |
| 234 | G1482 | *Malus* x *domestica* | gi4091806 | | 7.40E−15 |
| 234 | G1482 | *Ipomoea nil* | gi10946337 | | 2.00E−14 |
| 234 | G1482 | *Hordeum vulgare* | gi21667485 | | 2.90E−13 |
| 234 | G1482 | *Hordeum vulgare* subsp. *vulgare* | gi21655154 | | 1.50E−11 |
| 234 | G1482 | *Pinus radiata* | gi4557093 | | 3.10E−10 |
| 238 | G1493 | *Medicago truncatula* | CB891281 | | 9.00E−98 |
| 238 | G1493 | *Zea mays* | AB060130 | | 5.00E−95 |
| 238 | G1493 | *Brassica napus* | CD825309 | | 7.00E−84 |
| 238 | G1493 | *Vitis vinifera* | CD800109 | | 9.00E−84 |
| 238 | G1493 | *Oryza sativa* (*japonica* cultivar-group) | AK100530 | | 7.00E−81 |
| 238 | G1493 | *Oryza sativa* (*indica* cultivar-group) | CB630542 | | 3.00E−77 |
| 238 | G1493 | *Brassica oleracea* | BH687265 | | 2.00E−74 |
| 238 | G1493 | *Glycine max* | AW596288 | | 4.00E−70 |
| 238 | G1493 | *Poncirus trifoliata* | CD574729 | | 6.00E−69 |
| 238 | G1493 | *Lactuca sativa* | BQ858556 | | 1.00E−66 |
| 238 | G1493 | *Zea mays* | gi13661174 | | 1.00E−84 |
| 238 | G1493 | *Oryza sativa* (*japonica* cultivar-group) | gi24308616 | | 9.20E−82 |
| 238 | G1493 | *Oryza sativa* (*indica* cultivar-group) | gi31338860 | | 2.20E−42 |
| 238 | G1493 | *Oryza glaberrima* | gi31338862 | | 2.20E−42 |
| 238 | G1493 | *Oryza sativa* | gi15289981 | | 9.60E−19 |
| 238 | G1493 | *Solanum bulbocastanum* | gi32470629 | | 1.00E−10 |
| 238 | G1493 | *Chlamydomonas reinhardtii* | gi5916207 | | 1.20E−09 |
| 238 | G1493 | *Mesembryanthemum crystallinum* | gi6942190 | | 8.00E−09 |
| 238 | G1493 | *Nicotiana tabacum* | gi4519671 | | 2.50E−08 |
| 238 | G1493 | *Dianthus caryophyllus* | gi13173408 | | 1.40E−07 |
| 241 | G1510 | *Oryza sativa* | ORYSA-22JAN02-CLUSTER159728_1 | 1031 | |
| 241 | G1510 | *Oryza sativa* | OSC101036.C1.p2.fg | 1032 | |
| 241 | G1510 | *Glycine max* | Gma_S5061040 | 1662 | |
| 241 | G1510 | *Triticum aestivum* | Ta_S206702 | 1880 | |
| 241 | G1510 | *Lycopersicon esculentum* | Les_S5271097 | 1932 | |
| 241 | G1510 | *Lycopersicon esculentum* | SGN-UNIGENE-56179 | 2033 | |
| 242 | G1510 | *Brassica oleracea* | BZ493938 | | 8.00E−58 |
| 242 | G1510 | *Brassica napus* | CB686317 | | 3.00E−31 |
| 242 | G1510 | *Vitis vinifera* | BM437179 | | 5.00E−23 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 242 | G1510 | *Glycine max* | BF425622 | | 5.00E−23 |
| 242 | G1510 | *Oryza sativa* (*japonica* cultivar-group) | AK099607 | | 7.00E−23 |
| 242 | G1510 | *Sorghum bicolor* | CD213245 | | 9.00E−20 |
| 242 | G1510 | *Medicago truncatula* | BQ165696 | | 2.00E−18 |
| 242 | G1510 | *Populus tremula* x *Populus tremuloides* | BU863159 | | 5.00E−18 |
| 242 | G1510 | *Triticum aestivum* | AL816777 | | 4.00E−17 |
| 242 | G1510 | *Oryza sativa* | AC087597 | | 3.00E−15 |
| 242 | G1510 | *Oryza sativa* (*japonica* cultivar-group) | gi28372691 | | 7.00E−19 |
| 242 | G1510 | *Oryza sativa* | gi14165317 | | 5.10E−10 |
| 242 | G1510 | *Nicotiana tabacum* | gi12711287 | | 3.70E−07 |
| 242 | G1510 | *Nicotiana plumbaginifolia* | gi1076609 | | 4.20E−05 |
| 242 | G1510 | *Fagopyrum* sp. C97107 | gi31088153 | | 0.013 |
| 242 | G1510 | *Fagopyrum rubifolium* | gi31088139 | | 0.016 |
| 242 | G1510 | *Fagopyrum gracilipes* | gi31088119 | | 0.032 |
| 242 | G1510 | *Fagopyrum* sp. C97106 | gi31088151 | | 0.032 |
| 242 | G1510 | *Fagopyrum capillatum* | gi31088129 | | 0.032 |
| 242 | G1510 | *Fagopyrum callianthum* | gi31088131 | | 0.04 |
| 263 | G1660 | *Glycine max* | GLYMA-28NOV01-CLUSTER30666_1 | 1036 | |
| 263 | G1660 | *Glycine max* | uC-gmflLIB3275P059b07b1 | 1037 | |
| 263 | G1660 | *Oryza sativa* | ORYSA-22JAN02-CLUSTER6548_1 | 1038 | |
| 263 | G1660 | *Oryza sativa* | ORYSA-22JAN02-CLUSTER93242_1 | 1039 | |
| 263 | G1660 | *Oryza sativa* | OSC100113.C1.p9.fg | 1040 | |
| 263 | G1660 | *Oryza sativa* | OSC101572.C1.p8.fg | 1041 | |
| 263 | G1660 | *Oryza sativa* | OSC34319.C1.p4.fg | 1042 | |
| 263 | G1660 | *Zea mays* | 700167489_FLI | 1043 | |
| 263 | G1660 | *Zea mays* | LIB3279-010-H4_FLI | 1044 | |
| 263 | G1660 | *Zea mays* | LIB4767-001-R1-M1-D1 | 1045 | |
| 263 | G1660 | *Zea mays* | ZEAMA-08NOV01-CLUSTER43109_1 | 1046 | |
| 263 | G1660 | *Zea mays* | ZEAMA-08NOV01-CLUSTER64649_1 | 1047 | |
| 263 | G1660 | *Oryza sativa* | Os_S94670 | 1593 | |
| 263 | G1660 | *Zea mays* | Zm_S11454293 | 1803 | |
| 263 | G1660 | *Zea mays* | Zm_S11520265 | 1804 | |
| 263 | G1660 | *Triticum aestivum* | Ta_S142271 | 1881 | |
| 263 | G1660 | *Lycopersicon esculentum* | SGN-UNIGENE-SINGLET-35095 | 2034 | |
| 263 | G1660 | *Lycopersicon esculentum* | SGN-UNIGENE-SINGLET-53090 | 2035 | |
| 264 | G1660 | *Oryza sativa* (*japonica* cultivar-group) | AK102604 | | 1.00E−109 |
| 264 | G1660 | *Brassica oleracea* | BZ431607 | | 1.00E−108 |
| 264 | G1660 | *Brassica napus* | CD818917 | | 2.00E−95 |
| 264 | G1660 | *Oryza sativa* | BE040229 | | 2.00E−62 |
| 264 | G1660 | *Ipomoea nil* | BJ576287 | | 1.00E−54 |
| 264 | G1660 | *Lycopersicon esculentum* | AW443990 | | 7.00E−54 |
| 264 | G1660 | *Oryza sativa* (*indica* cultivar-group) | AAAA01001098 | | 2.00E−52 |
| 264 | G1660 | *Zea mays* | CB886289 | | 3.00E−50 |
| 264 | G1660 | *Hordeum vulgare* | BM377843 | | 3.00E−50 |
| 264 | G1660 | *Triticum aestivum* | BJ238027 | | 6.00E−47 |
| 264 | G1660 | *Oryza sativa* (*japonica* cultivar-group) | gi27452912 | | 7.70E−62 |
| 264 | G1660 | *Zea mays* | gi23928441 | | 3.30E−22 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 264 | G1660 | *Solanum tuberosum* | gi1881585 | | 1.60E−17 |
| 264 | G1660 | *Lycopersicon esculentum* | gi4731573 | | 1.20E−16 |
| 264 | G1660 | *Nicotiana tabacum* | gi8096269 | | 0.0017 |
| 264 | G1660 | *Cucurbita maxima* | gi17221648 | | 0.002 |
| 264 | G1660 | *Cicer arietinum* | gi7208779 | | 0.0026 |
| 264 | G1660 | *Oryza sativa* | gi11875196 | | 0.006 |
| 264 | G1660 | *Plastid Oenothera elata* subsp. *hookeri* | gi13276714 | | 0.0063 |
| 264 | G1660 | *Oenothera elata* subsp. *hookeri* | gi23822375 | | 0.0063 |
| 267 | G1730 | *Zea mays* | LIB5074-010-R1-XP1-A11 | 1048 | |
| 268 | G1730 | *Brassica oleracea* | BZ472679 | | 6.00E−67 |
| 268 | G1730 | *Medicago truncatula* | AC126787 | | 1.00E−27 |
| 268 | G1730 | *Brassica napus* | CD814199 | | 4.00E−27 |
| 268 | G1730 | *Zea mays* | BZ715596 | | 4.00E−21 |
| 268 | G1730 | *Oryza sativa* (*japonica* cultivar-group) | AK108491 | | 5.00E−21 |
| 268 | G1730 | *Oryza sativa* (*indica* cultivar-group) | AAAA01009602 | | 7.00E−21 |
| 268 | G1730 | *Oryza sativa* | AX653298 | | 1.00E−18 |
| 268 | G1730 | *Cucumis melo* | AF499727 | | 2.00E−18 |
| 268 | G1730 | *Solanum tuberosum* | BG593372 | | 5.00E−18 |
| 268 | G1730 | *Lycopersicon esculentum* | AW032769 | | 2.00E−17 |
| 268 | G1730 | *Cucumis melo* | gi28558782 | | 6.70E−23 |
| 268 | G1730 | *Oryza sativa* | gi12643047 | | 1.90E−19 |
| 268 | G1730 | *Oryza sativa* (*japonica* cultivar-group) | gi31433649 | | 1.90E−19 |
| 268 | G1730 | *Nicotiana tabacum* | gi12003386 | | 5.10E−17 |
| 268 | G1730 | *Zea mays* | gi21645888 | | 1.40E−16 |
| 268 | G1730 | *Medicago sativa* | gi23451086 | | 1.30E−14 |
| 268 | G1730 | *Hordeum vulgare* subsp. *vulgare* | gi20152976 | | 5.70E−14 |
| 268 | G1730 | *Hordeum vulgare* | gi2894379 | | 1.10E−09 |
| 268 | G1730 | *Oryza sativa* (*indica* cultivar-group) | gi29164825 | | 4.10E−09 |
| 268 | G1730 | *Thellungiella halophila* | gi20340241 | | 1.10E−08 |
| 275 | G1779 | *Glycine max* | GLYMA-28NOV01-CLUSTER185518_1 | 1051 | |
| 275 | G1779 | *Glycine max* | GLYMA-28NOV01-CLUSTER264928_1 | 1052 | |
| 275 | G1779 | *Glycine max* | GLYMA-28NOV01-CLUSTER76652_1 | 1053 | |
| 275 | G1779 | *Oryza sativa* | OSC21832.C1.p4.fg | 1054 | |
| 275 | G1779 | *Zea mays* | ZEAMA-08NOV01-CLUSTER78309_1 | 1055 | |
| 275 | G1779 | *Lycopersicon esculentum* | SGN-UNIGENE-SINGLET-56681 | 2036 | |
| 276 | G1779 | *Brassica oleracea* | BH558232 | | 3.00E−36 |
| 276 | G1779 | *Vitis vinifera* | BM437179 | | 2.00E−26 |
| 276 | G1779 | *Glycine max* | BF425622 | | 1.00E−24 |
| 276 | G1779 | *Oryza sativa* (*japonica* cultivar-group) | AK099607 | | 5.00E−21 |
| 276 | G1779 | *Sorghum bicolor* | CD213245 | | 3.00E−20 |
| 276 | G1779 | *Medicago truncatula* | BQ165696 | | 2.00E−19 |
| 276 | G1779 | *Populus tremula* × *Populus tremuloides* | BU863159 | | 2.00E−18 |
| 276 | G1779 | *Brassica napus* | CB686317 | | 9.00E−18 |
| 276 | G1779 | *Poncirus trifoliata* | CD576018 | | 3.00E−17 |
| 276 | G1779 | *Triticum aestivum* | AL816777 | | 2.00E−16 |
| 276 | G1779 | *Oryza sativa* (*japonica* cultivar-group) | gi28564714 | | 1.20E−20 |
| 276 | G1779 | *Oryza sativa* | gi5091599 | | 2.80E−08 |
| 276 | G1779 | *Nicotiana tabacum* | gi12711287 | | 2.90E−07 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 276 | G1779 | *Nicotiana plumbaginifolia* | gi1076609 | | 3.50E−05 |
| 276 | G1779 | *Lycopersicon esculentum* | gi1418988 | | 0.36 |
| 276 | G1779 | *Eutrema wasabi* | gi23200602 | | 0.55 |
| 276 | G1779 | *Amicia glandulosa* | gi30313971 | | 0.62 |
| 276 | G1779 | *Ipomoea batatas* | gi604324 | | 0.8 |
| 276 | G1779 | *Triticum aestivum* | gi23451222 | | 1 |
| 276 | G1779 | *Gnetum gnemon* | gi31746346 | | 1 |
| 277 | G1792 | *Oryza sativa* | G3380 | 2124 | 5.00E−29 |
| 277 | G1792 | *Oryza sativa* | G3383 | 2128 | 3.00E−33 |
| 277 | G1792 | *Oryza sativa* | G3515 | 2209 | 7.00E−30 |
| 277 | G1792 | *Zea mays* | G3516 | 2211 | 2.00E−31 |
| 277 | G1792 | *Zea mays* | G3517 | 2213 | 9.00E−33 |
| 277 | G1792 | *Glycine max* | G3518 | 2215 | 9.00E−35 |
| 277 | G1792 | *Glycine max* | G3519 | 2217 | 3.00E−35 |
| 277 | G1792 | *Glycine max* | G3520 | 2219 | 3.00E−36 |
| 277 | G1792 | *Glycine max* | AW308784.1 | 685 | |
| 277 | G1792 | *Glycine max* | BG790680.1 | 686 | |
| 277 | G1792 | *Glycine max* | GLYMA-28NOV01-CLUSTER602185_1 | 687 | |
| 277 | G1792 | *Glycine max* | GLYMA-28NOV01-CLUSTER91218_1 | 688 | |
| 277 | G1792 | *Glycine max* | LIB5118-009-Q1-PF1-F2 | 689 | |
| 277 | G1792 | *Oryza sativa* | OSC20174.C1.p2.fg | 690 | |
| 277 | G1792 | *Zea mays* | LIB4756-134-A1-K1-G10 | 691 | |
| 277 | G1792 | *Glycine max* | Gma_S5001644 | 1633 | |
| 277 | G1792 | *Zea mays* | Zm_S11513768 | 1754 | |
| 278 | G1792 | *Lycopersicon esculentum* | AI776626 | | 7.00E−35 |
| 278 | G1792 | *Solanum tuberosum* | BQ045702 | | 1.00E−32 |
| 278 | G1792 | *Glycine max* | BM178875 | | 9.00E−32 |
| 278 | G1792 | *Medicago truncatula* | BF649790 | | 2.00E−31 |
| 278 | G1792 | *Eucalyptus grandis* | CB967722 | | 1.00E−30 |
| 278 | G1792 | *Brassica oleracea* | BZ020356 | | 1.00E−30 |
| 278 | G1792 | *Oryza sativa* (indica cultivar-group) | AAAA01002491 | | 4.00E−30 |
| 278 | G1792 | *Oryza sativa* (japonica cultivar-group) | AE017099 | | 4.00E−30 |
| 278 | G1792 | *Oryza sativa* | AC025907 | | 4.00E−30 |
| 278 | G1792 | *Sorghum bicolor* | BZ337899 | | 4.00E−30 |
| 278 | G1792 | *Oryza sativa* (japonica cultivar-group) | gi31432356 | | 1.10E−30 |
| 278 | G1792 | *Lycopersicon esculentum* | gi23452024 | | 4.90E−26 |
| 278 | G1792 | *Nicotiana tabacum* | gi1732406 | | 2.60E−25 |
| 278 | G1792 | *Oryza sativa* | gi12597874 | | 4.50E−25 |
| 278 | G1792 | *Mesembryanthemum crystallinum* | gi32401273 | | 9.40E−25 |
| 278 | G1792 | *Catharanthus roseus* | gi8980313 | | 2.20E−23 |
| 278 | G1792 | *Nicotiana sylvestris* | gi8809571 | | 2.20E−23 |
| 278 | G1792 | *Matricaria chamomilla* | gi17385636 | | 1.40E−21 |
| 278 | G1792 | *Glycine max* | gi21304712 | | 3.80E−21 |
| 278 | G1792 | *Atriplex hortensis* | gi8571476 | | 1.30E−20 |
| 282 | G1797 | *Petunia* x *hybrida* | AF335240 | | 5.00E−52 |
| 282 | G1797 | *Lycopersicon esculentum* | AI486684 | | 7.00E−49 |
| 282 | G1797 | *Eucalyptus grandis* | AY263808 | | 8.00E−47 |
| 282 | G1797 | *Eucalyptus occidentalis* | AY273872 | | 7.00E−46 |
| 282 | G1797 | *Populus tremuloides* | CA925124 | | 8.00E−45 |
| 282 | G1797 | *Brassica rapa* subsp. *pekinensis* | AY257541 | | 5.00E−44 |
| 282 | G1797 | *Sinapis alba* | SAU25696 | | 5.00E−44 |
| 282 | G1797 | *Pimpinella brachycarpa* | AF082531 | | 5.00E−44 |
| 282 | G1797 | *Cardamine flexuosa* | AY257542 | | 2.00E−43 |
| 282 | G1797 | *Nicotiana tabacum* | NTTOB | | 5.00E−43 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 282 | G1797 | *Petunia* x *hybrida* | gi13384058 | | 4.40E−50 |
| 282 | G1797 | *Eucalyptus grandis* | gi30575600 | | 8.60E−47 |
| 282 | G1797 | *Eucalyptus occidentalis* | gi30983946 | | 6.00E−46 |
| 282 | G1797 | *Brassica rapa* subsp. *pekinensis* | gi30171307 | | 4.90E−44 |
| 282 | G1797 | *Populus tremuloides* | gi31295609 | | 4.90E−44 |
| 282 | G1797 | *Sinapis alba* | gi1049022 | | 1.60E−43 |
| 282 | G1797 | *Pimpinella brachycarpa* | gi3493647 | | 1.60E−43 |
| 282 | G1797 | *Cardamine flexuosa* | gi30171309 | | 2.70E−43 |
| 282 | G1797 | *Nicotiana tabacum* | gi1076646 | | 1.50E−42 |
| 282 | G1797 | *Draba nemorosa* var. *hebecarpa* | gi30171311 | | 1.00E−41 |
| 284 | G1798 | *Petunia* x *hybrida* | AF335240 | | 5.00E−53 |
| 284 | G1798 | *Lycopersicon esculentum* | AI486684 | | 3.00E−52 |
| 284 | G1798 | *Brassica rapa* subsp. *pekinensis* | AY257541 | | 3.00E−48 |
| 284 | G1798 | *Sinapis alba* | SAU25696 | | 3.00E−47 |
| 284 | G1798 | *Cardamine flexuosa* | AY257542 | | 5.00E−47 |
| 284 | G1798 | *Pimpinella brachycarpa* | AF082531 | | 5.00E−47 |
| 284 | G1798 | *Populus tremuloides* | CA925124 | | 1.00E−44 |
| 284 | G1798 | *Eucalyptus grandis* | AY263807 | | 1.00E−43 |
| 284 | G1798 | *Nicotiana tabacum* | NTTOB | | 1.00E−43 |
| 284 | G1798 | *Oryza sativa* (*japonica* cultivar-group) | AK104921 | | 5.00E−43 |
| 284 | G1798 | *Petunia* x *hybrida* | gi13384058 | | 1.30E−52 |
| 284 | G1798 | *Brassica rapa* subsp. *pekinensis* | gi30171307 | | 4.60E−48 |
| 284 | G1798 | *Sinapis alba* | gi1049022 | | 2.50E−47 |
| 284 | G1798 | *Cardamine flexuosa* | gi30171309 | | 1.40E−46 |
| 284 | G1798 | *Pimpinella brachycarpa* | gi3493647 | | 1.40E−46 |
| 284 | G1798 | *Populus tremuloides* | gi31295609 | | 2.30E−44 |
| 284 | G1798 | *Oryza sativa* | gi5295990 | | 6.20E−44 |
| 284 | G1798 | *Eucalyptus grandis* | gi30575598 | | 1.00E−43 |
| 284 | G1798 | *Zea mays* | gi12002139 | | 1.30E−43 |
| 284 | G1798 | *Nicotiana tabacum* | gi1076646 | | 5.60E−43 |
| 287 | G1816 | *Oryza sativa* | G3392 | 2131 | 2.00E−16 |
| 287 | G1816 | *Oryza sativa* | G3392 | 2133 | 2.00E−15 |
| 287 | G1816 | *Zea mays* | G3431 | 2147 | 1.00E−13 |
| 287 | G1816 | *Zea mays* | G3444 | 2157 | 1.00E−13 |
| 287 | G1816 | *Glycine max* | G3445 | 2159 | 5.00E−12 |
| 287 | G1816 | *Glycine max* | G3446 | 2161 | 5.00E−12 |
| 287 | G1816 | *Glycine max* | G3447 | 2163 | 5.00E−12 |
| 287 | G1816 | *Glycine max* | G3448 | 2165 | 1.00E−13 |
| 287 | G1816 | *Glycine max* | G3449 | 2167 | 3.00E−14 |
| 287 | G1816 | *Glycine max* | G3450 | 2168 | 3.00E−22 |
| 287 | G1816 | *Glycine max* | GLYMA-28NOV01-CLUSTER31802_1 | 1057 | |
| 287 | G1816 | *Glycine max* | GLYMA-28NOV01-CLUSTER586_102 | 1058 | |
| 287 | G1816 | *Glycine max* | GLYMA-28NOV01-CLUSTER586_116 | 1059 | |
| 287 | G1816 | *Glycine max* | GLYMA-28NOV01-CLUSTER8724_1 | 1060 | |
| 287 | G1816 | *Glycine max* | GLYMA-28NOV01-CLUSTER8724_2 | 1061 | |
| 287 | G1816 | *Oryza sativa* | ORYSA-22JAN02-CLUSTER30974_2 | 1062 | |
| 287 | G1816 | *Oryza sativa* | ORYSA-22JAN02-CLUSTER30974_3 | 1063 | |
| 287 | G1816 | *Oryza sativa* | OSC20053.C1.p5.fg | 1064 | |
| 287 | G1816 | *Oryza sativa* | OSC20055.C1.p5.fg | 1065 | |
| 287 | G1816 | *Zea mays* | ZEAMA-08NOV01-CLUSTER69699_1 | 1066 | |
| 287 | G1816 | *Zea mays* | ZEAMA-08NOV01-CLUSTER69699_2 | 1067 | |
| 287 | G1816 | *Glycine max* | Gma_S4901946 | 1663 | |
| 287 | G1816 | *Triticum aestivum* | Ta_S45274 | 1883 | |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 288 | G1816 | *Vitis vinifera* | BM437313 | | 8.00E−28 |
| 288 | G1816 | *Populus balsamifera* subsp. *trichocarpa* | BU872107 | | 2.00E−27 |
| 288 | G1816 | *Populus tremula* x *Populus tremuloides* | BU831849 | | 2.00E−27 |
| 288 | G1816 | *Vitis aestivalis* | CB289238 | | 7.00E−27 |
| 288 | G1816 | *Glycine max* | AI495284 | | 7.00E−19 |
| 288 | G1816 | *Brassica napus* | CD843377 | | 6.00E−15 |
| 288 | G1816 | *Nuphar advena* | CD473522 | | 1.00E−14 |
| 288 | G1816 | *Pinus pinaster* | AL750151 | | 3.00E−14 |
| 288 | G1816 | *Lactuca sativa* | BU015255 | | 5.00E−14 |
| 288 | G1816 | *Brassica oleracea* | BH961028 | | 8.00E−14 |
| 288 | G1816 | *Gossypioides kirkii* | gi23476295 | | 4.90E−12 |
| 288 | G1816 | *Gossypium raimondii* | gi14269333 | | 2.70E−11 |
| 288 | G1816 | *Gossypium herbaceum* | gi14269335 | | 2.70E−11 |
| 288 | G1816 | *Gossypium hirsutum* | gi14269337 | | 2.70E−11 |
| 288 | G1816 | *Solanum tuberosum* | gi9954118 | | 1.50E−10 |
| 288 | G1816 | *Oryza sativa* | gi2605619 | | 2.40E−10 |
| 288 | G1816 | *Cucumis sativus* | gi20514371 | | 3.10E−10 |
| 288 | G1816 | *Zea mays* subsp. *parviglumis* | gi15042108 | | 4.00E−10 |
| 288 | G1816 | *Zea luxurians* | gi15042124 | | 4.00E−10 |
| 288 | G1816 | *Anthurium andraeanum* | gi29824962 | | 5.20E−10 |
| 304 | G1863 | *Brassica oleracea* | BH582941 | | 5.00E−61 |
| 304 | G1863 | *Oryza sativa* | AF201895 | | 2.00E−34 |
| 304 | G1863 | *Solanum tuberosum* | BM404872 | | 3.00E−34 |
| 304 | G1863 | *Medicago truncatula* | AW981431 | | 1.00E−33 |
| 304 | G1863 | *Glycine max* | BI786182 | | 1.00E−33 |
| 304 | G1863 | *Oryza sativa* (*japonica* cultivar-group) | AK103508 | | 2.00E−33 |
| 304 | G1863 | *Lactuca sativa* | BQ852906 | | 4.00E−33 |
| 304 | G1863 | *Lycopersicon esculentum* | AW442227 | | 2.00E−32 |
| 304 | G1863 | *Hordeum vulgare* subsp. *vulgare* | CA029723 | | 4.00E−32 |
| 304 | G1863 | *Oryza sativa* (*indica* cultivar-group) | AAAA01004865 | | 1.00E−31 |
| 304 | G1863 | *Oryza sativa* (*japonica* cultivar-group) | gi32492205 | | 1.90E−43 |
| 304 | G1863 | *Oryza sativa* | gi6573149 | | 2.40E−39 |
| 304 | G1863 | *Solanum bulbocastanum* | gi32470630 | | 3.90E−39 |
| 304 | G1863 | *Sorghum bicolor* | gi18390099 | | 1.50E−37 |
| 304 | G1863 | *Lycopersicon esculentum* | gi19171209 | | 0.15 |
| 304 | G1863 | *Pisum sativum* | gi7008009 | | 0.75 |
| 304 | G1863 | *Zea mays* | gi1061308 | | 0.85 |
| 304 | G1863 | *Glycine max* | gi2129829 | | 0.98 |
| 304 | G1863 | *Oryza sativa* (*indica* cultivar-group) | gi4680184 | | 0.99 |
| 304 | G1863 | *Brassica rapa* | gi12655953 | | 1 |
| 305 | G1893 | *Glycine max* | AW278047.1 | 1068 | |
| 318 | G1945 | *Brassica rapa* subsp. *pekinensis* | BG543096 | | 2.00E−85 |
| 318 | G1945 | *Pisum sativum* | CD860359 | | 9.00E−69 |
| 318 | G1945 | *Brassica oleracea* | BH480897 | | 1.00E−66 |
| 318 | G1945 | *Glycine max* | CD397129 | | 4.00E−66 |
| 318 | G1945 | *Medicago truncatula* | BG647027 | | 4.00E−66 |
| 318 | G1945 | *Oryza sativa* (*indica* cultivar-group) | AAAA01000383 | | 7.00E−56 |
| 318 | G1945 | *Oryza sativa* (*japonica* cultivar-group) | AP005755 | | 9.00E−56 |
| 318 | G1945 | *Helianthus annuus* | BU023570 | | 3.00E−52 |
| 318 | G1945 | *Zea mays* | BZ412041 | | 7.00E−51 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 318 | G1945 | *Oryza sativa* | AP004020 | | 2.00E−48 |
| 318 | G1945 | *Oryza sativa* (*japonica* cultivar-group) | gi32489626 | | 1.60E−47 |
| 318 | G1945 | *Antirrhinum majus* | gi4165183 | | 1.20E−21 |
| 318 | G1945 | *Pisum sativum* | gi2213534 | | 2.20E−14 |
| 318 | G1945 | *Helianthus hirsutus* | gi27526446 | | 0.091 |
| 318 | G1945 | *Helianthus tuberosus* | gi27526452 | | 0.12 |
| 318 | G1945 | *Helianthus niveus* | gi27526450 | | 0.12 |
| 318 | G1945 | *Helianthus ciliaris* | gi14588999 | | 0.2 |
| 318 | G1945 | *Helianthus praecox* | gi18073228 | | 0.25 |
| 318 | G1945 | *Helianthus debilis* | gi27526440 | | 0.46 |
| 318 | G1945 | *Lycopersicon esculentum* | gi1345538 | | 0.46 |
| 327 | G1988 | *Glycine max* | GLYMA-28NOV01-CLUSTER75453_1 | 1098 | |
| 327 | G1988 | *Glycine max* | GLYMA-28NOV01-CLUSTER75453_2 | 1099 | |
| 327 | G1988 | *Oryza sativa* | ORYSA-22JAN02-CLUSTER153439_2 | 1100 | |
| 327 | G1988 | *Zea mays* | ZEAMA-08NOV01-CLUSTER10890_1 | 1101 | |
| 327 | G1988 | *Zea mays* | ZEAMA-08NOV01-CLUSTER10890_3 | 1102 | |
| 327 | G1988 | *Zea mays* | ZEAMA-08NOV01-CLUSTER201962_1 | 1103 | |
| 327 | G1988 | *Zea mays* | ZEAMA-08NOV01-CLUSTER3040_3 | 1104 | |
| 327 | G1988 | *Oryza sativa* | Os_S91481 | 1601 | |
| 327 | G1988 | *Lycopersicon esculentum* | SGN-UNIGENE-SINGLET-5090 | 2045 | |
| 328 | G1988 | *Brassica oleracea* | BH478747 | | 5.00E−23 |
| 328 | G1988 | *Populus balsamifera* subsp. *trichocarpa* | BU873581 | | 7.00E−22 |
| 328 | G1988 | *Citrus unshiu* | C95300 | | 2.00E−18 |
| 328 | G1988 | *Lycopersicon esculentum* | AW034552 | | 2.00E−18 |
| 328 | G1988 | *Oryza sativa* (*indica* cultivar-group) | AAAA01000340 | | 1.00E−17 |
| 328 | G1988 | *Beta vulgaris* | BQ594583 | | 1.00E−16 |
| 328 | G1988 | *Zea mays* | CC655765 | | 2.00E−15 |
| 328 | G1988 | *Glycine max* | BI469275 | | 8.00E−15 |
| 328 | G1988 | *Prunus persica* | BU046688 | | 7.00E−14 |
| 328 | G1988 | *Vitis vinifera* | CD719941 | | 2.00E−13 |
| 328 | G1988 | *Malus* x *domestica* | gi4091806 | | 2.60E−07 |
| 328 | G1988 | *Brassica napus* | gi30984027 | | 1.10E−06 |
| 328 | G1988 | *Brassica nigra* | gi22854920 | | 1.10E−06 |
| 328 | G1988 | *Raphanus sativus* | gi3341723 | | 2.70E−06 |
| 328 | G1988 | *Oryza sativa* (*japonica* cultivar-group) | gi32488104 | | 4.80E−06 |
| 328 | G1988 | *Ipomoea nil* | gi10946337 | | 5.10E−06 |
| 328 | G1988 | *Oryza sativa* | gi11094211 | | 2.20E−05 |
| 328 | G1988 | *Hordeum vulgare* | gi21667475 | | 4.50E−05 |
| 328 | G1988 | *Hordeum vulgare* subsp. *vulgare* | gi21655168 | | 0.00018 |
| 328 | G1988 | *Pinus radiata* | gi4557093 | | 0.0016 |
| 341 | G2041 | *Glycine max* | GLYMA-28NOV01-CLUSTER244491_1 | 1105 | |
| 341 | G2041 | *Glycine max* | LIB4280-051-Q1-K1-E4 | 1106 | |
| 341 | G2041 | *Oryza sativa* | rsicem_7360.y1.abd | 1107 | |
| 341 | G2041 | *Zea mays* | Zm_S11428605 | 1810 | |
| 341 | G2041 | *Lycopersicon esculentum* | SGN-UNIGENE-47127 | 2046 | |
| 341 | G2041 | *Lycopersicon esculentum* | SGN-UNIGENE-SINGLET-389924 | 2047 | |
| 342 | G2041 | *Glycine max* | AX196296 | | 1.0e−999 |
| 342 | G2041 | *Oryza sativa* (*indica* cultivar-group) | AAAA01023044 | | 1.00E−161 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 342 | G2041 | *Oryza sativa* (*japonica* cultivar-group) | AP004333 | | 1.00E−161 |
| 342 | G2041 | *Oryza sativa* | AC107085 | | 8.00E−90 |
| 342 | G2041 | *Lotus corniculatus* var. *japonicus* | AP006426 | | 7.00E−89 |
| 342 | G2041 | *Medicago truncatula* | BZ286591 | | 9.00E−89 |
| 342 | G2041 | *Helianthus annuus* | CD853758 | | 2.00E−88 |
| 342 | G2041 | *Lactuca sativa* | BQ853515 | | 6.00E−87 |
| 342 | G2041 | *Capsicum annuum* | BM067036 | | 3.00E−82 |
| 342 | G2041 | *Lycopersicon esculentum* | BI925244 | | 8.00E−79 |
| 342 | G2041 | *Oryza sativa* (*japonica* cultivar-group) | gi33146888 | | 1.50E−152 |
| 342 | G2041 | *Oryza sativa* | gi14140291 | | 5.60E−34 |
| 342 | G2041 | *Zea mays* | gi18463957 | | 1.50E−19 |
| 342 | G2041 | *Hordeum vulgare* | gi23193481 | | 4.40E−08 |
| 342 | G2041 | *Hordeum vulgare* subsp. *vulgare* | gi23193479 | | 1.40E−07 |
| 342 | G2041 | *Triticum monococcum* | gi23193487 | | 2.60E−07 |
| 342 | G2041 | *Brassica napus* | gi4106378 | | 0.12 |
| 342 | G2041 | *Medicago sativa* | gi1279563 | | 1 |
| 342 | G2041 | *Nicotiana tabacum* | gi8096269 | | 1 |
| 342 | G2041 | *Triticum aestivum* | gi32400814 | | 1 |
| 365 | G2142 | *Glycine max* | GLYMA-28NOV01-CLUSTER10684_8 | 1116 | |
| 365 | G2142 | *Glycine max* | GLYMA-28NOV01-CLUSTER137024_1 | 1117 | |
| 365 | G2142 | *Glycine max* | GLYMA-28NOV01-CLUSTER49853_1 | 1118 | |
| 365 | G2142 | *Glycine max* | GLYMA-28NOV01-CLUSTER49853_4 | 1119 | |
| 365 | G2142 | *Glycine max* | LIB3242-451-P1-J1-G8 | 1120 | |
| 365 | G2142 | *Glycine max* | jC-gmXLIB3563P042ag07d1 | 1121 | |
| 365 | G2142 | *Oryza sativa* | ORYSA-22JAN02-CLUSTER54709_1 | 1122 | |
| 365 | G2142 | *Oryza sativa* | ORYSA-22JAN02-CLUSTER8097_1 | 1123 | |
| 365 | G2142 | *Zea mays* | 700164501H1 | 1124 | |
| 365 | G2142 | *Glycine max* | Gma_S4891278 | 1666 | |
| 365 | G2142 | *Medicago truncatula* | Mtr_S5397469 | 1708 | |
| 365 | G2142 | *Zea mays* | Zm_S11527973 | 1812 | |
| 365 | G2142 | *Triticum aestivum* | Ta_S115402 | 1899 | |
| 365 | G2142 | *Triticum aestivum* | Ta_S146851 | 1900 | |
| 365 | G2142 | *Triticum aestivum* | Ta_S308126 | 1901 | |
| 365 | G2142 | *Lycopersicon esculentum* | SGN-UNIGENE-48174 | 2048 | |
| 365 | G2142 | *Lycopersicon esculentum* | SGN-UNIGENE-50424 | 2049 | |
| 365 | G2142 | *Lycopersicon esculentum* | SGN-UNIGENE-56397 | 2050 | |
| 365 | G2142 | *Lycopersicon esculentum* | SGN-UNIGENE-56608 | 2051 | |
| 366 | G2142 | *Brassica napus* | CD813318 | | 8.00E−90 |
| 366 | G2142 | *Medicago truncatula* | BF650735 | | 2.00E−59 |
| 366 | G2142 | *Populus tremula* x *Populus tremuloides* | BU837621 | | 4.00E−59 |
| 366 | G2142 | *Glycine max* | BU080678 | | 3.00E−58 |
| 366 | G2142 | *Beta vulgaris* | BQ594352 | | 4.00E−54 |
| 366 | G2142 | *Solanum tuberosum* | BF186943 | | 6.00E−53 |
| 366 | G2142 | *Lycopersicon esculentum* | AI490572 | | 1.00E−52 |
| 366 | G2142 | *Oryza sativa* (*japonica* cultivar-group) | AK101896 | | 7.00E−48 |
| 366 | G2142 | *Stevia rebaudiana* | BG524015 | | 2.00E−44 |
| 366 | G2142 | *Hordeum vulgare* subsp. *vulgare* | BU989763 | | 8.00E−42 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 366 | G2142 | *Pennisetum glaucum* | gi527655 | | 3.10E−10 |
| 366 | G2142 | *Sorghum bicolor* | gi527665 | | 3.90E−08 |
| 366 | G2142 | *Phyllostachys acuta* | gi527661 | | 6.50E−08 |
| 366 | G2142 | *Tripsacum australe* | gi527663 | | 1.80E−07 |
| 366 | G2142 | *Oryza sativa* (*japonica* cultivar-group) | gi32488806 | | 3.20E−07 |
| 366 | G2142 | *Oryza sativa* | gi15451582 | | 3.50E−07 |
| 366 | G2142 | *Oryza rufipogon* | gi2130061 | | 6.40E−07 |
| 366 | G2142 | *Oryza australiensis* | gi1086526 | | 1.40E−06 |
| 366 | G2142 | *Oryza officinalis* | gi1086534 | | 2.90E−06 |
| 366 | G2142 | *Oryza longistaminata* | gi1086530 | | 3.80E−06 |
| 371 | G2207 | *Oryza sativa* | Os_S17837 | 1605 | |
| 371 | G2207 | *Oryza sativa* | Os_S6232 | 1606 | |
| 371 | G2207 | *Glycine max* | Gma_S5129383 | 1667 | |
| 371 | G2207 | *Lycopersicon esculentum* | SGN-UNIGENE-50991 | 2052 | |
| 371 | G2207 | *Lycopersicon esculentum* | SGN-UNIGENE-SINGLET-399437 | 2053 | |
| 372 | G2207 | *Oryza sativa* (*japonica* cultivar-group) | AK100046 | | 1.00E−172 |
| 372 | G2207 | *Oryza sativa* | AX654056 | | 1.00E−168 |
| 372 | G2207 | *Lotus japonicus* | LJA239041 | | 1.00E−148 |
| 372 | G2207 | *Pisum sativum* | PSA493066 | | 1.00E−130 |
| 372 | G2207 | *Brassica oleracea* | BZ078380 | | 1.00E−123 |
| 372 | G2207 | *Oryza sativa* (*indica* cultivar-group) | AAAA01002068 | | 2.00E−76 |
| 372 | G2207 | *Brassica nigra* | AY061812 | | 7.00E−71 |
| 372 | G2207 | *Zea mays* | CC644684 | | 6.00E−70 |
| 372 | G2207 | *Gossypium arboreum* | BF269998 | | 4.00E−58 |
| 372 | G2207 | *Lycopersicon esculentum* | BI931640 | | 7.00E−55 |
| 372 | G2207 | *Oryza sativa* (*japonica* cultivar-group) | gi20503001 | | 1.00E−166 |
| 372 | G2207 | *Lotus japonicus* | gi6448579 | | 3.90E−160 |
| 372 | G2207 | *Pisum sativum* | gi23504759 | | 4.50E−124 |
| 372 | G2207 | *Oryza sativa* | gi7339715 | | 1.00E−122 |
| 372 | G2207 | *Chlamydomonas incerta* | gi2190980 | | 4.70E−06 |
| 372 | G2207 | *Chlamydomonas reinhardtii* | gi1928929 | | 0.00049 |
| 372 | G2207 | *Bromheadia finlaysoniana* | gi2108256 | | 0.55 |
| 372 | G2207 | *Lycopersicon esculentum* | gi100214 | | 0.73 |
| 372 | G2207 | *Nicotiana tabacum* | gi322758 | | 0.81 |
| 372 | G2207 | *Oryza sativa* (*indica* cultivar-group) | gi2407271 | | 0.96 |
| 393 | G2334 | *Lycopersicon esculentum* | SGN-UNIGENE-57794 | 2055 | |
| 394 | G2334 | *Brassica oleracea* | BZ428330 | | 5.00E−61 |
| 394 | G2334 | *Medicago truncatula* | AW981431 | | 1.00E−30 |
| 394 | G2334 | *Glycine max* | BI786182 | | 3.00E−30 |
| 394 | G2334 | *Solanum tuberosum* | BE922572 | | 7.00E−30 |
| 394 | G2334 | *Oryza sativa* (*japonica* cultivar-group) | AK110934 | | 7.00E−30 |
| 394 | G2334 | *Amborella trichopoda* | CD483211 | | 3.00E−29 |
| 394 | G2334 | *Lycopersicon esculentum* | AW650563 | | 4.00E−29 |
| 394 | G2334 | *Oryza sativa* | AF201895 | | 6.00E−29 |
| 394 | G2334 | *Hordeum vulgare* subsp. *vulgare* | CA029723 | | 6.00E−29 |
| 394 | G2334 | *Zea mays* | CA828910 | | 2.00E−28 |
| 394 | G2334 | *Oryza sativa* | gi6573149 | | 6.20E−37 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 394 | G2334 | *Oryza sativa* (*japonica* cultivar-group) | gi24413958 | | 1.80E−35 |
| 394 | G2334 | *Sorghum bicolor* | gi18390099 | | 6.00E−33 |
| 394 | G2334 | *Solanum bulbocastanum* | gi32470646 | | 5.90E−32 |
| 394 | G2334 | *Nicotiana alata* | gi1087017 | | 0.79 |
| 394 | G2334 | *Petunia* x *hybrida* | gi14522848 | | 0.94 |
| 394 | G2334 | *Picea abies* | gi10764150 | | 0.98 |
| 394 | G2334 | *Oryza sativa* (*indica* cultivar-group) | gi4680183 | | 1 |
| 394 | G2334 | *Lycopersicon esculentum* | gi1418988 | | 1 |
| 394 | G2334 | *Pyrus pyrifolia* | gi8698889 | | 1 |
| 404 | G2394 | *Oryza sativa* (*japonica* cultivar-group) | AK071804 | | 1.00E−108 |
| 404 | G2394 | *Zea mays* | BG837939 | | 2.00E−85 |
| 404 | G2394 | *Oryza sativa* | AX699700 | | 3.00E−72 |
| 404 | G2394 | *Triticum aestivum* | BJ319065 | | 7.00E−72 |
| 404 | G2394 | *Oryza sativa* (*indica* cultivar-group) | CB634885 | | 3.00E−69 |
| 404 | G2394 | *Lactuca sativa* | BQ852089 | | 4.00E−69 |
| 404 | G2394 | *Lycopersicon esculentum* | BI921710 | | 1.00E−67 |
| 404 | G2394 | *Hordeum vulgare* subsp. *vulgare* | AL505242 | | 9.00E−64 |
| 404 | G2394 | *Hordeum vulgare* | BU991885 | | 3.00E−60 |
| 404 | G2394 | *Solanum tuberosum* | BQ512426 | | 3.00E−57 |
| 404 | G2394 | *Oryza sativa* (*japonica* cultivar-group) | gi15289774 | | 1.50E−74 |
| 404 | G2394 | *Phacelia tanacetifolia* | gi5002214 | | 1.50E−24 |
| 404 | G2394 | *Oryza sativa* | gi14164470 | | 1.40E−13 |
| 404 | G2394 | *Hordeum vulgare* subsp. *vulgare* | gi20152976 | | 1.80E−12 |
| 404 | G2394 | *Cicer arietinum* | gi10334499 | | 6.90E−12 |
| 404 | G2394 | *Cucumis melo* | gi17016985 | | 8.10E−12 |
| 404 | G2394 | *Thellungiella halophila* | gi20340241 | | 7.80E−11 |
| 404 | G2394 | *Nicotiana tabacum* | gi12003386 | | 8.80E−10 |
| 404 | G2394 | *Zea mays* | gi21645888 | | 1.10E−09 |
| 404 | G2394 | *Hordeum vulgare* | gi2894379 | | 2.30E−09 |
| 505 | G2717 | *Glycine max* | GLYMA-28NOV01-CLUSTER16793_1 | 1209 | |
| 505 | G2717 | *Glycine max* | GLYMA-28NOV01-CLUSTER16793_3 | 1210 | |
| 505 | G2717 | *Glycine max* | GLYMA-28NOV01-CLUSTER23207_1 | 1211 | |
| 505 | G2717 | *Glycine max* | GLYMA-28NOV01-CLUSTER30577_1 | 1212 | |
| 505 | G2717 | *Glycine max* | GLYMA-28NOV01-CLUSTER30577_4 | 1213 | |
| 505 | G2717 | *Glycine max* | LIB3053-003-Q1-N1-A7 | 1214 | |
| 505 | G2717 | *Glycine max* | jC-gmle01810024c12a1 | 1215 | |
| 505 | G2717 | *Oryza sativa* | AU075998.1 | 1216 | |
| 505 | G2717 | *Oryza sativa* | ORYSA-22JAN02-CLUSTER275001_1 | 1217 | |
| 505 | G2717 | *Oryza sativa* | ORYSA-22JAN02-CLUSTER62825_1 | 1218 | |
| 505 | G2717 | *Oryza sativa* | OSC100863.C1.p7.fg | 1219 | |
| 505 | G2717 | *Oryza sativa* | OSC17223.C1.p2.fg | 1220 | |
| 505 | G2717 | *Oryza sativa* | OSC21325.C1.p9.fg | 1221 | |
| 505 | G2717 | *Zea mays* | LIB3689-236-Q1-K6-H9 | 1222 | |
| 505 | G2717 | *Zea mays* | LIB4758-055-R2-K1-G11 | 1223 | |
| 505 | G2717 | *Zea mays* | ZEAMA-08NOV01-CLUSTER25294_1 | 1224 | |
| 505 | G2717 | *Zea mays* | ZEAMA-08NOV01-CLUSTER25294_2 | 1225 | |
| 505 | G2717 | *Zea mays* | ZEAMA-08NOV01-CLUSTER304_164 | 1226 | |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 505 | G2717 | *Zea mays* | ZEAMA-08NOV01-CLUSTER304_172 | 1227 | |
| 505 | G2717 | *Oryza sativa* | Os_S96374 | 1614 | |
| 505 | G2717 | *Glycine max* | Gma_S4993926 | 1670 | |
| 505 | G2717 | *Hordeum vulgare* | Hv_S134310 | 1744 | |
| 505 | G2717 | *Zea mays* | Zm_S11527070 | 1818 | |
| 505 | G2717 | *Triticum aestivum* | Ta_S167441 | 1907 | |
| 505 | G2717 | *Triticum aestivum* | Ta_S275432 | 1908 | |
| 505 | G2717 | *Triticum aestivum* | Ta_S88094 | 1909 | |
| 505 | G2717 | *Lycopersicon esculentum* | SGN-UNIGENE-51988 | 2068 | |
| 505 | G2717 | *Lycopersicon esculentum* | SGN-UNIGENE-SINGLET-393701 | 2069 | |
| 506 | G2717 | *Brassica napus* | CD814949 | | 7.00E−90 |
| 506 | G2717 | *Oryza sativa* (*japonica* cultivar-group) | AK100618 | | 2.00E−74 |
| 506 | G2717 | *Lycopersicon esculentum* | BG127613 | | 3.00E−65 |
| 506 | G2717 | *Vitis vinifera* | CB007263 | | 5.00E−63 |
| 506 | G2717 | *Ipomoea nil* | BJ563043 | | 2.00E−61 |
| 506 | G2717 | *Medicago truncatula* | BF003720 | | 3.00E−61 |
| 506 | G2717 | *Pennisetum ciliare* | BM084769 | | 2.00E−58 |
| 506 | G2717 | *Glycine max* | BU964889 | | 3.00E−55 |
| 506 | G2717 | *Solanum tuberosum* | BQ119267 | | 2.00E−54 |
| 506 | G2717 | *Hordeum vulgare* | BM816006 | | 4.00E−52 |
| 506 | G2717 | *Oryza sativa* (*japonica* cultivar-group) | gi20146249 | | 1.10E−69 |
| 506 | G2717 | *Zea mays* | gi18463961 | | 1.80E−39 |
| 506 | G2717 | *Petroselinum crispum* | gi2224899 | | 7.80E−21 |
| 506 | G2717 | *Nicotiana tabacum* | gi1084419 | | 2.20E−14 |
| 506 | G2717 | *Triticum aestivum* | gi283024 | | 5.10E−14 |
| 506 | G2717 | *Fritillaria liliacea* | gi15281590 | | 1.10E−13 |
| 506 | G2717 | *Lycopersicon esculentum* | gi3021487 | | 5.40E−13 |
| 506 | G2717 | *Fritillaria agrestis* | gi2641211 | | 2.70E−12 |
| 506 | G2717 | *Medicago truncatula* | gi32966575 | | 3.10E−11 |
| 506 | G2717 | *Lens culinaris* | gi13540405 | | 6.10E−11 |
| 507 | G2718 | *Glycine max* | GLYMA-28NOV01-CLUSTER31802_1 | 1057 | |
| 507 | G2718 | *Glycine max* | GLYMA-28NOV01-CLUSTER586_102 | 1058 | |
| 507 | G2718 | *Glycine max* | GLYMA-28NOV01-CLUSTER586_116 | 1059 | |
| 507 | G2718 | *Glycine max* | GLYMA-28NOV01-CLUSTER8724_1 | 1060 | |
| 507 | G2718 | *Glycine max* | GLYMA-28NOV01-CLUSTER8724_2 | 1061 | |
| 507 | G2718 | *Oryza sativa* | ORYSA-22JAN02-CLUSTER30974_3 | 1063 | |
| 507 | G2718 | *Oryza sativa* | OSC20053.C1.p5.fg | 1064 | |
| 507 | G2718 | *Oryza sativa* | OSC20055.C1.p5.fg | 1065 | |
| 507 | G2718 | *Zea mays* | ZEAMA-08NOV01-CLUSTER69699_1 | 1066 | |
| 507 | G2718 | *Zea mays* | ZEAMA-08NOV01-CLUSTER69699_2 | 1067 | |
| 507 | G2718 | *Glycine max* | Gma_S4901946 | 1663 | |
| 507 | G2718 | *Triticum aestivum* | Ta_S45274 | 1883 | |
| 508 | G2718 | *Brassica oleracea* | BH961028 | | 1.00E−24 |
| 508 | G2718 | *Populus tremula* × *Populus tremuloides* | BU831849 | | 3.00E−21 |
| 508 | G2718 | *Populus balsamifera* subsp. *trichocarpa* | BU872107 | | 3.00E−21 |
| 508 | G2718 | *Vitis vinifera* | BM437313 | | 6.00E−20 |
| 508 | G2718 | *Vitis aestivalis* | CB289238 | | 3.00E−19 |
| 508 | G2718 | *Glycine max* | BI699876 | | 2.00E−18 |
| 508 | G2718 | *Pinus pinaster* | AL750151 | | 4.00E−16 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 508 | G2718 | *Hordeum vulgare* subsp. *vulgare* | AV911235 | | 1.00E−12 |
| 508 | G2718 | *Nuphar advena* | CD473522 | | 2.00E−12 |
| 508 | G2718 | *Oryza sativa* (*japonica* cultivar-group) | CB684618 | | 4.00E−12 |
| 508 | G2718 | *Solanum tuberosum* | gi9954118 | | 7.20E−11 |
| 508 | G2718 | *Vitis labrusca* x *Vitis vinifera* | gi22266671 | | 3.10E−10 |
| 508 | G2718 | *Gossypium hirsutum* | gi23476287 | | 3.10E−10 |
| 508 | G2718 | *Gossypium raimondii* | gi23476291 | | 3.10E−10 |
| 508 | G2718 | *Gossypium herbaceum* | gi23476293 | | 3.10E−10 |
| 508 | G2718 | *Gossypioides kirkii* | gi23476295 | | 3.10E−10 |
| 508 | G2718 | *Fragaria* x *ananassa* | gi15082210 | | 5.00E−10 |
| 508 | G2718 | *Oryza sativa* | gi19072770 | | 6.40E−10 |
| 508 | G2718 | *Zea luxurians* | gi15042120 | | 8.20E−10 |
| 508 | G2718 | *Zea mays* | gi19548449 | | 8.20E−10 |
| 511 | G2741 | *Glycine max* | BG508638.1 | 1229 | |
| 511 | G2741 | *Glycine max* | GLYMA-28NOV01-CLUSTER5654_1 | 1230 | |
| 511 | G2741 | *Glycine max* | GLYMA-28NOV01-CLUSTER5654_2 | 1231 | |
| 511 | G2741 | *Oryza sativa* | OSC102289.C1.p18.fg | 1232 | |
| 511 | G2741 | *Oryza sativa* | OSC5384.C1.p5.fg | 1233 | |
| 511 | G2741 | *Oryza sativa* | rsicen_25533.y1.abd | 1234 | |
| 511 | G2741 | *Oryza sativa* | rsicen_8566.y1.abd | 1235 | |
| 511 | G2741 | *Zea mays* | ZEAMA-08NOV01-CLUSTER73638_1 | 1236 | |
| 511 | G2741 | *Glycine max* | Gma_S4922181 | 1671 | |
| 511 | G2741 | *Hordeum vulgare* | Hv_S24580 | 1745 | |
| 511 | G2741 | *Zea mays* | Zm_S11434269 | 1819 | |
| 511 | G2741 | *Lycopersicon esculentum* | SGN-UNIGENE-50878 | 2070 | |
| 511 | G2741 | *Lycopersicon esculentum* | SGN-UNIGENE-SINGLET-356106 | 2071 | |
| 512 | G2741 | *Oryza sativa* | AP003277 | | 2.00E−56 |
| 512 | G2741 | *Brassica oleracea* | BZ506408 | | 6.00E−48 |
| 512 | G2741 | *Zea mays* | BZ709707 | | 1.00E−47 |
| 512 | G2741 | *Glycine max* | CA953428 | | 4.00E−45 |
| 512 | G2741 | *Lycopersicon esculentum* | BE432293 | | 3.00E−39 |
| 512 | G2741 | *Oryza sativa* (*japonica* cultivar-group) | AC130607 | | 7.00E−39 |
| 512 | G2741 | *Hordeum vulgare* | BE559431 | | 2.00E−37 |
| 512 | G2741 | *Oryza minuta* | CB210034 | | 2.00E−34 |
| 512 | G2741 | *Oryza sativa* (*indica* cultivar-group) | AAAA01011300 | | 5.00E−34 |
| 512 | G2741 | *Lactuca sativa* | BU000462 | | 1.00E−33 |
| 512 | G2741 | *Oryza sativa* | gi15289981 | | 3.20E−57 |
| 512 | G2741 | *Oryza sativa* (*japonica* cultivar-group) | gi20160613 | | 9.30E−29 |
| 512 | G2741 | *Zea mays* | gi13661174 | | 3.00E−25 |
| 512 | G2741 | *Oryza glaberrima* | gi31338862 | | 2.50E−13 |
| 512 | G2741 | *Oryza sativa* (*indica* cultivar-group) | gi31338860 | | 7.60E−13 |
| 512 | G2741 | *Chlamydomonas reinhardtii* | gi5916207 | | 3.20E−11 |
| 512 | G2741 | *Mesembryanthemum crystallinum* | gi6942190 | | 7.90E−11 |
| 512 | G2741 | *Nicotiana tabacum* | gi4519671 | | 1.20E−09 |
| 512 | G2741 | *Solanum bulbocastanum* | gi32470629 | | 4.30E−09 |
| 512 | G2741 | *Pisum sativum* | gi23504755 | | 0.063 |
| 524 | G2765 | *Oryza sativa* (*japonica* cultivar-group) | AK106649 | | 4.00E−61 |
| 524 | G2765 | *Lycopersicon esculentum* | AI488313 | | 5.00E−60 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 524 | G2765 | *Brassica oleracea* | BH582059 | | 4.00E−51 |
| 524 | G2765 | *Glycine max* | BE020519 | | 2.00E−50 |
| 524 | G2765 | *Oryza sativa* subsp. *japonica* | AU093196 | | 4.00E−49 |
| 524 | G2765 | *Populus tremula* x *Populus tremuloides* | BU813371 | | 1.00E−37 |
| 524 | G2765 | *Medicago truncatula* | BF647687 | | 2.00E−37 |
| 524 | G2765 | *Pinus pinaster* | BX252556 | | 1.00E−32 |
| 524 | G2765 | *Populus balsamifera* subsp. *trichocarpa* | BU869748 | | 4.00E−32 |
| 524 | G2765 | *Zea mays* | BZ644709 | | 3.00E−31 |
| 524 | G2765 | *Oryza sativa* (*japonica* cultivar-group) | gi32129332 | | 2.30E−30 |
| 524 | G2765 | *Oryza sativa* | gi10800070 | | 3.80E−28 |
| 524 | G2765 | *Pennisetum glaucum* | gi527655 | | 8.40E−09 |
| 524 | G2765 | *Perilla frutescens* | gi28375728 | | 1.30E−08 |
| 524 | G2765 | *Sorghum bicolor* | gi527665 | | 1.40E−08 |
| 524 | G2765 | *Oryza australiensis* | gi1086526 | | 1.80E−08 |
| 524 | G2765 | *Oryza rufipogon* | gi1086536 | | 2.30E−08 |
| 524 | G2765 | *Phyllostachys acuta* | gi527661 | | 3.80E−08 |
| 524 | G2765 | *Oryza longistaminata* | gi1086530 | | 4.90E−08 |
| 524 | G2765 | *Oryza officinalis* | gi1086534 | | 1.00E−07 |
| 586 | G2898 | *Medicago truncatula* | AJ501279 | | 2.00E−41 |
| 586 | G2898 | *Glycine max* | BG651880 | | 2.00E−41 |
| 586 | G2898 | *Solanum tuberosum* | BQ516260 | | 3.00E−35 |
| 586 | G2898 | *Populus tremula* | BU816897 | | 8.00E−32 |
| 586 | G2898 | *Zinnia elegans* | AU292820 | | 4.00E−30 |
| 586 | G2898 | *Oryza sativa* (*japonica* cultivar-group) | AK064663 | | 7.00E−30 |
| 586 | G2898 | *Zea mays* | CD999897 | | 5.00E−29 |
| 586 | G2898 | *Triticum aestivum* | BM135160 | | 2.00E−28 |
| 586 | G2898 | *Gossypium arboreum* | BG446904 | | 6.00E−21 |
| 586 | G2898 | *Nuphar advena* | CD475578 | | 1.00E−19 |
| 586 | G2898 | *Vicia faba* | gi541981 | | 1.60E−20 |
| 586 | G2898 | *Oryza sativa* (*japonica* cultivar-group) | gi20161572 | | 3.90E−19 |
| 586 | G2898 | *Ipomoea nil* | gi1052956 | | 6.30E−19 |
| 586 | G2898 | *Solanum tuberosum* | gi2894109 | | 1.00E−18 |
| 586 | G2898 | *Pisum sativum* | gi436424 | | 1.00E−18 |
| 586 | G2898 | *Nicotiana tabacum* | gi2196548 | | 2.80E−16 |
| 586 | G2898 | *Glycine max* | gi123379 | | 5.90E−16 |
| 586 | G2898 | *Canavalia gladiata* | gi1813329 | | 7.50E−16 |
| 586 | G2898 | *Narcissus pseudonarcissus* | gi18419623 | | 2.50E−15 |
| 586 | G2898 | *Oryza sativa* (*indica* cultivar-group) | gi23345287 | | 2.50E−15 |
| 593 | G2933 | *Glycine max* | GLYMA-28NOV01-CLUSTER243321_1 | 1314 | |
| 593 | G2933 | *Oryza sativa* | OSC7496.C1.p10.fg | 1315 | |
| 593 | G2933 | *Zea mays* | ZEAMA-08NOV01-CLUSTER88899_1 | 1316 | |
| 593 | G2933 | *Oryza sativa* | Os_S39118 | 1624 | |
| 593 | G2933 | *Zea mays* | Zm_S11445525 | 1828 | |
| 593 | G2933 | *Lycopersicon esculentum* | SGN-UNIGENE-53603 | 2090 | |
| 594 | G2933 | *Brassica oleracea* | BH587081 | | 6.00E−59 |
| 594 | G2933 | *Populus tremula* x *Populus tremuloides* | BU884102 | | 8.00E−37 |
| 594 | G2933 | *Lycopersicon esculentum* | BI205905 | | 6.00E−29 |
| 594 | G2933 | *Glycine max* | BQ611037 | | 4.00E−28 |
| 594 | G2933 | *Triticum aestivum* | CD872523 | | 4.00E−24 |
| 594 | G2933 | *Lupinus albus* | CA410291 | | 4.00E−23 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 594 | G2933 | *Oryza sativa* (*japonica* cultivar-group) | CB660906 | | 5.00E−23 |
| 594 | G2933 | *Oryza sativa* (*indica* cultivar-group) | CB624355 | | 1.00E−22 |
| 594 | G2933 | *Medicago truncatula* | AC125478 | | 6.00E−21 |
| 594 | G2933 | *Zinnia elegans* | AU288915 | | 9.00E−20 |
| 594 | G2933 | *Oryza sativa* | gi15528806 | | 3.90E−26 |
| 594 | G2933 | *Pennisetum glaucum* | gi527657 | | 8.60E−07 |
| 594 | G2933 | *Phyllostachys acuta* | gi527661 | | 4.10E−05 |
| 594 | G2933 | *Sorghum bicolor* | gi527667 | | 5.60E−05 |
| 594 | G2933 | *Tripsacum australe* | gi527663 | | 0.00024 |
| 594 | G2933 | *Mesembryanthemum crystallinum* | gi4206118 | | 0.00048 |
| 594 | G2933 | *Oryza sativa* (*japonica* cultivar-group) | gi20521292 | | 0.0012 |
| 594 | G2933 | *Zea mays* | gi18542170 | | 0.0014 |
| 594 | G2933 | *Oryza australiensis* | gi1086526 | | 0.0031 |
| 594 | G2933 | *Oryza rufipogon* | gi1086538 | | 0.0055 |
| 607 | G2979 | *Lycopersicon esculentum* | SGN-UNIGENE-49425 | 2092 | |
| 608 | G2979 | *Zea mays* | AY107996 | | 2.00E−68 |
| 608 | G2979 | *Thellungiella salsuginea* | BI698460 | | 1.00E−60 |
| 608 | G2979 | *Vitis vinifera* | CB920900 | | 4.00E−45 |
| 608 | G2979 | *Helianthus annuus* | CD853183 | | 2.00E−41 |
| 608 | G2979 | *Medicago truncatula* | BG450549 | | 3.00E−39 |
| 608 | G2979 | *Glycine max* | BM524804 | | 8.00E−38 |
| 608 | G2979 | *Lycopersicon esculentum* | BI924306 | | 8.00E−37 |
| 608 | G2979 | *Solanum tuberosum* | BE920312 | | 7.00E−32 |
| 608 | G2979 | *Eschscholzia californica* | CD478692 | | 9.00E−32 |
| 608 | G2979 | *Sorghum bicolor* | BG273641 | | 5.00E−28 |
| 608 | G2979 | *Nicotiana tabacum* | gi6328415 | | 4.40E−10 |
| 608 | G2979 | *Physcomitrella patens* | gi26190147 | | 1.00E−09 |
| 608 | G2979 | *Triticum monococcum* | gi13619655 | | 3.90E−09 |
| 608 | G2979 | *Triticum* sp. | gi5763821 | | 3.90E−09 |
| 608 | G2979 | *Daucus carota* | gi8977833 | | 5.80E−09 |
| 608 | G2979 | *Oryza sativa* | gi12225043 | | 9.90E−09 |
| 608 | G2979 | *Chenopodium rubrum* | gi11558192 | | 3.00E−08 |
| 608 | G2979 | *Populus alba* | gi27802536 | | 3.10E−08 |
| 608 | G2979 | *Oryza sativa* (*japonica* cultivar-group) | gi32479738 | | 1.10E−07 |
| 608 | G2979 | *Thlaspi caerulescens* | gi22086272 | | 2.90E−07 |
| 609 | G2981 | *Glycine max* | GLYMA-28NOV01-CLUSTER28852_1 | 1318 | |
| 609 | G2981 | *Glycine max* | GLYMA-28NOV01-CLUSTER28852_2 | 1319 | |
| 609 | G2981 | *Glycine max* | GLYMA-28NOV01-CLUSTER28852_4 | 1320 | |
| 609 | G2981 | *Glycine max* | GLYMA-28NOV01-CLUSTER28852_5 | 1321 | |
| 609 | G2981 | *Glycine max* | GLYMA-28NOV01-CLUSTER28852_6 | 1322 | |
| 609 | G2981 | *Glycine max* | GLYMA-28NOV01-CLUSTER28852_8 | 1323 | |
| 609 | G2981 | *Glycine max* | GLYMA-28NOV01-CLUSTER28852_9 | 1324 | |
| 609 | G2981 | *Glycine max* | LIB3242-344-Q1-J1-G7 | 1325 | |
| 609 | G2981 | *Glycine max* | LIB4392-029-R1-K1-C8 | 1326 | |
| 609 | G2981 | *Oryza sativa* | ORYSA-22JAN02-CLUSTER89637_1 | 1327 | |
| 609 | G2981 | *Oryza sativa* | Os_S104685 | 1626 | |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 609 | G2981 | *Glycine max* | Gma_S4882455 | 1683 | |
| 609 | G2981 | *Zea mays* | Zm_S11334447 | 1829 | |
| 609 | G2981 | *Zea mays* | Zm_S11524241 | 1830 | |
| 609 | G2981 | *Lycopersicon esculentum* | SGN-UNIGENE-50978 | 2093 | |
| 610 | G2981 | *Populus tremula* x *Populus tremuloides* | AY307373 | | 1.00E−123 |
| 610 | G2981 | *Oryza sativa* (*japonica* cultivar-group) | AY224589 | | 1.00E−106 |
| 610 | G2981 | *Zea mays* | AY108383 | | 1.00E−105 |
| 610 | G2981 | *Poncirus trifoliata* | CD573622 | | 1.00E−96 |
| 610 | G2981 | *Glycine max* | BU579005 | | 8.00E−85 |
| 610 | G2981 | *Solanum tuberosum* | BM406319 | | 6.00E−79 |
| 610 | G2981 | *Lycopersicon esculentum* | BG134590 | | 2.00E−76 |
| 610 | G2981 | *Pinus taeda* | BG040894 | | 4.00E−74 |
| 610 | G2981 | *Marchantia polymorpha* | C96290 | | 2.00E−71 |
| 610 | G2981 | *Lactuca sativa* | BU012590 | | 4.00E−66 |
| 610 | G2981 | *Populus tremula* x *Populus tremuloides* | gi32187097 | | 8.20E−119 |
| 610 | G2981 | *Oryza sativa* (*japonica* cultivar-group) | gi29371983 | | 2.80E−101 |
| 610 | G2981 | *Triticum* sp. | gi11877791 | | 4.10E−47 |
| 610 | G2981 | *Triticum monococcum* | gi13619653 | | 4.10E−47 |
| 610 | G2981 | *Populus alba* | gi27802536 | | 0.0064 |
| 610 | G2981 | *Gnetum gnemon* | gi5019435 | | 0.037 |
| 610 | G2981 | *Nicotiana tabacum* | gi6328415 | | 0.069 |
| 610 | G2981 | *Oryza sativa* | gi12225043 | | 0.071 |
| 610 | G2981 | *Physcomitrella patens* | gi26190147 | | 0.099 |
| 610 | G2981 | *Chenopodium rubrum* | gi11558192 | | 0.15 |
| 611 | G2982 | *Glycine max* | GLYMA-28NOV01-CLUSTER28852_1 | 1318 | |
| 611 | G2982 | *Glycine max* | GLYMA-28NOV01-CLUSTER28852_2 | 1319 | |
| 611 | G2982 | *Glycine max* | GLYMA-28NOV01-CLUSTER28852_4 | 1320 | |
| 611 | G2982 | *Glycine max* | GLYMA-28NOV01-CLUSTER28852_5 | 1321 | |
| 611 | G2982 | *Glycine max* | GLYMA-28NOV01-CLUSTER28852_6 | 1322 | |
| 611 | G2982 | *Glycine max* | GLYMA-28NOV01-CLUSTER28852_8 | 1323 | |
| 611 | G2982 | *Glycine max* | LIB3242-344-Q1-J1-G7 | 1325 | |
| 611 | G2982 | *Glycine max* | LIB4392-029-R1-K1-C8 | 1326 | |
| 611 | G2982 | *Oryza sativa* | ORYSA-22JAN02-CLUSTER89637_1 | 1327 | |
| 611 | G2982 | *Lycopersicon esculentum* | SGN-UNIGENE-50978 | 2093 | |
| 612 | G2982 | *Brassica napus* | CD813391 | | 1.00E−79 |
| 612 | G2982 | *Populus tremula* x *Populus tremuloides* | AY307373 | | 2.00E−59 |
| 612 | G2982 | *Zea mays* | AY108383 | | 6.00E−57 |
| 612 | G2982 | *Oryza sativa* (*japonica* cultivar-group) | AY224551 | | 2.00E−54 |
| 612 | G2982 | *Glycine max* | BU579005 | | 8.00E−52 |
| 612 | G2982 | *Pinus taeda* | BG040894 | | 3.00E−50 |
| 612 | G2982 | *Solanum tuberosum* | BM406319 | | 2.00E−47 |
| 612 | G2982 | *Marchantia polymorpha* | C96290 | | 3.00E−47 |
| 612 | G2982 | *Lycopersicon esculentum* | BM412584 | | 1.00E−42 |
| 612 | G2982 | *Triticum* sp. | TSP271917 | | 9.00E−40 |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 612 | G2982 | *Populus tremula* x *Populus tremuloides* | gi32187097 | | 1.20E−58 |
| 612 | G2982 | *Oryza sativa* (*japonica* cultivar-group) | gi29367654 | | 6.80E−54 |
| 612 | G2982 | *Triticum* sp. | gi11877791 | | 2.00E−40 |
| 612 | G2982 | *Triticum monococcum* | gi13619653 | | 2.00E−40 |
| 612 | G2982 | *Daucus carota* | gi8977833 | | 0.0044 |
| 612 | G2982 | *Nicotiana tabacum* | gi6328415 | | 0.057 |
| 612 | G2982 | *Physcomitrella patens* | gi26190147 | | 0.17 |
| 612 | G2982 | *Thlaspi caerulescens* | gi22086272 | | 0.21 |
| 612 | G2982 | *Oryza sativa* | gi12225043 | | 0.24 |
| 612 | G2982 | *Chenopodium rubrum* | gi11558192 | | 0.25 |
| 615 | G2990 | *Oryza sativa* | OSC4898.C1.p6.fg | 1334 | |
| 615 | G2990 | *Zea mays* | LIB3279-221-Q6-K6-B2 | 1335 | |
| 615 | G2990 | *Zea mays* | ZEAMA-08NOV01-CLUSTER42733_1 | 1336 | |
| 615 | G2990 | *Oryza sativa* | Os__S56831 | 1628 | |
| 615 | G2990 | *Glycine max* | Gma__S4897246 | 1685 | |
| 615 | G2990 | *Medicago truncatula* | Mtr__S5341529 | 1715 | |
| 615 | G2990 | *Triticum aestivum* | Ta__S171947 | 1921 | |
| 615 | G2990 | *Lycopersicon esculentum* | SGN-UNIGENE-49426 | 2095 | |
| 615 | G2990 | *Lycopersicon esculentum* | SGN-UNIGENE-52525 | 2096 | |
| 616 | G2990 | *Brassica oleracea* | BH738007 | | 1.00E−100 |
| 616 | G2990 | *Medicago truncatula* | AC139600 | | 3.00E−84 |
| 616 | G2990 | *Flaveria bidentis* | FBI18580 | | 8.00E−81 |
| 616 | G2990 | *Glycine max* | BF069575 | | 4.00E−59 |
| 616 | G2990 | *Solanum tuberosum* | BE471989 | | 7.00E−56 |
| 616 | G2990 | *Flaveria trinervia* | FTR18577 | | 3.00E−51 |
| 616 | G2990 | *Populus balsamifera* subsp. *trichocarpa* | AI166342 | | 5.00E−45 |
| 616 | G2990 | *Vitis vinifera* | CB970621 | | 7.00E−45 |
| 616 | G2990 | *Oryza sativa* (*japonica* cultivar-group) | AP005152 | | 2.00E−43 |
| 616 | G2990 | *Zea mays* | CC335993 | | 3.00E−42 |
| 616 | G2990 | *Flaveria bidentis* | gi13277220 | | 1.10E−76 |
| 616 | G2990 | *Oryza sativa* (*japonica* cultivar-group) | gi32480091 | | 2.10E−38 |
| 616 | G2990 | *Flaveria trinervia* | gi13277216 | | 1.60E−29 |
| 616 | G2990 | *Oryza sativa* | gi5091602 | | 3.00E−28 |
| 616 | G2990 | *Lactuca sativa* | gi29119890 | | 9.00E−20 |
| 616 | G2990 | *Bromheadia finlaysoniana* | gi2108256 | | 4.30E−06 |
| 616 | G2990 | *Lycopersicon esculentum* | gi100214 | | 1.20E−05 |
| 616 | G2990 | *Daucus carota* | gi224556 | | 1.70E−05 |
| 616 | G2990 | *Nicotiana alata* | gi1247388 | | 1.90E−05 |
| 616 | G2990 | *Gossypium barbadense* | gi451544 | | 3.80E−05 |
| 655 | G3076 | *Oryza sativa* | Os__S95874 | 1630 | |

TABLE 7-continued

Orthologs of Representative *Arabidopsis* Transcription Factor Genes

| Table 7: SEQ ID NO: of *Arabidopsis* Sequence | GID No. | Species from Which Ortholog is Derived | Sequence Identifier or Accession Number | SEQ ID NO: of Orthologous Sequence | Smallest Sum Probability to Ortholog, When Known |
|---|---|---|---|---|---|
| 655 | G3076 | *Lycopersicon esculentum* | SGN-UNIGENE-52322 | 2100 | |
| 656 | G3076 | *Brassica oleracea* | BH458827 | | 1.00E−59 |
| 656 | G3076 | *Lycopersicon esculentum* | AI489100 | | 3.00E−52 |
| 656 | G3076 | *Theobroma cacao* | CA796492 | | 6.00E−31 |
| 656 | G3076 | *Nicotiana glauca* x *Nicotiana langsdorffii* | TOBTID3 | | 3.00E−25 |
| 656 | G3076 | *Populus tremula* x *Populus tremuloides* | BU866131 | | 3.00E−21 |
| 656 | G3076 | *Medicago truncatula* | BQ123004 | | 4.00E−20 |
| 656 | G3076 | *Zea mays* | CC633595 | | 8.00E−18 |
| 656 | G3076 | *Oryza sativa* (*japonica* cultivar-group) | AK106334 | | 1.00E−17 |
| 656 | G3076 | *Oryza sativa* | AP003567 | | 4.00E−17 |
| 656 | G3076 | *Oryza sativa* (*indica* cultivar-group) | AAAA01001312 | | 4.00E−17 |
| 656 | G3076 | *Oryza sativa* | gi15408613 | | 1.10E−19 |
| 656 | G3076 | *Oryza sativa* (*japonica* cultivar-group) | gi21104797 | | 1.10E−19 |
| 656 | G3076 | *Lycopersicon esculentum* | gi4959970 | | 4.30E−13 |
| 656 | G3076 | *Triticum aestivum* | gi100809 | | 2.70E−12 |
| 656 | G3076 | *Solanum tuberosum* | gi13195751 | | 6.90E−12 |
| 656 | G3076 | *Zea mays* | gi297020 | | 8.80E−12 |
| 656 | G3076 | *Nicotiana glauca* x *Nicotiana langsdorffii* | gi688423 | | 1.00E−11 |
| 656 | G3076 | *Phaseolus vulgaris* | gi15148924 | | 1.40E−10 |
| 656 | G3076 | *Nicotiana tabacum* | gi12230709 | | 1.10E−09 |
| 656 | G3076 | *Glycine max* | gi7488719 | | 1.40E−08 |
| 657 | G3083 | *Oryza sativa* | LIB3434-065-P1-K1-B5 | 1346 | |
| 657 | G3083 | *Oryza sativa* | Os_S54214 | 1631 | |
| 657 | G3083 | *Glycine max* | Gma_S4880456 | 1687 | |
| 657 | G3083 | *Hordeum vulgare* | Hv_S60182 | 1753 | |
| 657 | G3083 | *Triticum aestivum* | Ta_S179586 | 1924 | |
| 657 | G3083 | *Lycopersicon esculentum* | SGN-UNIGENE-SINGLET-306367 | 2101 | |
| 658 | G3083 | *Medicago truncatula* | BQ123004 | | 9.00E−65 |
| 658 | G3083 | *Arachis hypogaea* | CD038559 | | 3.00E−58 |
| 658 | G3083 | *Glycine max* | BE657440 | | 7.00E−51 |
| 658 | G3083 | *Theobroma cacao* | CA794948 | | 2.00E−48 |
| 658 | G3083 | *Phaseolus coccineus* | CA899019 | | 8.00E−47 |
| 658 | G3083 | *Brassica oleracea* | BZ028606 | | 3.00E−42 |
| 658 | G3083 | *Brassica napus* | CD823868 | | 3.00E−42 |
| 658 | G3083 | *Populus tremula* x *Populus tremuloides* | BU866131 | | 5.00E−36 |
| 658 | G3083 | *Oryza sativa* (*indica* cultivar-group) | AAAA01006352 | | 2.00E−32 |
| 658 | G3083 | *Nicotiana glauca* x *Nicotiana langsdorffii* | TOBTID3 | | 1.00E−31 |
| 658 | G3083 | *Nicotiana glauca* x *Nicotiana langsdorffii* | gi688423 | | 8.80E−36 |
| 658 | G3083 | *Oryza sativa* | gi8570052 | | 1.30E−29 |
| 658 | G3083 | *Lycopersicon esculentum* | gi4959970 | | 3.10E−17 |
| 658 | G3083 | *Nicotiana tabacum* | gi12230709 | | 7.50E−16 |
| 658 | G3083 | *Triticum aestivum* | gi100809 | | 1.60E−15 |
| 658 | G3083 | *Solanum tuberosum* | gi13195751 | | 3.00E−14 |
| 658 | G3083 | *Zea mays* | gi297020 | | 6.00E−14 |
| 658 | G3083 | *Phaseolus vulgaris* | gi15148926 | | 1.90E−13 |
| 658 | G3083 | *Nicotiana* sp. | gi19680 | | 7.30E−13 |
| 658 | G3083 | *Glycine max* | gi7488719 | | 5.10E−11 |

Table 8 lists sequences discovered to be paralogous to a number of transcription factors of the present invention. The columns headings include, from left to right, the *Arabidopsis* SEQ ID NO; corresponding *Arabidopsis* Gene ID (GID) numbers; the GID numbers of the paralogs discovered in a database search; and the SEQ ID NOs assigned to the paralogs.

TABLE 8

*Arabidopsis* Transcription Factor Genes and Paralogs

| Table 8: *Arabidopsis* Transcription Factor SEQ ID NO: | *Arabidopsis* TF GID No | Paralog GID No. | Paralog Nucleotide SEQ ID NO: |
|---|---|---|---|
| 7 | G30 | G1791 | 1461 |
|   |   | G1792 | 1463 |
|   |   | G1795 | 1465 |
| 11 | G47 | G2133 | 1495 |
| 39 | G148 | G142 | 33 |
| 43 | G153 | G152 | 1365 |
|   |   | G1760 | 1459 |
|   |   | G860 | 1419 |
| 105 | G485 | G1364 | 1439 |
|   |   | G2345 | 1501 |
|   |   | G481 | 1395 |
|   |   | G482 | 1397 |
| 121 | G627 | G149 | 1363 |
| 161 | G975 | G1387 | 1443 |
|   |   | G2583 | 1515 |
| 163 | G1011 | G154 | 1367 |
| 207 | G1357 | G1452 | 1451 |
|   |   | G512 | 1401 |
| 225 | G1452 | G1357 | 1437 |
|   |   | G512 | 1401 |
| 233 | G1482 | G1888 | 1477 |
| 277 | G1792 | G1791 | 1461 |
|   |   | G1795 | 1465 |
|   |   | G30 | 7 |
| 281 | G1797 | G1798 | 283 |
| 283 | G1798 | G1797 | 281 |
| 287 | G1816 | G225 | 1375 |
|   |   | G226 | 1377 |
|   |   | G2718 | 507 |
|   |   | G682 | 1407 |
| 303 | G1863 | G2334 | 1499 |
| 341 | G2041 | G2882 | 1537 |
| 371 | G2207 | G2199 | 1497 |
| 393 | G2334 | G1863 | 303 |
| 505 | G2717 | G204 | 1373 |
|   |   | G2709 | 1525 |
| 507 | G2718 | G1816 | 287 |
|   |   | G225 | 1375 |
|   |   | G226 | 1377 |
|   |   | G682 | 1407 |
| 511 | G2741 | G1435 | 1449 |
| 593 | G2933 | G2928 | 1539 |
|   |   | G2932 | 1541 |
| 607 | G2979 | G2980 | 1547 |
| 609 | G2981 | G2982 | 1551 |
| 611 | G2982 | G2981 | 1549 |
| 615 | G2990 | G2989 | 1553 |

Table 9 lists the gene identification number (GID) and relationships for homologous (found using analyses according to Example IX) and variant sequences for the sequences of the Sequence Listing. Table 9. Similarity relationships found within the Sequence Listing

TABLE 9

Similarity relationships found within the Sequence Listing

| Table 9: SEQ ID NO: | GID | DNA or Protein (PRT) | Species from which Sequence is Derived | Relationship |
|---|---|---|---|---|
| 685 |   | DNA | *Glycine max* | Predicted polypeptide sequence is orthologous to G30, G1792 |
| 686 |   | DNA | *Glycine max* | Predicted polypeptide sequence is orthologous to G30, G1792 |
| 687 |   | DNA | *Glycine max* | Predicted polypeptide sequence is orthologous to G30, G1792 |
| 688 |   | DNA | *Glycine max* | Predicted polypeptide sequence is orthologous to G30, G1792 |
| 689 |   | DNA | *Glycine max* | Predicted polypeptide sequence is orthologous to G30, G1792 |
| 690 |   | PRT | *Oryza sativa* | Orthologous to G30, G1792 |
| 691 |   | DNA | *Zea mays* | Predicted polypeptide sequence is orthologous to G30, G1792 |
| 702 |   | DNA | *Glycine max* | Predicted polypeptide sequence is orthologous to G47 |
| 703 |   | PRT | *Oryza sativa* | Orthologous to G47 |
| 704 |   | DNA | *Glycine max* | Predicted polypeptide sequence is orthologous to G148 |
| 705 |   | DNA | *Glycine max* | Predicted polypeptide sequence is orthologous to G148 |
| 706 |   | DNA | *Oryza sativa* | Predicted polypeptide sequence is orthologous to G148 |
| 707 |   | PRT | *Oryza sativa* | Orthologous to G148 |
| 708 |   | DNA | *Zea mays* | Predicted polypeptide sequence is orthologous to G148 |
| 709 |   | DNA | *Zea mays* | Predicted polypeptide sequence is orthologous to G148 |
| 710 |   | DNA | *Zea mays* | Predicted polypeptide sequence is orthologous to G148 |
| 711 |   | DNA | *Zea mays* | Predicted polypeptide sequence is orthologous to G148 |
| 712 |   | DNA | *Zea mays* | Predicted polypeptide sequence is orthologous to G148 |
| 713 |   | DNA | *Glycine max* | Predicted polypeptide sequence is orthologous to G153 |
| 714 |   | DNA | *Glycine max* | Predicted polypeptide sequence is orthologous to G153 |
| 715 |   | PRT | *Oryza sativa* | Orthologous to G153 |
| 716 |   | DNA | *Zea mays* | Predicted polypeptide sequence is orthologous to G153 |
| 717 |   | DNA | *Zea mays* | Predicted polypeptide sequence is orthologous to G153 |
| 718 |   | DNA | *Zea mays* | Predicted polypeptide sequence is orthologous to G153 |
| 798 |   | DNA | *Glycine max* | Predicted polypeptide sequence is orthologous to G485 |

TABLE 9-continued

Similarity relationships found within the Sequence Listing

| Table 9: SEQ ID NO: | GID | DNA or Protein (PRT) | Species from which Sequence is Derived | Relationship |
|---|---|---|---|---|
| 799 | | DNA | Glycine max | Predicted polypeptide sequence is orthologous to G485 |
| 800 | | DNA | Glycine max | Predicted polypeptide sequence is orthologous to G485 |
| 801 | | DNA | Glycine max | Predicted polypeptide sequence is orthologous to G485 |
| 802 | | DNA | Glycine max | Predicted polypeptide sequence is orthologous to G485 |
| 803 | | DNA | Glycine max | Predicted polypeptide sequence is orthologous to G485 |
| 804 | | DNA | Glycine max | Predicted polypeptide sequence is orthologous to G485 |
| 805 | | DNA | Glycine max | Predicted polypeptide sequence is orthologous to G485 |
| 806 | | DNA | Glycine max | Predicted polypeptide sequence is orthologous to G485 |
| 807 | | PRT | Oryza sativa | Orthologous to G485 |
| 808 | | PRT | Oryza sativa | Orthologous to G485 |
| 809 | | PRT | Oryza sativa | Orthologous to G485 |
| 810 | | PRT | Oryza sativa | Orthologous to G485 |
| 811 | | PRT | Oryza sativa | Orthologous to G485 |
| 812 | | DNA | Oryza sativa | Predicted polypeptide sequence is orthologous to G485 |
| 813 | | DNA | Zea mays | Predicted polypeptide sequence is orthologous to G485 |
| 814 | | DNA | Zea mays | Predicted polypeptide sequence is orthologous to G485 |
| 815 | | DNA | Zea mays | Predicted polypeptide sequence is orthologous to G485 |
| 816 | | DNA | Zea mays | Predicted polypeptide sequence is orthologous to G485 |
| 817 | | DNA | Zea mays | Predicted polypeptide sequence is orthologous to G485 |
| 818 | | DNA | Zea mays | Predicted polypeptide sequence is orthologous to G485 |
| 819 | | DNA | Zea mays | Predicted polypeptide sequence is orthologous to G485 |
| 820 | | DNA | Zea mays | Predicted polypeptide sequence is orthologous to G485 |
| 821 | | DNA | Zea mays | Predicted polypeptide sequence is orthologous to G485 |
| 822 | | DNA | Glycine max | Predicted polypeptide sequence is orthologous to G627 |
| 823 | | DNA | Glycine max | Predicted polypeptide sequence is orthologous to G627 |
| 824 | | DNA | Oryza sativa | Predicted polypeptide sequence is orthologous to G627 |
| 902 | | DNA | Glycine max | Predicted polypeptide sequence is orthologous to G975 |
| 903 | | DNA | Glycine max | Predicted polypeptide sequence is orthologous to G975 |
| 904 | | DNA | Glycine max | Predicted polypeptide sequence is orthologous to G975 |
| 905 | | DNA | Glycine max | Predicted polypeptide sequence is orthologous to G975 |
| 906 | | DNA | Glycine max | Predicted polypeptide sequence is orthologous to G975 |
| 907 | | DNA | Oryza sativa | Predicted polypeptide sequence is orthologous to G975 |
| 908 | | PRT | Oryza sativa | Orthologous to G975 |
| 909 | | DNA | Oryza sativa | Predicted polypeptide sequence is orthologous to G975 |
| 910 | | DNA | Zea mays | Predicted polypeptide sequence is orthologous to G975 |
| 911 | | DNA | Zea mays | Predicted polypeptide sequence is orthologous to G975 |
| 912 | | DNA | Glycine max | Predicted polypeptide sequence is orthologous to G1011 |
| 913 | | DNA | Glycine max | Predicted polypeptide sequence is orthologous to G1011 |
| 914 | | DNA | Glycine max | Predicted polypeptide sequence is orthologous to G1011 |
| 915 | | DNA | Glycine max | Predicted polypeptide sequence is orthologous to G1011 |
| 916 | | DNA | Glycine max | Predicted polypeptide sequence is orthologous to G1011 |
| 917 | | DNA | Glycine max | Predicted polypeptide sequence is orthologous to G1011 |
| 918 | | DNA | Oryza sativa | Predicted polypeptide sequence is orthologous to G1011 |
| 919 | | PRT | Oryza sativa | Orthologous to G1011 |
| 920 | | DNA | Zea mays | Predicted polypeptide sequence is orthologous to G1011 |
| 921 | | DNA | Zea mays | Predicted polypeptide sequence is orthologous to G1011 |
| 922 | | DNA | Zea mays | Predicted polypeptide sequence is orthologous to G1011 |
| 923 | | DNA | Zea mays | Predicted polypeptide sequence is orthologous to G1011 |
| 924 | | DNA | Zea mays | Predicted polypeptide sequence is orthologous to G1011 |
| 968 | | DNA | Glycine max | Predicted polypeptide sequence is orthologous to G1274 |
| 969 | | DNA | Glycine max | Predicted polypeptide sequence is orthologous to G1274 |
| 970 | | PRT | Oryza sativa | Orthologous to G1274 |
| 971 | | PRT | Oryza sativa | Orthologous to G1274 |
| 972 | | DNA | Zea mays | Predicted polypeptide sequence is orthologous to G1274 |
| 973 | | DNA | Zea mays | Predicted polypeptide sequence is orthologous to G1274 |
| 974 | | DNA | Zea mays | Predicted polypeptide sequence is orthologous to G1274 |
| 975 | | DNA | Zea mays | Predicted polypeptide sequence is orthologous to G1274 |
| 982 | | DNA | Glycine max | Predicted polypeptide sequence is orthologous to G1357, G1452 |
| 1014 | | DNA | Glycine max | Predicted polypeptide sequence is orthologous to G1482 |
| 1015 | | DNA | Glycine max | Predicted polypeptide sequence is orthologous to G1482 |
| 1016 | | DNA | Glycine max | Predicted polypeptide sequence is orthologous to G1482 |
| 1017 | | DNA | Glycine max | Predicted polypeptide sequence is orthologous to G1482 |
| 1018 | | DNA | Glycine max | Predicted polypeptide sequence is orthologous to G1482 |
| 1019 | | DNA | Oryza sativa | Predicted polypeptide sequence is orthologous to G1482 |
| 1020 | | DNA | Oryza sativa | Predicted polypeptide sequence is orthologous to G1482 |
| 1021 | | DNA | Oryza sativa | Predicted polypeptide sequence is orthologous to G1482 |
| 1022 | | DNA | Oryza sativa | Predicted polypeptide sequence is orthologous to G1482 |
| 1023 | | PRT | Oryza sativa | Orthologous to G1482 |
| 1024 | | PRT | Oryza sativa | Orthologous to G1482 |
| 1025 | | DNA | Zea mays | Predicted polypeptide sequence is orthologous to G1482 |
| 1026 | | DNA | Zea mays | Predicted polypeptide sequence is orthologous to G1482 |
| 1027 | | DNA | Zea mays | Predicted polypeptide sequence is orthologous to G1482 |
| 1028 | | DNA | Zea mays | Predicted polypeptide sequence is orthologous to G1482 |

TABLE 9-continued

Similarity relationships found within the Sequence Listing

| Table 9: SEQ ID NO: | GID | DNA or Protein (PRT) | Species from which Sequence is Derived | Relationship |
|---|---|---|---|---|
| 1029 | | DNA | Zea mays | Predicted polypeptide sequence is orthologous to G1482 |
| 1030 | | DNA | Zea mays | Predicted polypeptide sequence is orthologous to G1482 |
| 1031 | | DNA | Oryza sativa | Predicted polypeptide sequence is orthologous to G1510 |
| 1032 | | PRT | Oryza sativa | Orthologous to G1510 |
| 1036 | | DNA | Glycine max | Predicted polypeptide sequence is orthologous to G1660 |
| 1037 | | DNA | Glycine max | Predicted polypeptide sequence is orthologous to G1660 |
| 1038 | | DNA | Oryza sativa | Predicted polypeptide sequence is orthologous to G1660 |
| 1039 | | DNA | Oryza sativa | Predicted polypeptide sequence is orthologous to G1660 |
| 1040 | | PRT | Oryza sativa | Orthologous to G1660 |
| 1041 | | PRT | Oryza sativa | Orthologous to G1660 |
| 1042 | | PRT | Oryza sativa | Orthologous to G1660 |
| 1043 | | DNA | Zea mays | Predicted polypeptide sequence is orthologous to G1660 |
| 1044 | | DNA | Zea mays | Predicted polypeptide sequence is orthologous to G1660 |
| 1045 | | DNA | Zea mays | Predicted polypeptide sequence is orthologous to G1660 |
| 1046 | | DNA | Zea mays | Predicted polypeptide sequence is orthologous to G1660 |
| 1047 | | DNA | Zea mays | Predicted polypeptide sequence is orthologous to G1660 |
| 1048 | | DNA | Zea mays | Predicted polypeptide sequence is orthologous to G1730 |
| 1051 | | DNA | Glycine max | Predicted polypeptide sequence is orthologous to G1779 |
| 1052 | | DNA | Glycine max | Predicted polypeptide sequence is orthologous to G1779 |
| 1053 | | DNA | Glycine max | Predicted polypeptide sequence is orthologous to G1779 |
| 1054 | | PRT | Oryza sativa | Orthologous to G1779 |
| 1055 | | DNA | Zea mays | Predicted polypeptide sequence is orthologous to G1779 |
| 1057 | | DNA | Glycine max | Predicted polypeptide sequence is orthologous to G1816, G2718 |
| 1058 | | DNA | Glycine max | Predicted polypeptide sequence is orthologous to G1816, G2718 |
| 1059 | | DNA | Glycine max | Predicted polypeptide sequence is orthologous to G1816, G2718 |
| 1060 | | DNA | Glycine max | Predicted polypeptide sequence is orthologous to G1816, G2718 |
| 1061 | | DNA | Glycine max | Predicted polypeptide sequence is orthologous to G1816, G2718 |
| 1062 | | DNA | Oryza sativa | Predicted polypeptide sequence is orthologous to G1816 |
| 1063 | | DNA | Oryza sativa | Predicted polypeptide sequence is orthologous to G1816, G2718 |
| 1064 | | PRT | Oryza sativa | Orthologous to G1816, G2718 |
| 1065 | | PRT | Oryza sativa | Orthologous to G1816, G2718 |
| 1066 | | DNA | Zea mays | Predicted polypeptide sequence is orthologous to G1816, G2718 |
| 1067 | | DNA | Zea mays | Predicted polypeptide sequence is orthologous to G1816, G2718 |
| 1098 | | DNA | Glycine max | Predicted polypeptide sequence is orthologous to G1988 |
| 1099 | | DNA | Glycine max | Predicted polypeptide sequence is orthologous to G1988 |
| 1100 | | DNA | Oryza sativa | Predicted polypeptide sequence is orthologous to G1988 |
| 1101 | | DNA | Zea mays | Predicted polypeptide sequence is orthologous to G1988 |
| 1102 | | DNA | Zea mays | Predicted polypeptide sequence is orthologous to G1988 |
| 1103 | | DNA | Zea mays | Predicted polypeptide sequence is orthologous to G1988 |
| 1104 | | DNA | Zea mays | Predicted polypeptide sequence is orthologous to G1988 |
| 1105 | | DNA | Glycine max | Predicted polypeptide sequence is orthologous to G2041 |
| 1106 | | DNA | Glycine max | Predicted polypeptide sequence is orthologous to G2041 |
| 1107 | | DNA | Oryza sativa | Predicted polypeptide sequence is orthologous to G2041 |
| 1116 | | DNA | Glycine max | Predicted polypeptide sequence is orthologous to G2142 |
| 1117 | | DNA | Glycine max | Predicted polypeptide sequence is orthologous to G2142 |
| 1118 | | DNA | Glycine max | Predicted polypeptide sequence is orthologous to G2142 |
| 1119 | | DNA | Glycine max | Predicted polypeptide sequence is orthologous to G2142 |
| 1120 | | DNA | Glycine max | Predicted polypeptide sequence is orthologous to G2142 |
| 1121 | | DNA | Glycine max | Predicted polypeptide sequence is orthologous to G2142 |
| 1122 | | DNA | Oryza sativa | Predicted polypeptide sequence is orthologous to G2142 |
| 1123 | | DNA | Oryza sativa | Predicted polypeptide sequence is orthologous to G2142 |
| 1124 | | DNA | Zea mays | Predicted polypeptide sequence is orthologous to G2142 |
| 1209 | | DNA | Glycine max | Predicted polypeptide sequence is orthologous to G2717 |
| 1210 | | DNA | Glycine max | Predicted polypeptide sequence is orthologous to G2717 |
| 1211 | | DNA | Glycine max | Predicted polypeptide sequence is orthologous to G2717 |
| 1212 | | DNA | Glycine max | Predicted polypeptide sequence is orthologous to G2717 |
| 1213 | | DNA | Glycine max | Predicted polypeptide sequence is orthologous to G2717 |
| 1214 | | DNA | Glycine max | Predicted polypeptide sequence is orthologous to G2717 |
| 1215 | | DNA | Glycine max | Predicted polypeptide sequence is orthologous to G2717 |
| 1216 | | DNA | Oryza sativa | Predicted polypeptide sequence is orthologous to G2717 |
| 1217 | | DNA | Oryza sativa | Predicted polypeptide sequence is orthologous to G2717 |
| 1218 | | DNA | Oryza sativa | Predicted polypeptide sequence is orthologous to G2717 |
| 1219 | | PRT | Oryza sativa | Orthologous to G2717 |
| 1220 | | PRT | Oryza sativa | Orthologous to G2717 |
| 1221 | | PRT | Oryza sativa | Orthologous to G2717 |
| 1222 | | DNA | Zea mays | Predicted polypeptide sequence is orthologous to G2717 |

TABLE 9-continued

Similarity relationships found within the Sequence Listing

| Table 9: SEQ ID NO: | GID | DNA or Protein (PRT) | Species from which Sequence is Derived | Relationship |
|---|---|---|---|---|
| 1223 | | DNA | Zea mays | Predicted polypeptide sequence is orthologous to G2717 |
| 1224 | | DNA | Zea mays | Predicted polypeptide sequence is orthologous to G2717 |
| 1225 | | DNA | Zea mays | Predicted polypeptide sequence is orthologous to G2717 |
| 1226 | | DNA | Zea mays | Predicted polypeptide sequence is orthologous to G2717 |
| 1227 | | DNA | Zea mays | Predicted polypeptide sequence is orthologous to G2717 |
| 1229 | | DNA | Glycine max | Predicted polypeptide sequence is orthologous to G2741 |
| 1230 | | DNA | Glycine max | Predicted polypeptide sequence is orthologous to G2741 |
| 1231 | | DNA | Glycine max | Predicted polypeptide sequence is orthologous to G2741 |
| 1232 | | PRT | Oryza sativa | Orthologous to G2741 |
| 1233 | | PRT | Oryza sativa | Orthologous to G2741 |
| 1234 | | DNA | Oryza sativa | Predicted polypeptide sequence is orthologous to G2741 |
| 1235 | | DNA | Oryza sativa | Predicted polypeptide sequence is orthologous to G2741 |
| 1236 | | DNA | Zea mays | Predicted polypeptide sequence is orthologous to G2741 |
| 1314 | | DNA | Glycine max | Predicted polypeptide sequence is orthologous to G2933 |
| 1315 | | PRT | Oryza sativa | Orthologous to G2933 |
| 1316 | | DNA | Zea mays | Predicted polypeptide sequence is orthologous to G2933 |
| 1318 | | DNA | Glycine max | Predicted polypeptide sequence is orthologous to G2981, G2982 |
| 1319 | | DNA | Glycine max | Predicted polypeptide sequence is orthologous to G2981, G2982 |
| 1320 | | DNA | Glycine max | Predicted polypeptide sequence is orthologous to G2981, G2982 |
| 1321 | | DNA | Glycine max | Predicted polypeptide sequence is orthologous to G2981, G2982 |
| 1322 | | DNA | Glycine max | Predicted polypeptide sequence is orthologous to G2981, G2982 |
| 1323 | | DNA | Glycine max | Predicted polypeptide sequence is orthologous to G2981, G2982 |
| 1324 | | DNA | Glycine max | Predicted polypeptide sequence is orthologous to G2981 |
| 1325 | | DNA | Glycine max | Predicted polypeptide sequence is orthologous to G2981, G2982 |
| 1326 | | DNA | Glycine max | Predicted polypeptide sequence is orthologous to G2981, G2982 |
| 1327 | | DNA | Oryza sativa | Predicted polypeptide sequence is orthologous to G2981, G2982 |
| 1334 | | PRT | Oryza sativa | Orthologous to G2990 |
| 1335 | | DNA | Zea mays | Predicted polypeptide sequence is orthologous to G2990 |
| 1336 | | DNA | Zea mays | Predicted polypeptide sequence is orthologous to G2990 |
| 1346 | | DNA | Oryza sativa | Predicted polypeptide sequence is orthologous to G3083 |
| 1353 | G30 | DNA | Arabidopsis thaliana | Predicted polypeptide sequence is paralogous to G1792 |
| 1354 | G30 | PRT | Arabidopsis thaliana | Paralogous to G1792 |
| 1361 | G142 | DNA | Arabidopsis thaliana | Predicted polypeptide sequence is paralogous to G148 |
| 1362 | G142 | PRT | Arabidopsis thaliana | Paralogous to G148 |
| 1363 | G149 | DNA | Arabidopsis thaliana | Predicted polypeptide sequence is paralogous to G627 |
| 1364 | G149 | PRT | Arabidopsis thaliana | Paralogous to G627 |
| 1365 | G152 | DNA | Arabidopsis thaliana | Predicted polypeptide sequence is paralogous to G153 |
| 1366 | G152 | PRT | Arabidopsis thaliana | Paralogous to G153 |
| 1367 | G154 | DNA | Arabidopsis thaliana | Predicted polypeptide sequence is paralogous to G1011 |
| 1368 | G154 | PRT | Arabidopsis thaliana | Paralogous to G1011 |
| 1373 | G204 | DNA | Arabidopsis thaliana | Predicted polypeptide sequence is paralogous to G2717 |
| 1374 | G204 | PRT | Arabidopsis thaliana | Paralogous to G2717 |
| 1375 | G225 | DNA | Arabidopsis thaliana | Predicted polypeptide sequence is paralogous to G1816, G2718 |
| 1376 | G225 | PRT | Arabidopsis thaliana | Paralogous to G1816, G2718 |
| 1377 | G226 | DNA | Arabidopsis thaliana | Predicted polypeptide sequence is paralogous to G1816, G2718 |
| 1378 | G226 | PRT | Arabidopsis thaliana | Paralogous to G1816, G2718 |
| 1395 | G481 | DNA | Arabidopsis thaliana | Predicted polypeptide sequence is paralogous to G485 |
| 1396 | G481 | PRT | Arabidopsis thaliana | Paralogous to G485 |
| 1397 | G482 | DNA | Arabidopsis thaliana | Predicted polypeptide sequence is paralogous to G485 |
| 1398 | G482 | PRT | Arabidopsis thaliana | Paralogous to G485 |
| 1401 | G512 | DNA | Arabidopsis thaliana | Predicted polypeptide sequence is paralogous to G1357, G1452 |
| 1402 | G512 | PRT | Arabidopsis thaliana | Paralogous to G1357, G1452 |
| 1407 | G682 | DNA | Arabidopsis thaliana | Predicted polypeptide sequence is paralogous to G1816, G2718 |
| 1408 | G682 | PRT | Arabidopsis thaliana | Paralogous to G1816, G2718 |
| 1419 | G860 | DNA | Arabidopsis thaliana | Predicted polypeptide sequence is paralogous to G153 |
| 1420 | G860 | PRT | Arabidopsis thaliana | Paralogous to G153 |
| 1437 | G1357 | DNA | Arabidopsis thaliana | Predicted polypeptide sequence is paralogous to G1452 |
| 1438 | G1357 | PRT | Arabidopsis thaliana | Paralogous to G1452 |
| 1439 | G1364 | DNA | Arabidopsis thaliana | Predicted polypeptide sequence is paralogous to G485 |
| 1440 | G1364 | PRT | Arabidopsis thaliana | Paralogous to G485 |
| 1443 | G1387 | DNA | Arabidopsis thaliana | Predicted polypeptide sequence is paralogous to G975 |

TABLE 9-continued

Similarity relationships found within the Sequence Listing

| Table 9: SEQ ID NO: | GID | DNA or Protein (PRT) | Species from which Sequence is Derived | Relationship |
|---|---|---|---|---|
| 1444 | G1387 | PRT | Arabidopsis thaliana | Paralogous to G975 |
| 1449 | G1435 | DNA | Arabidopsis thaliana | Predicted polypeptide sequence is paralogous to G2741 |
| 1450 | G1435 | PRT | Arabidopsis thaliana | Paralogous to G2741 |
| 1451 | G1452 | DNA | Arabidopsis thaliana | Predicted polypeptide sequence is paralogous to G1357 |
| 1452 | G1452 | PRT | Arabidopsis thaliana | Paralogous to G1357 |
| 1459 | G1760 | DNA | Arabidopsis thaliana | Predicted polypeptide sequence is paralogous to G153 |
| 1460 | G1760 | PRT | Arabidopsis thaliana | Paralogous to G153 |
| 1461 | G1791 | DNA | Arabidopsis thaliana | Predicted polypeptide sequence is paralogous to G30, G1792 |
| 1462 | G1791 | PRT | Arabidopsis thaliana | Paralogous to G30, G1792 |
| 1463 | G1792 | DNA | Arabidopsis thaliana | Predicted polypeptide sequence is paralogous to G30 |
| 1464 | G1792 | PRT | Arabidopsis thaliana | Paralogous to G30 |
| 1465 | G1795 | DNA | Arabidopsis thaliana | Predicted polypeptide sequence is paralogous to G30, G1792 |
| 1466 | G1795 | PRT | Arabidopsis thaliana | Paralogous to G30, G1792 |
| 1467 | G1797 | DNA | Arabidopsis thaliana | Predicted polypeptide sequence is paralogous to G1798 |
| 1468 | G1797 | PRT | Arabidopsis thaliana | Paralogous to G1798 |
| 1469 | G1798 | DNA | Arabidopsis thaliana | Predicted polypeptide sequence is paralogous to G1797 |
| 1470 | G1798 | PRT | Arabidopsis thaliana | Paralogous to G1797 |
| 1471 | G1816 | DNA | Arabidopsis thaliana | Predicted polypeptide sequence is paralogous to G2718 |
| 1472 | G1816 | PRT | Arabidopsis thaliana | Paralogous to G2718 |
| 1475 | G1863 | DNA | Arabidopsis thaliana | Predicted polypeptide sequence is paralogous to G2334 |
| 1476 | G1863 | PRT | Arabidopsis thaliana | Paralogous to G2334 |
| 1477 | G1888 | DNA | Arabidopsis thaliana | Predicted polypeptide sequence is paralogous to G1482 |
| 1478 | G1888 | PRT | Arabidopsis thaliana | Paralogous to G1482 |
| 1495 | G2133 | DNA | Arabidopsis thaliana | Predicted polypeptide sequence is paralogous to G47 |
| 1496 | G2133 | PRT | Arabidopsis thaliana | Paralogous to G47 |
| 1497 | G2199 | DNA | Arabidopsis thaliana | Predicted polypeptide sequence is paralogous to G2207 |
| 1498 | G2199 | PRT | Arabidopsis thaliana | Paralogous to G2207 |
| 1499 | G2334 | DNA | Arabidopsis thaliana | Predicted polypeptide sequence is paralogous to G1863 |
| 1500 | G2334 | PRT | Arabidopsis thaliana | Paralogous to G1863 |
| 1501 | G2345 | DNA | Arabidopsis thaliana | Predicted polypeptide sequence is paralogous to G485 |
| 1502 | G2345 | PRT | Arabidopsis thaliana | Paralogous to G485 |
| 1515 | G2583 | DNA | Arabidopsis thaliana | Predicted polypeptide sequence is paralogous to G975 |
| 1516 | G2583 | PRT | Arabidopsis thaliana | Paralogous to G975 |
| 1525 | G2709 | DNA | Arabidopsis thaliana | Predicted polypeptide sequence is paralogous to G2717 |
| 1526 | G2709 | PRT | Arabidopsis thaliana | Paralogous to G2717 |
| 1527 | G2718 | DNA | Arabidopsis thaliana | Predicted polypeptide sequence is paralogous to G1816 |
| 1528 | G2718 | PRT | Arabidopsis thaliana | Paralogous to G1816 |
| 1537 | G2882 | DNA | Arabidopsis thaliana | Predicted polypeptide sequence is paralogous to G2041 |
| 1538 | G2882 | PRT | Arabidopsis thaliana | Paralogous to G2041 |
| 1539 | G2928 | DNA | Arabidopsis thaliana | Predicted polypeptide sequence is paralogous to G2933 |
| 1540 | G2928 | PRT | Arabidopsis thaliana | Paralogous to G2933 |
| 1541 | G2932 | DNA | Arabidopsis thaliana | Predicted polypeptide sequence is paralogous to G2933 |
| 1542 | G2932 | PRT | Arabidopsis thaliana | Paralogous to G2933 |
| 1547 | G2980 | DNA | Arabidopsis thaliana | Predicted polypeptide sequence is paralogous to G2979 |
| 1548 | G2980 | PRT | Arabidopsis thaliana | Paralogous to G2979 |
| 1549 | G2981 | DNA | Arabidopsis thaliana | Predicted polypeptide sequence is paralogous to G2982 |
| 1550 | G2981 | PRT | Arabidopsis thaliana | Paralogous to G2982 |
| 1551 | G2982 | DNA | Arabidopsis thaliana | Predicted polypeptide sequence is paralogous to G2981 |
| 1552 | G2982 | PRT | Arabidopsis thaliana | Paralogous to G2981 |
| 1553 | G2989 | DNA | Arabidopsis thaliana | Predicted polypeptide sequence is paralogous to G2990 |
| 1554 | G2989 | PRT | Arabidopsis thaliana | Paralogous to G2990 |
| 1559 | | DNA | Oryza sativa | Predicted polypeptide sequence is orthologous to G30 |
| 1560 | | DNA | Oryza sativa | Predicted polypeptide sequence is orthologous to G148 |
| 1561 | | DNA | Oryza sativa | Predicted polypeptide sequence is orthologous to G148 |
| 1562 | | DNA | Oryza sativa | Predicted polypeptide sequence is orthologous to G148 |
| 1575 | | DNA | Oryza sativa | Predicted polypeptide sequence is orthologous to G627 |
| 1581 | | DNA | Oryza sativa | Predicted polypeptide sequence is orthologous to G1011 |
| 1592 | | DNA | Oryza sativa | Predicted polypeptide sequence is orthologous to G1482 |
| 1593 | | DNA | Oryza sativa | Predicted polypeptide sequence is orthologous to G1660 |
| 1601 | | DNA | Oryza sativa | Predicted polypeptide sequence is orthologous to G1988 |
| 1605 | | DNA | Oryza sativa | Predicted polypeptide sequence is orthologous to G2207 |
| 1606 | | DNA | Oryza sativa | Predicted polypeptide sequence is orthologous to G2207 |
| 1614 | | DNA | Oryza sativa | Predicted polypeptide sequence is orthologous to G2717 |
| 1624 | | DNA | Oryza sativa | Predicted polypeptide sequence is orthologous to G2933 |
| 1626 | | DNA | Oryza sativa | Predicted polypeptide sequence is orthologous to G2981 |
| 1628 | | DNA | Oryza sativa | Predicted polypeptide sequence is orthologous to G2990 |
| 1630 | | DNA | Oryza sativa | Predicted polypeptide sequence is orthologous to G3076 |
| 1631 | | DNA | Oryza sativa | Predicted polypeptide sequence is orthologous to G3083 |
| 1633 | | DNA | Glycine max | Predicted polypeptide sequence is orthologous to G30, G1792 |
| 1634 | | DNA | Glycine max | Predicted polypeptide sequence is orthologous to G153 |
| 1641 | | DNA | Glycine max | Predicted polypeptide sequence is orthologous to G485 |

TABLE 9-continued

Similarity relationships found within the Sequence Listing

| Table 9: SEQ ID NO: GID | DNA or Protein (PRT) | Species from which Sequence is Derived | Relationship |
|---|---|---|---|
| 1651 | DNA | *Glycine max* | Predicted polypeptide sequence is orthologous to G1011 |
| 1662 | DNA | *Glycine max* | Predicted polypeptide sequence is orthologous to G1510 |
| 1663 | DNA | *Glycine max* | Predicted polypeptide sequence is orthologous to G1816, G2718 |
| 1666 | DNA | *Glycine max* | Predicted polypeptide sequence is orthologous to G2142 |
| 1667 | DNA | *Glycine max* | Predicted polypeptide sequence is orthologous to G2207 |
| 1670 | DNA | *Glycine max* | Predicted polypeptide sequence is orthologous to G2717 |
| 1671 | DNA | *Glycine max* | Predicted polypeptide sequence is orthologous to G2741 |
| 1683 | DNA | *Glycine max* | Predicted polypeptide sequence is orthologous to G2981 |
| 1685 | DNA | *Glycine max* | Predicted polypeptide sequence is orthologous to G2990 |
| 1687 | DNA | *Glycine max* | Predicted polypeptide sequence is orthologous to G3083 |
| 1695 | DNA | *Medicago truncatula* | Predicted polypeptide sequence is orthologous to G627 |
| 1696 | DNA | *Medicago truncatula* | Predicted polypeptide sequence is orthologous to G1011 |
| 1703 | DNA | *Medicago truncatula* | Predicted polypeptide sequence is orthologous to G1482 |
| 1708 | DNA | *Medicago truncatula* | Predicted polypeptide sequence is orthologous to G2142 |
| 1715 | DNA | *Medicago truncatula* | Predicted polypeptide sequence is orthologous to G2990 |
| 1718 | DNA | *Hordeum vulgare* | Predicted polypeptide sequence is orthologous to G47 |
| 1725 | DNA | *Hordeum vulgare* | Predicted polypeptide sequence is orthologous to G485 |
| 1726 | DNA | *Hordeum vulgare* | Predicted polypeptide sequence is orthologous to G485 |
| 1727 | DNA | *Hordeum vulgare* | Predicted polypeptide sequence is orthologous to G627 |
| 1733 | DNA | *Hordeum vulgare* | Predicted polypeptide sequence is orthologous to G975 |
| 1744 | DNA | *Hordeum vulgare* | Predicted polypeptide sequence is orthologous to G2717 |
| 1745 | DNA | *Hordeum vulgare* | Predicted polypeptide sequence is orthologous to G2741 |
| 1753 | DNA | *Hordeum vulgare* | Predicted polypeptide sequence is orthologous to G3083 |
| 1754 | DNA | *Zea mays* | Predicted polypeptide sequence is orthologous to G30, G1792 |
| 1755 | DNA | *Zea mays* | Predicted polypeptide sequence is orthologous to G148 |
| 1756 | DNA | *Zea mays* | Predicted polypeptide sequence is orthologous to G148 |
| 1757 | DNA | *Zea mays* | Predicted polypeptide sequence is orthologous to G153 |
| 1758 | DNA | *Zea mays* | Predicted polypeptide sequence is orthologous to G153 |
| 1776 | DNA | *Zea mays* | Predicted polypeptide sequence is orthologous to G485 |
| 1777 | DNA | *Zea mays* | Predicted polypeptide sequence is orthologous to G485 |
| 1778 | DNA | *Zea mays* | Predicted polypeptide sequence is orthologous to G485 |
| 1786 | DNA | *Zea mays* | Predicted polypeptide sequence is orthologous to G1011 |
| 1787 | DNA | *Zea mays* | Predicted polypeptide sequence is orthologous to G1011 |
| 1802 | DNA | *Zea mays* | Predicted polypeptide sequence is orthologous to G1482 |
| 1803 | DNA | *Zea mays* | Predicted polypeptide sequence is orthologous to G1660 |
| 1804 | DNA | *Zea mays* | Predicted polypeptide sequence is orthologous to G1660 |
| 1810 | DNA | *Zea mays* | Predicted polypeptide sequence is orthologous to G2041 |
| 1812 | DNA | *Zea mays* | Predicted polypeptide sequence is orthologous to G2142 |
| 1818 | DNA | *Zea mays* | Predicted polypeptide sequence is orthologous to G2717 |
| 1819 | DNA | *Zea mays* | Predicted polypeptide sequence is orthologous to G2741 |
| 1828 | DNA | *Zea mays* | Predicted polypeptide sequence is orthologous to G2933 |
| 1829 | DNA | *Zea mays* | Predicted polypeptide sequence is orthologous to G2981 |
| 1830 | DNA | *Zea mays* | Predicted polypeptide sequence is orthologous to G2981 |
| 1834 | DNA | *Triticum aestivum* | Predicted polypeptide sequence is orthologous to G30 |
| 1835 | DNA | *Triticum aestivum* | Predicted polypeptide sequence is orthologous to G148 |
| 1846 | DNA | *Triticum aestivum* | Predicted polypeptide sequence is orthologous to G485 |
| 1847 | DNA | *Triticum aestivum* | Predicted polypeptide sequence is orthologous to G485 |
| 1848 | DNA | *Triticum aestivum* | Predicted polypeptide sequence is orthologous to G485 |
| 1849 | DNA | *Triticum aestivum* | Predicted polypeptide sequence is orthologous to G485 |
| 1850 | DNA | *Triticum aestivum* | Predicted polypeptide sequence is orthologous to G627 |
| 1858 | DNA | *Triticum aestivum* | Predicted polypeptide sequence is orthologous to G1011 |
| 1859 | DNA | *Triticum aestivum* | Predicted polypeptide sequence is orthologous to G1011 |
| 1860 | DNA | *Triticum aestivum* | Predicted polypeptide sequence is orthologous to G1011 |
| 1879 | DNA | *Triticum aestivum* | Predicted polypeptide sequence is orthologous to G1482 |
| 1880 | DNA | *Triticum aestivum* | Predicted polypeptide sequence is orthologous to G1510 |
| 1881 | DNA | *Triticum aestivum* | Predicted polypeptide sequence is orthologous to G1660 |
| 1883 | DNA | *Triticum aestivum* | Predicted polypeptide sequence is orthologous to G1816, G2718 |
| 1899 | DNA | *Triticum aestivum* | Predicted polypeptide sequence is orthologous to G2142 |
| 1900 | DNA | *Triticum aestivum* | Predicted polypeptide sequence is orthologous to G2142 |
| 1901 | DNA | *Triticum aestivum* | Predicted polypeptide sequence is orthologous to G2142 |
| 1907 | DNA | *Triticum aestivum* | Predicted polypeptide sequence is orthologous to G2717 |
| 1908 | DNA | *Triticum aestivum* | Predicted polypeptide sequence is orthologous to G2717 |
| 1909 | DNA | *Triticum aestivum* | Predicted polypeptide sequence is orthologous to G2717 |
| 1921 | DNA | *Triticum aestivum* | Predicted polypeptide sequence is orthologous to G2990 |
| 1924 | DNA | *Triticum aestivum* | Predicted polypeptide sequence is orthologous to G3083 |
| 1929 | DNA | *Lycopersicon esculentum* | Predicted polypeptide sequence is orthologous to G1011 |
| 1932 | DNA | *Lycopersicon esculentum* | Predicted polypeptide sequence is orthologous to G1510 |
| 1943 | DNA | *Lycopersicon esculentum* | Predicted polypeptide sequence is orthologous to G148 |
| 1944 | DNA | *Lycopersicon esculentum* | Predicted polypeptide sequence is orthologous to G148 |
| 1945 | DNA | *Lycopersicon esculentum* | Predicted polypeptide sequence is orthologous to G153 |
| 1946 | DNA | *Lycopersicon esculentum* | Predicted polypeptide sequence is orthologous to G153 |

TABLE 9-continued

Similarity relationships found within the Sequence Listing

| Table 9: SEQ ID NO: | GID | DNA or Protein (PRT) | Species from which Sequence is Derived | Relationship |
|---|---|---|---|---|
| 1980 | | DNA | Lycopersicon esculentum | Predicted polypeptide sequence is orthologous to G485 |
| 1981 | | DNA | Lycopersicon esculentum | Predicted polypeptide sequence is orthologous to G485 |
| 1982 | | DNA | Lycopersicon esculentum | Predicted polypeptide sequence is orthologous to G627 |
| 2003 | | DNA | Lycopersicon esculentum | Predicted polypeptide sequence is orthologous to G975 |
| 2004 | | DNA | Lycopersicon esculentum | Predicted polypeptide sequence is orthologous to G975 |
| 2005 | | DNA | Lycopersicon esculentum | Predicted polypeptide sequence is orthologous to G975 |
| 2006 | | DNA | Lycopersicon esculentum | Predicted polypeptide sequence is orthologous to G975 |
| 2007 | | DNA | Lycopersicon esculentum | Predicted polypeptide sequence is orthologous to G1011 |
| 2008 | | DNA | Lycopersicon esculentum | Predicted polypeptide sequence is orthologous to G1011 |
| 2009 | | DNA | Lycopersicon esculentum | Predicted polypeptide sequence is orthologous to G1011 |
| 2010 | | DNA | Lycopersicon esculentum | Predicted polypeptide sequence is orthologous to G1011 |
| 2017 | | DNA | Lycopersicon esculentum | Predicted polypeptide sequence is orthologous to G1274 |
| 2018 | | DNA | Lycopersicon esculentum | Predicted polypeptide sequence is orthologous to G1274 |
| 2020 | | DNA | Lycopersicon esculentum | Predicted polypeptide sequence is orthologous to G1357, G1452 |
| 2032 | | DNA | Lycopersicon esculentum | Predicted polypeptide sequence is orthologous to G1482 |
| 2033 | | DNA | Lycopersicon esculentum | Predicted polypeptide sequence is orthologous to G1510 |
| 2034 | | DNA | Lycopersicon esculentum | Predicted polypeptide sequence is orthologous to G1660 |
| 2035 | | DNA | Lycopersicon esculentum | Predicted polypeptide sequence is orthologous to G1660 |
| 2036 | | DNA | Lycopersicon esculentum | Predicted polypeptide sequence is orthologous to G1779 |
| 2045 | | DNA | Lycopersicon esculentum | Predicted polypeptide sequence is orthologous to G1988 |
| 2046 | | DNA | Lycopersicon esculentum | Predicted polypeptide sequence is orthologous to G2041 |
| 2047 | | DNA | Lycopersicon esculentum | Predicted polypeptide sequence is orthologous to G2041 |
| 2048 | | DNA | Lycopersicon esculentum | Predicted polypeptide sequence is orthologous to G2142 |
| 2049 | | DNA | Lycopersicon esculentum | Predicted polypeptide sequence is orthologous to G2142 |
| 2050 | | DNA | Lycopersicon esculentum | Predicted polypeptide sequence is orthologous to G2142 |
| 2051 | | DNA | Lycopersicon esculentum | Predicted polypeptide sequence is orthologous to G2142 |
| 2052 | | DNA | Lycopersicon esculentum | Predicted polypeptide sequence is orthologous to G2207 |
| 2053 | | DNA | Lycopersicon esculentum | Predicted polypeptide sequence is orthologous to G2207 |
| 2055 | | DNA | Lycopersicon esculentum | Predicted polypeptide sequence is orthologous to G2334 |
| 2068 | | DNA | Lycopersicon esculentum | Predicted polypeptide sequence is orthologous to G2717 |
| 2069 | | DNA | Lycopersicon esculentum | Predicted polypeptide sequence is orthologous to G2717 |
| 2070 | | DNA | Lycopersicon esculentum | Predicted polypeptide sequence is orthologous to G2741 |
| 2071 | | DNA | Lycopersicon esculentum | Predicted polypeptide sequence is orthologous to G2741 |
| 2090 | | DNA | Lycopersicon esculentum | Predicted polypeptide sequence is orthologous to G2933 |
| 2092 | | DNA | Lycopersicon esculentum | Predicted polypeptide sequence is orthologous to G2979 |
| 2093 | | DNA | Lycopersicon esculentum | Predicted polypeptide sequence is orthologous to G2981, G2982 |
| 2095 | | DNA | Lycopersicon esculentum | Predicted polypeptide sequence is orthologous to G2990 |
| 2096 | | DNA | Lycopersicon esculentum | Predicted polypeptide sequence is orthologous to G2990 |
| 2100 | | DNA | Lycopersicon esculentum | Predicted polypeptide sequence is orthologous to G3076 |
| 2101 | | DNA | Lycopersicon esculentum | Predicted polypeptide sequence is orthologous to G3083 |
| 2110 | G2041_1 | DNA | Arabidopsis thaliana | Expression construct P13846 (sequence variant) |
| 2124 | G3380 | DNA | Oryza sativa | Predicted polypeptide sequence is orthologous to G1795 Member of G1792 clade |
| 2125 | G3380 | PRT | Oryza sativa | Orthologous to G1795 Member of G1792 clade |
| 2126 | G3381 | DNA | Oryza sativa | Predicted polypeptide sequence is orthologous to G30 Member of G1792 clade |
| 2127 | G3381 | PRT | Oryza sativa | Orthologous to G30 Member of G1792 clade |
| 2128 | G3383 | DNA | Oryza sativa | Predicted polypeptide sequence is orthologous to G1792 Member of G1792 clade |
| 2129 | G3383 | PRT | Oryza sativa | Orthologous to G1792 Member of G1792 clade |
| 2130 | G3392 | DNA | Oryza sativa | Predicted polypeptide sequence is orthologous to G682 Member of G1816 and G2718 clade |
| 2131 | G3392 | PRT | Oryza sativa | Orthologous to G682 Member of G1816 and G2718 clade |
| 2132 | G3393 | DNA | Oryza sativa | Predicted polypeptide sequence is orthologous to G682 Member of G1816 and G2718 clade |
| 2133 | G3393 | PRT | Oryza sativa | Orthologous to G682 Member of G1816 and G2718 clade |
| 2134 | G3394 | DNA | Oryza sativa | Predicted polypeptide sequence is orthologous to G485 Member of G485 clade |
| 2135 | G3394 | PRT | Oryza sativa | Orthologous to G485 Member of G485 clade |
| 2136 | G3395 | DNA | Oryza sativa | Predicted polypeptide sequence is orthologous to G485 Member of G485 clade |
| 2137 | G3395 | PRT | Oryza sativa | Orthologous to G485 Member of G485 clade |
| 2138 | G3396 | DNA | Oryza sativa | Predicted polypeptide sequence is orthologous to G485 Member of G485 clade |
| 2139 | G3396 | PRT | Oryza sativa | Orthologous to G485 Member of G485 clade |
| 2140 | G3397 | DNA | Oryza sativa | Predicted polypeptide sequence is orthologous to G485 Member of G485 clade |
| 2141 | G3397 | PRT | Oryza sativa | Orthologous to G485 Member of G485 clade |
| 2142 | G3398 | DNA | Oryza sativa | Predicted polypeptide sequence is orthologous to G485 Member of G485 clade |
| 2143 | G3398 | PRT | Oryza sativa | Orthologous to G485 Member of G485 clade |

TABLE 9-continued

Similarity relationships found within the Sequence Listing

| Table 9: SEQ ID NO: | GID | DNA or Protein (PRT) | Species from which Sequence is Derived | Relationship |
|---|---|---|---|---|
| 2144 | G3429 | DNA | Oryza sativa | Predicted polypeptide sequence is orthologous to G485 Member of G485 clade |
| 2145 | G3429 | PRT | Oryza sativa | Orthologous to G485 Member of G485 clade |
| 2146 | G3431 | DNA | Zea mays | Predicted polypeptide sequence is orthologous to G682 Member of G1816 and G2718 clade |
| 2147 | G3431 | PRT | Zea mays | Orthologous to G682 Member of G1816 and G2718 clade |
| 2148 | G3434 | DNA | Zea mays | Predicted polypeptide sequence is orthologous to G485 Member of G485 clade |
| 2149 | G3434 | PRT | Zea mays | Orthologous to G485 Member of G485 clade |
| 2150 | G3435 | DNA | Zea mays | Predicted polypeptide sequence is orthologous to G482 Member of G485 clade |
| 2151 | G3435 | PRT | Zea mays | Orthologous to G482 Member of G485 clade |
| 2152 | G3436 | DNA | Zea mays | Predicted polypeptide sequence is orthologous to G485 Member of G485 clade |
| 2153 | G3436 | PRT | Zea mays | Orthologous to G485 Member of G485 clade |
| 2154 | G3437 | DNA | Zea mays | Predicted polypeptide sequence is orthologous to G485 Member of G485 clade |
| 2155 | G3437 | PRT | Zea mays | Orthologous to G485 Member of G485 clade |
| 2156 | G3444 | DNA | Zea mays | Predicted polypeptide sequence is orthologous to G682 Member of G1816 and G2718 clade |
| 2157 | G3444 | PRT | Zea mays | Orthologous to G682 Member of G1816 and G2718 clade |
| 2158 | G3445 | DNA | Glycine max | Predicted polypeptide sequence is orthologous to G225 Member of G1816 and G2718 clade |
| 2159 | G3445 | PRT | Glycine max | Orthologous to G225 Member of G1816 and G2718 clade |
| 2160 | G3446 | DNA | Glycine max | Predicted polypeptide sequence is orthologous to G225 Member of G1816 and G2718 clade |
| 2161 | G3446 | PRT | Glycine max | Orthologous to G225 Member of G1816 and G2718 clade |
| 2162 | G3447 | DNA | Glycine max | Predicted polypeptide sequence is orthologous to G225 Member of G1816 and G2718 clade |
| 2163 | G3447 | PRT | Glycine max | Orthologous to G225 Member of G1816 and G2718 clade |
| 2164 | G3448 | DNA | Glycine max | Predicted polypeptide sequence is orthologous to G225 Member of G1816 and G2718 clade |
| 2165 | G3448 | PRT | Glycine max | Orthologous to G225 Member of G1816 and G2718 clade |
| 2166 | G3449 | DNA | Glycine max | Predicted polypeptide sequence is orthologous to G225 Member of G1816 and G2718 clade |
| 2167 | G3449 | PRT | Glycine max | Orthologous to G225 Member of G1816 and G2718 clade |
| 2168 | G3450 | DNA | Glycine max | Predicted polypeptide sequence is orthologous to G682 Member of G1816 and G2718 clade |
| 2169 | G3450 | PRT | Glycine max | Orthologous to G682 Member of G1816 and G2718 clade |
| 2170 | G3470 | DNA | Glycine max | Predicted polypeptide sequence is orthologous to G482 Member of G485 clade |
| 2171 | G3470 | PRT | Glycine max | Orthologous to G482 Member of G485 clade |
| 2172 | G3471 | DNA | Glycine max | Predicted polypeptide sequence is orthologous to G482 Member of G485 clade |
| 2173 | G3471 | PRT | Glycine max | Orthologous to G482 Member of G485 clade |
| 2174 | G3472 | DNA | Glycine max | Predicted polypeptide sequence is orthologous to G485 Member of G485 clade |
| 2175 | G3472 | PRT | Glycine max | Orthologous to G485 Member of G485 clade |
| 2176 | G3473 | DNA | Glycine max | Predicted polypeptide sequence is orthologous to G485 Member of G485 clade |
| 2177 | G3473 | PRT | Glycine max | Orthologous to G485 Member of G485 clade |
| 2178 | G3474 | DNA | Glycine max | Predicted polypeptide sequence is orthologous to G485 Member of G485 clade |
| 2179 | G3474 | PRT | Glycine max | Orthologous to G485 Member of G485 clade |
| 2180 | G3475 | DNA | Glycine max | Predicted polypeptide sequence is orthologous to G485 Member of G485 clade |
| 2181 | G3475 | PRT | Glycine max | Orthologous to G485 Member of G485 clade |
| 2182 | G3476 | DNA | Glycine max | Predicted polypeptide sequence is orthologous to G482 Member of G485 clade |
| 2183 | G3476 | PRT | Glycine max | Orthologous to G485 Member of G482 clade |
| 2184 | G3477 | DNA | Glycine max | Predicted polypeptide sequence is orthologous to G482 Member of G485 clade |
| 2185 | G3477 | PRT | Glycine max | Orthologous to G485 Member of G482 clade |
| 2186 | G3478 | DNA | Glycine max | Predicted polypeptide sequence is orthologous to G485 Member of G485 clade |
| 2187 | G3478 | PRT | Glycine max | Orthologous to G485 Member of G485 clade |
| 2188 | G3479 | DNA | Oryza sativa | Predicted polypeptide sequence is orthologous to G153 Member of G153 clade |
| 2189 | G3479 | PRT | Oryza sativa | Orthologous to G153 Member of G153 clade |
| 2190 | G3484 | DNA | Glycine max | Predicted polypeptide sequence is orthologous to G153 Member of G153 clade |
| 2191 | G3484 | PRT | Glycine max | Orthologous to G153 Member of G153 clade |
| 2192 | G3485 | DNA | Glycine max | Predicted polypeptide sequence is orthologous to G153 Member of G153 clade |

TABLE 9-continued

Similarity relationships found within the Sequence Listing

| Table 9: SEQ ID NO: | GID | DNA or Protein (PRT) | Species from which Sequence is Derived | Relationship |
|---|---|---|---|---|
| 2193 | G3485 | PRT | Glycine max | Orthologous to G153 Member of G153 clade |
| 2194 | G3487 | DNA | Zea mays | Predicted polypeptide sequence is orthologous to G153 Member of G153 clade |
| 2195 | G3487 | PRT | Zea mays | Orthologous to G153 Member of G153 clade |
| 2196 | G3488 | DNA | Zea mays | Predicted polypeptide sequence is orthologous to G153 Member of G153 clade |
| 2197 | G3488 | PRT | Zea mays | Orthologous to G153 Member of G153 clade |
| 2198 | G3489 | DNA | Zea mays | Predicted polypeptide sequence is orthologous to G153 Member of G153 clade |
| 2199 | G3489 | PRT | Zea mays | Orthologous to G153 Member of G153 clade |
| 2208 | G3515 | DNA | Oryza sativa | Predicted polypeptide sequence is orthologous to G30 Member of G1792 clade |
| 2209 | G3515 | PRT | Oryza sativa | Orthologous to G30 Member of G1792 clade |
| 2210 | G3516 | DNA | Zea mays | Predicted polypeptide sequence is orthologous to G1792 Member of G1792 clade |
| 2211 | G3516 | PRT | Zea mays | Orthologous to G1792 Member of G1792 clade |
| 2212 | G3517 | DNA | Zea mays | Predicted polypeptide sequence is orthologous to G1791 Member of G1792 clade |
| 2213 | G3517 | PRT | Zea mays | Orthologous to G1791 Member of G1792 clade |
| 2214 | G3518 | DNA | Glycine max | Predicted polypeptide sequence is orthologous to G1792 Member of G1792 clade |
| 2215 | G3518 | PRT | Glycine max | Orthologous to G1792 Member of G1792 clade |
| 2216 | G3519 | DNA | Glycine max | Predicted polypeptide sequence is orthologous to G1792 Member of G1792 clade |
| 2217 | G3519 | PRT | Glycine max | Orthologous to G1792 Member of G1792 clade |
| 2218 | G3520 | DNA | Glycine max | Predicted polypeptide sequence is orthologous to G1792 Member of G1792 clade |
| 2219 | G3520 | PRT | Glycine max | Orthologous to G1792 Member of G1792 clade |
| 2220 | G3527 | DNA | Glycine max | |
| 2221 | G3527 | PRT | Glycine max | |
| 2222 | G3528 | DNA | Glycine max | |
| 2223 | G3528 | PRT | Glycine max | |
| 2224 | G3643 | DNA | Glycine max | Predicted polypeptide sequence is orthologous to G47 Member of G47 and G2133 clade |
| 2225 | G3643 | PRT | Glycine max | Orthologous to G47 Member of G47 and G2133 clade |
| 2226 | G3644 | DNA | Oryza sativa | Predicted polypeptide sequence is orthologous to G47 Member of G47 and G2133 clade |
| 2227 | G3644 | PRT | Oryza sativa | Orthologous to G47 Member of G47 and G2133 clade |
| 2228 | G3645 | DNA | Brassica rapa | Predicted polypeptide sequence is orthologous to G47 Member of G47 and G2133 clade |
| 2229 | G3645 | PRT | Brassica rapa | Orthologous to G47 Member of G47 and G2133 clade |
| 2230 | G3646 | DNA | Brassica oleracea | Predicted polypeptide sequence is orthologous to G2133 Member of G47 and G2133 clade |
| 2231 | G3646 | PRT | Brassica oleracea | Orthologous to G2133 Member of G47 and G2133 clade |
| 2232 | G3647 | DNA | Zinnia elegans | Predicted polypeptide sequence is orthologous to G47 Member of G47 and G2133 clade |
| 2233 | G3647 | PRT | Zinnia elegans | Orthologous to G47 Member of G47 and G2133 clade |
| 2234 | G3649 | DNA | Oryza sativa | Predicted polypeptide sequence is orthologous to G47 and G2133 Member of G47 and G2133 clade |
| 2235 | G3649 | PRT | Oryza sativa | Orthologous to G47 and G2133 Member of G47 and G2133 clade |
| 2236 | G3651 | DNA | Oryza sativa | Predicted polypeptide sequence is orthologous to G2133 Member of G47 and G2133 clade |
| 2237 | G3651 | PRT | Oryza sativa | Orthologous to G2133 Member of G47 and G2133 clade |

EXAMPLES

The invention, now being generally described, will be more readily understood by reference to the following examples, which are included merely for purposes of illustration of certain aspects and embodiments of the present invention and are not intended to limit the invention. It will be recognized by one of skill in the art that a transcription factor that is associated with a particular first trait may also be associated with at least one other, unrelated and inherent second trait which was not predicted by the first trait.

The complete descriptions of the traits associated with each polynucleotide of the invention are fully disclosed in Table 4 and Table 6. The complete description of the transcription factor gene family and identified conserved domains of the polypeptide encoded by the polynucleotide is fully disclosed in Table 5.

Example I

Full Length Gene Identification and Cloning

Putative transcription factor sequences (genomic or ESTs) related to known transcription factors were identified in the *Arabidopsis thaliana* GenBank database using the tblastn sequence analysis program using default parameters and a P-value cutoff threshold of −4 or −5 or lower, depending on the length of the query sequence. Putative transcription factor sequence hits were then screened to identify those containing particular sequence strings. If the sequence hits contained such sequence strings, the sequences were confirmed as transcription factors.

Alternatively, *Arabidopsis thaliana* cDNA libraries derived from different tissues or treatments, or genomic libraries were screened to identify novel members of a transcription family using a low stringency hybridization approach. Probes were synthesized using gene specific primers in a standard PCR reaction (annealing temperature 60° C.) and labeled with $^{32}$P dCTP using the High Prime DNA Labeling Kit (Boehringer Mannheim Corp. (now Roche Diagnostics Corp., Indianapolis, Ind.). Purified radiolabelled probes were added to filters immersed in Church hybridization medium (0.5 M NaPO$_4$ pH 7.0, 7% SDS, 1% w/v bovine serum albumin) and hybridized overnight at 60° C. with shaking. Filters were washed two times for 45 to 60 minutes with 1×SCC, 1% SDS at 60° C.

To identify additional sequence 5' or 3' of a partial cDNA sequence in a cDNA library, 5' and 3' rapid amplification of cDNA ends (RACE) was performed using the MARATHON cDNA amplification kit (Clontech, Palo Alto, Calif.). Generally, the method entailed first isolating poly(A) mRNA, performing first and second strand cDNA synthesis to generate double stranded cDNA, blunting cDNA ends, followed by ligation of the MARATHON Adaptor to the cDNA to form a library of adaptor-ligated ds cDNA.

Gene-specific primers were designed to be used along with adaptor specific primers for both 5' and 3' RACE reactions. Nested primers, rather than single primers, were used to increase PCR specificity. Using 5' and 3' RACE reactions, 5' and 3' RACE fragments were obtained, sequenced and cloned. The process can be repeated until 5' and 3' ends of the full-length gene were identified. Then the full-length cDNA was generated by PCR using primers specific to 5' and 3' ends of the gene by end-to-end PCR.

Example II

Construction of Expression Vectors

The sequence was amplified from a genomic or cDNA library using primers specific to sequences upstream and downstream of the coding region. The expression vector was pMEN20 or pMEN65, which are both derived from pMON316 (Sanders et al. (1987) *Nucleic Acids Res.* 15:1543-1558) and contain the CaMV 35S promoter to express transgenes. To clone the sequence into the vector, both pMEN20 and the amplified DNA fragment were digested separately with SalI and NotI restriction enzymes at 37° C. for 2 hours. The digestion products were subject to electrophoresis in a 0.8% agarose gel and visualized by ethidium bromide staining. The DNA fragments containing the sequence and the linearized plasmid were excised and purified by using a QIAQUICK gel extraction kit (Qiagen, Valencia Calif.). The fragments of interest were ligated at a ratio of 3:1 (vector to insert). Ligation reactions using T4 DNA ligase (New England Biolabs, Beverly Mass.) were carried out at 16° C. for 16 hours. The ligated DNAs were transformed into competent cells of the *E. coli* strain DH5alpha by using the heat shock method. The transformations were plated on LB plates containing 50 mg/l kanamycin (Sigma Chemical Co. St. Louis Mo.). Individual colonies were grown overnight in five milliliters of LB broth containing 50 mg/l kanamycin at 37° C. Plasmid DNA was purified by using Qiaquick Mini Prep kits (Qiagen).

Example III

Transformation of *Agrobacterium* with the Expression Vector

After the plasmid vector containing the gene was constructed, the vector was used to transform *Agrobacterium tumefaciens* cells expressing the gene products. The stock of *Agrobacterium tumefaciens* cells for transformation were made as described by Nagel et al. (1990) *FEMS Microbiol Letts.* 67: 325-328. *Agrobacterium* strain ABI was grown in 250 ml LB medium (Sigma) overnight at 28° C. with shaking until an absorbance over 1 cm at 600 nm ($A_{600}$) of 0.5-1.0 was reached. Cells were harvested by centrifugation at 4,000×g for 15 min at 4° C. Cells were then resuspended in 250 µl chilled buffer (1 mM HEPES, pH adjusted to 7.0 with KOH). Cells were centrifuged again as described above and resuspended in 125 µl chilled buffer. Cells were then centrifuged and resuspended two more times in the same HEPES buffer as described above at a volume of 100 µl and 750 µl, respectively. Resuspended cells were then distributed into 40 µl aliquots, quickly frozen in liquid nitrogen, and stored at –80° C.

*Agrobacterium* cells were transformed with plasmids prepared as described above following the protocol described by Nagel et al. (supra). For each DNA construct to be transformed, 50-100 ng DNA (generally resuspended in 10 mM Tris-HCl, 1 mM EDTA, pH 8.0) was mixed with 40 µl of *Agrobacterium* cells. The DNA/cell mixture was then transferred to a chilled cuvette with a 2 mm electrode gap and subject to a 2.5 kV charge dissipated at 25 µF and 200 µF using a Gene Pulser II apparatus (Bio-Rad, Hercules, Calif.). After electroporation, cells were immediately resuspended in 1.0 ml LB and allowed to recover without antibiotic selection for 2-4 hours at 28° C. in a shaking incubator. After recovery, cells were plated onto selective medium of LB broth containing 100 µg/ml spectinomycin (Sigma) and incubated for 24-48 hours at 28° C. Single colonies were then picked and inoculated in fresh medium. The presence of the plasmid construct was verified by PCR amplification and sequence analysis.

Example IV

Transformation of *Arabidopsis* Plants with *Agrobacterium tumefaciens* with Expression Vector After transformation of *Agrobacterium tumefaciens* with plasmid vectors containing the gene, single *Agrobacterium* colonies were identified, propagated, and used to transform *Arabidopsis* plants. Briefly, 500 ml cultures of LB medium containing 50 mg/l kanamycin were inoculated with the colonies and grown at 28° C. with shaking for 2 days until an optical absorbance at 600 nm wavelength over 1 cm ($A_{600}$) of >2.0 is reached. Cells were then harvested by centrifugation at 4,000×g for 10 min, and resuspended in infiltration medium (1/2×Murashige and Skoog salts (Sigma), 1× Gamborg's B-5 vitamins (Sigma), 5.0% (w/v) sucrose (Sigma), 0.044 µM benzylamino purine (Sigma), 200 µl/l Silwet L-77 (Lehle Seeds) until an $A_{600}$ of 0.8 was reached.

Prior to transformation, *Arabidopsis thaliana* seeds (ecotype Columbia) were sown at a density of ~10 plants per 4" pot onto Pro-Mix BX potting medium (Hummert International) covered with fiberglass mesh (18 mm×16 mm) Plants were grown under continuous illumination (50-75 µE/m$^2$/sec) at 22-23° C. with 65-70% relative humidity. After about 4 weeks, primary inflorescence stems (bolts) are cut off to encourage growth of multiple secondary bolts. After flowering of the mature secondary bolts, plants were prepared for transformation by removal of all siliques and opened flowers.

The pots were then immersed upside down in the mixture of *Agrobacterium* infiltration medium as described above for 30 sec, and placed on their sides to allow draining into a 1'×2' flat surface covered with plastic wrap. After 24 h, the plastic wrap was removed and pots are turned upright. The immersion procedure was repeated one week later, for a total of two immersions per pot. Seeds were then collected from each transformation pot and analyzed following the protocol described below.

Example V

Identification of *Arabidopsis* Primary Transformants

Seeds collected from the transformation pots were sterilized essentially as follows. Seeds were dispersed into in a solution containing 0.1% (v/v) Triton X-100 (Sigma) and sterile water and washed by shaking the suspension for 20 min. The wash solution was then drained and replaced with fresh wash solution to wash the seeds for 20 min with shaking. After removal of the ethanol/detergent solution, a solution containing 0.1% (v/v) Triton X-100 and 30% (v/v) bleach (CLOROX; Clorox Corp. Oakland Calif.) was added to the seeds, and the suspension was shaken for 10 min. After removal of the bleach/detergent solution, seeds were then washed five times in sterile distilled water. The seeds were stored in the last wash water at 4° C. for 2 days in the dark before being plated onto antibiotic selection medium (1× Murashige and Skoog salts (pH adjusted to 5.7 with 1M KOH), 1× Gamborg's B-5 vitamins, 0.9% phytagar (Life Technologies), and 50 mg/l kanamycin). Seeds were germinated under continuous illumination (50-75 $\mu E/m^2/sec$) at 22-23° C. After 7-10 days of growth under these conditions, kanamycin resistant primary transformants (T1 generation) were visible and obtained. These seedlings were transferred first to fresh selection plates where the seedlings continued to grow for 3-5 more days, and then to soil (Pro-Mix BX potting medium).

Primary transformants were crossed and progeny seeds ($T_2$) collected; kanamycin resistant seedlings were selected and analyzed. The expression levels of the recombinant polynucleotides in the transformants varies from about a 5% expression level increase to a least a 100% expression level increase. Similar observations are made with respect to polypeptide level expression.

Example VI

Identification of *Arabidopsis* Plants with Transcription Factor Gene Knockouts

The screening of insertion mutagenized *Arabidopsis* collections for null mutants in a known target gene was essentially as described in Krysan et al. (1999) *Plant Cell* 11: 2283-2290. Briefly, gene-specific primers, nested by 5-250 base pairs to each other, were designed from the 5' and 3' regions of a known target gene. Similarly, nested sets of primers were also created specific to each of the T-DNA or transposon ends (the "right" and "left" borders). All possible combinations of gene specific and T-DNA/transposon primers were used to detect by PCR an insertion event within or close to the target gene. The amplified DNA fragments were then sequenced which allows the precise determination of the T-DNA/transposon insertion point relative to the target gene. Insertion events within the coding or intervening sequence of the genes were deconvoluted from a pool comprising a plurality of insertion events to a single unique mutant plant for functional characterization. The method is described in more detail in Yu and Adam, U.S. application Ser. No. 09/177,733 filed Oct. 23, 1998.

Example VII

Identification of Modified Phenotypes in Overexpression or Gene Knockout Plants

Experiments were performed to identify those transformants or knockouts that exhibited modified biochemical characteristics. Among the biochemicals that were assayed were insoluble sugars, such as arabinose, fucose, galactose, mannose, rhamnose or xylose or the like; prenyl lipids, such as lutein, beta-carotene, xanthophyll-1, xanthophyll-2, chlorophylls A or B, or alpha-, delta- or gamma-tocopherol or the like; fatty acids, such as 16:0 (palmitic acid), 16:1 (palmitoleic acid), 18:0 (stearic acid), 18:1 (oleic acid), 18:2 (linoleic acid), 20:0, 18:3 (linolenic acid), 20:1 (eicosenoic acid), 20:2, 22:1 (erucic acid) or the like; waxes, such as by altering the levels of C29, C31, or C33 alkanes; sterols, such as brassicasterol, campesterol, stigmasterol, sitosterol or stigmastanol or the like, glucosinolates, protein or oil levels.

Fatty acids were measured using two methods depending on whether the tissue was from leaves or seeds. For leaves, lipids were extracted and esterified with hot methanolic $H_2SO_4$ and partitioned into hexane from methanolic brine. For seed fatty acids, seeds were pulverized and extracted in methanol:heptane:toluene:2,2-dimethoxypropane:$H_2SO_4$ (39:34:20:5:2) for 90 minutes at 80° C. After cooling to room temperature the upper phase, containing the seed fatty acid esters, was subjected to GC analysis. Fatty acid esters from both seed and leaf tissues were analyzed with a SUPELCO SP-2330 column (Supelco, Bellefonte, Pa.).

Glucosinolates were purified from seeds or leaves by first heating the tissue at 95° C. for 10 minutes. Preheated ethanol: water (50:50) is added and after heating at 95° C. for a further 10 minutes, the extraction solvent is applied to a DEAE SEPHADEX column (Pharmacia) which had been previously equilibrated with 0.5 M pyridine acetate. Desulfoglucosinolates were eluted with 300 ul water and analyzed by reverse phase HPLC monitoring at 226 nm.

For wax alkanes, samples were extracted using an identical method as fatty acids and extracts were analyzed on a HP 5890 GC coupled with a 5973 MSD. Samples were chromatographically isolated on a J&W DB35 mass spectrometer (J&W Scientific Agilent Technologies, Folsom, Calif.).

To measure prenyl lipid levels, seeds or leaves were pulverized with 1 to 2% pyrogallol as an antioxidant. For seeds, extracted samples were filtered and a portion removed for tocopherol and carotenoid/chlorophyll analysis by HPLC. The remaining material was saponified for sterol determination. For leaves, an aliquot was removed and diluted with methanol and chlorophyll A, chlorophyll B, and total carotenoids measured by spectrophotometry by determining optical absorbance at 665.2 nm, 652.5 nm, and 470 nm. An aliquot was removed for tocopherol and carotenoid/chlorophyll composition by HPLC using a Waters μBondapak C18 column (4.6 mm×150 mm). The remaining methanolic solution was saponified with 10% KOH at 80° C. for one hour. The samples were cooled and diluted with a mixture of methanol and water. A solution of 2% methylene chloride in hexane was mixed in and the samples were centrifuged. The aqueous methanol phase was again re-extracted 2% methylene chloride in hexane and, after centrifugation, the two upper phases were combined and evaporated. 2% methylene chloride in hexane was added to the tubes and the samples were then extracted with one ml of water. The upper phase was removed, dried, and resuspended in 400 ul of 2% methylene chloride in hexane and analyzed by gas chromatography using a 50 m DB-5 ms (0.25 mm ID, 0.25 um phase, J&W Scientific).

Insoluble sugar levels were measured by the method essentially described by Reiter et al. (1999), *Plant J.* 12: 335-345. This method analyzes the neutral sugar composition of cell wall polymers found in *Arabidopsis* leaves. Soluble sugars were separated from sugar polymers by extracting leaves with hot 70% ethanol. The remaining residue containing the insoluble polysaccharides was then acid hydrolyzed with allose added as an internal standard. Sugar monomers generated by the hydrolysis were then reduced to the corresponding alditols by treatment with NaBH4, then were acetylated to generate the volatile alditol acetates which were then analyzed by GC-FID. Identity of the peaks was determined by comparing the retention times of known sugars converted to the corresponding alditol acetates with the retention times of peaks from wild-type plant extracts. Alditol acetates were analyzed on a Supelco SP-2330 capillary column (30 m×250 μm×0.2 μm) using a temperature program beginning at 180° C. for 2 minutes followed by an increase to 220° C. in 4 minutes. After holding at 220° C. for 10 minutes, the oven temperature is increased to 240° C. in 2 minutes and held at this temperature for 10 minutes and brought back to room temperature.

To identify plants with alterations in total seed oil or protein content, 150 mg of seeds from T2 progeny plants were subjected to analysis by Near Infrared Reflectance Spectroscopy (NIRS) using a Foss NirSystems Model 6500 with a spinning cup transport system. NIRS is a non-destructive analytical method used to determine seed oil and protein composition. Infrared is the region of the electromagnetic spectrum located after the visible region in the direction of longer wavelengths. 'Near infrared' owns its name for being the infrared region near to the visible region of the electromagnetic spectrum. For practical purposes, near infrared comprises wavelengths between 800 and 2500 nm. NIRS is applied to organic compounds rich in O—H bonds (such as moisture, carbohydrates, and fats), C—H bonds (such as organic compounds and petroleum derivatives), and N—H bonds (such as proteins and amino acids). The NIRS analytical instruments operate by statistically correlating NIRS signals at several wavelengths with the characteristic or property intended to be measured. All biological substances contain thousands of C—H, O—H, and N—H bonds. Therefore, the exposure to near infrared radiation of a biological sample, such as a seed, results in a complex spectrum which contains qualitative and quantitative information about the physical and chemical composition of that sample.

The numerical value of a specific analyte in the sample, such as protein content or oil content, is mediated by a calibration approach known as chemometrics. Chemometrics applies statistical methods such as multiple linear regression (MLR), partial least squares (PLS), and principle component analysis (PCA) to the spectral data and correlates them with a physical property or other factor, that property or factor is directly determined rather than the analyte concentration itself. The method first provides "wet chemistry" data of the samples required to develop the calibration.

Calibration of NIRS response was performed using data obtained by wet chemical analysis of a population of *Arabidopsis* ecotypes that were expected to represent diversity of oil and protein levels.

The exact oil composition of each ecotype used in the calibration experiment was performed using gravimetric analysis of oils extracted from seed samples (0.5 g or 1.0 g) by the accelerated solvent extraction method (ASE; Dionex Corp, Sunnyvale, Calif.). The extraction method was validated against certified canola samples (Community Bureau of Reference, Belgium). Seed samples from each ecotype (0.5 g or 1 g) were subjected to accelerated solvent extraction and the resulting extracted oil weights compared to the weight of oil recovered from canola seed that has been certified for oil content (Community Bureau of Reference). The oil calibration equation was based on 57 samples with a range of oil contents from 27.0% to 50.8%. To check the validity of the calibration curve, an additional set of samples was extracted by ASE and predicted using the oil calibration equation. This validation set counted 46 samples, ranging from 27.9% to 47.5% oil, and had a predicted standard error of performance of 0.63%. The wet chemical method for protein was elemental analysis (% N×6.0) using the average of 3 representative samples of 5 mg each validated against certified ground corn (NIST). The instrumentation was an Elementar Vario-EL III elemental analyzer operated in CNS operating mode (Elementar Analysensysteme GmbH, Hanau, Germany)

The protein calibration equation was based on a library of 63 samples with a range of protein contents from 17.4% to 31.2%. An additional set of samples was analyzed for protein by elemental analysis (n=57) and scanned by NIRS in order to validate the protein prediction equation. The protein range of the validation set was from 16.8% to 31.2% and the standard error of prediction was 0.468%.

NIRS analysis of *Arabidopsis* seed was carried out on between 40-300 mg experimental sample. The oil and protein contents were predicted using the respective calibration equations.

Data obtained from NIRS analysis was analyzed statistically using a nearest-neighbor (N—N) analysis. The N—N analysis allows removal of within-block spatial variability in a fairly flexible fashion, which does not require prior knowledge of the pattern of variability in the chamber. Ideally, all hybrids are grown under identical experimental conditions within a block (rep). In reality, even in many block designs, significant within-block variability exists. Nearest-neighbor procedures are based on assumption that environmental effect of a plot is closely related to that of its neighbors. Nearest-neighbor methods use information from adjacent plots to adjust for within-block heterogeneity and so provide more precise estimates of treatment means and differences. If there is within-plot heterogeneity on a spatial scale that is larger than a single plot and smaller than the entire block, then yields from adjacent plots will be positively correlated. Information from neighboring plots can be used to reduce or remove the unwanted effect of the spatial heterogeneity, and hence improve the estimate of the treatment effect. Data from neighboring plots can also be used to reduce the influence of competition between adjacent plots. The Papadakis N—N analysis can be used with designs to remove within-block variability that would not be removed with the standard split plot analysis ((Papadakis (1973) *Inst. d'Amelior. Plantes Thessaloniki (Greece) Bull. Scientif.* No. 23; Papadakis (1984) *Proc. Acad. Athens* 59: 326-342).

Experiments were performed to identify those transformants or knockouts that exhibited modified sugar sensing. For such studies, seeds from transformants were germinated on media containing 5% glucose or 9.4% sucrose which normally partially restrict hypocotyl elongation. Plants with altered sugar sensing may have either longer or shorter hypocotyls than normal plants when grown on this media. Additionally, other plant traits may be varied such as root mass.

Experiments may be performed to identify those transformants or knockouts that exhibited an improved pathogen tolerance. For such studies, the transformants are exposed to biotropic fungal pathogens, such as *Erysiphe orontii*, and necrotropic fungal pathogens, such as *Fusarium oxysporum*. *Fusarium oxysporum* isolates cause vascular wilts and damping off of various annual vegetables, perennials and weeds (Mauch-Mani and Slusarenko (1994) *Molec Plant-Microbe Interact.* 7: 378-383). For *Fusarium oxysporum* experiments, plants are grown on Petri dishes and sprayed with a fresh spore suspension of *F. oxysporum*. The spore suspension is prepared as follows: A plug of fungal hyphae from a plate culture is placed on a fresh potato dextrose agar plate and allowed to spread for one week. Five ml sterile water is then added to the plate, swirled, and pipetted into 50 ml Armstrong *Fusarium* medium. Spores are grown overnight in *Fusarium* medium and then sprayed onto plants using a Preval paint sprayer. Plant tissue is harvested and frozen in liquid nitrogen 48 hours post-infection.

*Erysiphe orontii* is a causal agent of powdery mildew. For *Erysiphe orontii* experiments, plants are grown approximately 4 weeks in a greenhouse under 12 hour light (20° C., ~30% relative humidity (rh)). Individual leaves are infected with *E. orontii* spores from infected plants using a camel's hair brush, and the plants are transferred to a Percival growth chamber (20° C., 80% rh.). Plant tissue is harvested and frozen in liquid nitrogen 7 days post-infection.

*Botrytis cinerea* is a necrotrophic pathogen. *Botrytis cinerea* is grown on potato dextrose agar under 12 hour light (20° C., ~30% relative humidity (rh)). A spore culture is made by spreading 10 ml of sterile water on the fungus plate, swirling and transferring spores to 10 ml of sterile water. The spore inoculum (approx. 105 spores/ml) is then used to spray 10 day-old seedlings grown under sterile conditions on MS (minus sucrose) media. Symptoms are evaluated every day up to approximately 1 week.

*Sclerotinia sclerotiorum* hyphal cultures are grown in potato dextrose broth. One gram of hyphae is ground, filtered, spun down and resuspended in sterile water. A 1:10 dilution is used to spray 10 day-old seedlings grown aseptically under a 12 hour light/dark regime on MS (minus sucrose) media. Symptoms are evaluated every day up to approximately 1 week.

*Pseudomonas syringae* pv maculicola (Psm) strain 4326 and pv maculicola strain 4326 was inoculated by hand at two doses. Two inoculation doses allows the differentiation between plants with enhanced susceptibility and plants with enhanced resistance to the pathogen. Plants are grown for 3 weeks in the greenhouse, then transferred to the growth chamber for the remainder of their growth. Psm ES4326 may be hand inoculated with 1 ml syringe on 3 fully-expanded leaves per plant (4½ wk old), using at least 9 plants per overexpressing line at two inoculation doses, OD=0.005 and OD=0.0005. Disease scoring is performed at day 3 post-inoculation with pictures of the plants and leaves taken in parallel.

In some instances, expression patterns of the pathogen-induced genes (such as defense genes) may be monitored by microarray experiments. In these experiments, cDNAs are generated by PCR and resuspended at a final concentration of ~100 ng/ul in 3×SSC or 150 mM Na-phosphate (Eisen and Brown (1999) *Methods Enzymol.* 303: 179-205). The cDNAs are spotted on microscope glass slides coated with polylysine. The prepared cDNAs are aliquoted into 384 well plates and spotted on the slides using, for example, an x-y-z gantry (OmniGrid) which may be purchased from GeneMachines (Menlo Park, Calif.) outfitted with quill type pins which may be purchased from Telechem International (Sunnyvale, Calif.). After spotting, the arrays are cured for a minimum of one week at room temperature, rehydrated and blocked following the protocol recommended by Eisen and Brown (1999; supra).

Sample total RNA (10 µg) samples are labeled using fluorescent Cy3 and Cy5 dyes. Labeled samples are resuspended in 4×SSC/0.03% SDS/4 µg salmon sperm DNA/2 µg tRNA/50 mM Na-pyrophosphate, heated for 95° C. for 2.5 minutes, spun down and placed on the array. The array is then covered with a glass coverslip and placed in a sealed chamber. The chamber is then kept in a water bath at 62° C. overnight. The arrays are washed as described in Eisen and Brown (1999, supra) and scanned on a General Scanning 3000 laser scanner. The resulting files are subsequently quantified using IMAGENE, software (BioDiscovery, Los Angeles Calif.).

RT-PCR experiments may be performed to identify those genes induced after exposure to biotropic fungal pathogens, such as *Erysiphe orontii*, necrotropic fungal pathogens, such as *Fusarium oxysporum*, bacteria, viruses and salicylic acid, the latter being involved in a nonspecific resistance response in *Arabidopsis thaliana*. Generally, the gene expression patterns from ground plant leaf tissue is examined Reverse transcriptase PCR was conducted using gene specific primers within the coding region for each sequence identified. The primers were designed near the 3' region of each DNA binding sequence initially identified.

Total RNA from these ground leaf tissues was isolated using the CTAB extraction protocol. Once extracted total RNA was normalized in concentration across all the tissue types to ensure that the PCR reaction for each tissue received the same amount of cDNA template using the 28S band as reference. Poly(A+) RNA was purified using a modified protocol from the Qiagen OLIGOTEX purification kit batch protocol. cDNA was synthesized using standard protocols. After the first strand cDNA synthesis, primers for Actin 2 were used to normalize the concentration of cDNA across the tissue types. Actin 2 is found to be constitutively expressed in fairly equal levels across the tissue types we are investigating.

For RT PCR, cDNA template was mixed with corresponding primers and Taq DNA polymerase. Each reaction consisted of 0.2 µl cDNA template, 2 µl 10× Tricine buffer, 2 µl 10× Tricine buffer and 16.8 µl water, 0.05 µl Primer 1, 0.05 µl, Primer 2, 0.3 µl Taq DNA polymerase and 8.6 µl water.

The 96 well plate is covered with microfilm and set in the thermocycler to start the reaction cycle. By way of illustration, the reaction cycle may comprise the following steps:

Step 1: 93° C. for 3 min;
Step 2: 93° C. for 30 sec;
Step 3: 65° C. for 1 min;
Step 4: 72° C. for 2 min;
Steps 2, 3 and 4 are repeated for 28 cycles;
Step 5: 72° C. for 5 min; and
STEP 6 4° C.

To amplify more products, for example, to identify genes that have very low expression, additional steps may be performed: The following method illustrates a method that may be used in this regard. The PCR plate is placed back in the thermocycler for 8 more cycles of steps 2-4.

Step 2 93° C. for 30 sec;
Step 3 65° C. for 1 min;
Step 4 72° C. for 2 min, repeated for 8 cycles; and
Step 5 4° C.

Eight microliters of PCR product and 1.5 µl of loading dye are loaded on a 1.2% agarose gel for analysis after 28 cycles and 36 cycles. Expression levels of specific transcripts are considered low if they were only detectable after 36 cycles of PCR. Expression levels are considered medium or high depending on the levels of transcript compared with observed transcript levels for an internal control such as actin2. Transcript levels are determined in repeat experiments and compared to transcript levels in control (e.g., non-transformed) plants.

Experiments were performed to identify those transformants or knockouts that exhibited an improved environmental stress tolerance. For such studies, the transformants were exposed to a variety of environmental stresses. Plants were exposed to chilling stress (6 hour exposure to 4-8° C.), heat stress (6 hour exposure to 32-37° C.), high salt stress (6 hour exposure to 200 mM NaCl), drought stress (168 hours after removing water from trays), osmotic stress (6 hour exposure to 3 M mannitol), or nutrient limitation (nitrogen, phosphate, and potassium) (nitrogen: all components of MS medium remained constant except N was reduced to 20 mg/l of $NH_4NO_3$; phosphate: all components of MS medium except $KH2PO_4$, which was replaced by $K_2SO_4$; potassium: all components of MS medium except removal of $KNO_3$ and $KH_2PO_4$, which were replaced by $NaH_4PO_4$).

Experiments were performed to identify those transformants or knockouts that exhibited a modified structure and development characteristics. For such studies, the transformants were observed by eye to identify novel structural or developmental characteristics associated with the ectopic expression of the polynucleotides or polypeptides of the invention.

Flowering time was measured by the number of rosette leaves present when a visible inflorescence of approximately 3 cm is apparent. Rosette and total leaf number on the progeny stem are tightly correlated with the timing of flowering (Koornneef et al. (1991) *Mol. Gen. Genet.* 229: 57-66). The vernalization response was also measured. For vernalization treatments, seeds were sown to MS agar plates, sealed with micropore tape, and placed in a 4° C. cold room with low light levels for 6-8 weeks. The plates were then transferred to the growth rooms alongside plates containing freshly sown non-vernalized controls. Rosette leaves were counted when a visible inflorescence of approximately 3 cm was apparent.

Modified phenotypes observed for particular overexpressor or knockout plants are provided in Table 4. For a particular overexpressor that shows a less beneficial characteristic, it may be more useful to select a plant with a decreased expression of the particular transcription factor. For a particular knockout that shows a less beneficial characteristic, it may be more useful to select a plant with an increased expression of the particular transcription factor.

The sequences of the Sequence Listing or those in Tables 4-9, or those disclosed here, can be used to prepare transgenic plants and plants with altered traits. The specific transgenic plants listed below are produced from the sequences of the Sequence Listing, as noted. Tables 4 and 6 provide exemplary polynucleotide and polypeptide sequences of the invention.

Example VIII

Examples of Genes that Confer Significant Improvements to Plants

Examples of genes and homologs that confer significant improvements to knockout or overexpressing plants are noted below. Experimental observations made by us with regard to specific genes whose expression has been modified in overexpressing or knock-out plants, and potential applications based on these observations, are also presented.

This example provides experimental evidence for increased biomass and abiotic stress tolerance controlled by the transcription factor polypeptides and polypeptides of the invention.

Salt stress assays are intended to find genes that confer better germination, seedling vigor or growth in high salt. Evaporation from the soil surface causes upward water movement and salt accumulation in the upper soil layer where the seeds are placed. Thus, germination normally takes place at a salt concentration much higher than the mean salt concentration of in the whole soil profile. Plants differ in their tolerance to NaCl depending on their stage of development, therefore seed germination, seedling vigor, and plant growth responses are evaluated.

Osmotic stress assays (including NaCl and mannitol assays) are intended to determine if an osmotic stress phenotype is NaCl-specific or if it is a general osmotic stress related phenotype. Plants tolerant to osmotic stress could also have more tolerance to drought and/or freezing.

Drought assays are intended to find genes that mediate better plant survival after short-term, severe water deprivation. Ion leakage will be measured if needed. Osmotic stress tolerance would also support a drought tolerant phenotype.

Temperature stress assays are intended to find genes that confer better germination, seedling vigor or plant growth under temperature stress (cold, freezing and heat).

Sugar sensing assays are intended to find genes involved in sugar sensing by germinating seeds on high concentrations of sucrose and glucose and looking for degrees of hypocotyl elongation. The germination assay on mannitol controls for responses related to osmotic stress. Sugars are key regulatory molecules that affect diverse processes in higher plants including germination, growth, flowering, senescence, sugar metabolism and photosynthesis. Sucrose is the major transport form of photosynthate and its flux through cells has been shown to affect gene expression and alter storage compound accumulation in seeds (source-sink relationships). Glucose-specific hexose-sensing has also been described in plants and is implicated in cell division and repression of "famine" genes (photosynthetic or glyoxylate cycles).

Germination assays followed modifications of the same basic protocol. Sterile seeds were sown on the conditional media listed below. Plates were incubated at 22° C. under 24-hour light (120-130 µEin/m²/s) in a growth chamber. Evaluation of germination and seedling vigor was conducted 3 to 15 days after planting. The basal media was 80% Murashige-Skoog medium (MS)+vitamins.

For salt and osmotic stress germination experiments, the medium was supplemented with 150 mM NaCl or 300 mM mannitol. Growth regulator sensitivity assays were performed in MS media, vitamins, and either 0.3 µM ABA, 9.4% sucrose, or 5% glucose.

Temperature stress cold germination experiments were carried out at 8° C. Heat stress germination experiments were conducted at 32° C. to 37° C. for 6 hours of exposure.

For stress experiments conducted with more mature plants, seeds were germinated and grown for seven days on MS+vitamins+1% sucrose at 22° C. and then transferred to chilling and heat stress conditions. The plants were either exposed to chilling stress (6 hour exposure to 4-8° C.), or heat stress (32° C. was applied for five days, after which the plants were transferred back 22° C. for recovery and evaluated after 5 days relative to controls not exposed to the depressed or elevated temperature).
Results:
G30 (SEQ ID NO: 7)
Published Information G30 (At1g04370) is part of the BAC clone F19P19, GenBank accession number AC000104 (nid=2341023).
Experimental Observations Initial experiments were performed with G30 knockout mutant plants. However, these experiments did not uncover the functions of the gene.

In order to characterize the gene further, 35S::G30 overexpressing lines were generated. Morphological analysis of the transgenic plants indicated that G30 could be involved in light regulation: the seedlings had long hypocotyls and elongated cotyledon petioles. In addition, some of the seedlings also had longer roots compared to control plants. At later stages, the plants became darker green, and had glossy leaves, perhaps indicating elevated levels of epidermal wax. The phenotype for G30 overexpression resembled those produced by related AP2 genes.
Utilities Based on the appearance of 35S::G30 leaves, the gene could be used to engineer changes in the composition and amount of leaf surface components (most likely wax). The ability to manipulate wax composition, amount, or distribution could modify plant tolerance to drought and low humidity, or resistance to insects or pathogens. Additionally, in some species, wax is a valuable commodity and altering its accumulation and/or composition could enhance yield.

The phenotypes of 35S::G30 seedlings indicate that the gene may also be used to manipulate light-regulated developmental processes like shade avoidance. Eliminating shading responses might allow increased planting densities with subsequent yield enhancement.

Additionally, if the dark coloration of 35S::G30 lines reflects an increase in biochemical composition, the gene might be used to improve the nutraceutical value of foodstuffs, or increase photosynthetic capacity to improve yield.
G47 (SEQ ID NO: 11)
Published Information G47 corresponds to gene T22J18.2 (AAC25505). No information is available about the function(s) of G47.
Experimental Observations The function of G47 was studied using transgenic plants in which the gene was expressed under the control of the 35S promoter. Overexpression of G47 resulted in a variety of morphological and physiological phenotypic alterations.

35S::G47 plants showed enhanced tolerance to osmotic stress. In a root growth assay on PEG containing media, G47 overexpressing transgenic seedlings were larger and had more root growth compared to the wild-type controls (FIG. 3A). Interestingly, G47 expression levels might be altered by environmental conditions, in particular reduced by salt and osmotic stresses. In addition to the phenotype observed in the osmotic stress assay, germination efficiency for the seeds from G47 overexpressors was low.

35S::G47 plants were also significantly larger and greener in a soil-based drought assay than wild-type controls plants.

Overexpression of G47 also produced a substantial delay in flowering time and caused a marked change in shoot architecture. 35S::G47 transformants were small at early stages and switched to flowering more than a week later than wild-type controls (continuous light conditions). Interestingly, the inflorescences from these plants appeared thick and fleshy, had reduced apical dominance, and exhibited reduced internode elongation leading to a short compact stature (FIG. 3B). The branching pattern of the stems also appeared abnormal, with the primary shoot becoming 'kinked' at each coflorescence node. Additionally, the plants showed slightly reduced fertility and formed rather small siliques that were borne on short pedicels and held vertically, close against the stem.

Additional alterations were detected in the inflorescence stems of 35S::G47 plants. Stem sections from T2-21 and T2-24 plants were of wider diameter, and had large irregular vascular bundles containing a much greater number of xylem vessels than wild type. Furthermore some of the xylem vessels within the bundles appeared narrow and were possibly more lignified than were those of controls.

G47 was expressed at higher levels in rosette leaves, and transcripts can be detected in other tissues (flower, embryo, silique, and germinating seedling), but apparently not in roots.
Utilities G47 or its equivalogs could potentially be used to manipulate flowering time, to modify plant architecture and stem structure, including development of vascular tissues and lignin content, and to improve plant performance under drought and osmotic stress conditions.

The use of G47 or its equivalogs from tree species could offer the potential for modulating lignin content. This might allow the quality of wood used for furniture or construction to be improved.
G148 (SEQ ID NO: 39)
Published Information G148 corresponds to AGAMOUS-LIKE 13 (AGL13), and was originally identified based on its conserved MADS domain (Purugganan et al. (1995) *Genetics* 140: 345-356; Rounsley et al. (1995). *Plant Cell* 7: 1259-1269). No functional information about G148 is available in the public domain. However, its expression pattern indicated that the gene has a role in ovule development; AGL13 transcript was present in ovules at the time of integument development, but fell following fertilization. Additionally, lower levels of expression were found in anther filaments and style tissue (Rounsley et al. (1995) supra).
Experimental Observations Homozygotes were analyzed for a transposon insertion (SLAT collection) within G148; these plants showed no obvious macroscopic changes in morphology and exhibited a similar response to wild type in all of the physiological assays performed.

The effects of G148 overexpression were studied by generating transgenic lines in which a G148 genomic clone was expressed from the 35S CaMV promoter. 35S::G148 transformants displayed a range of morphological changes including a severe reduction in overall plant size, leaf curling, accelerated flowering, and terminal flower formation. Such changes indicate that G148 influences the genetic networks controlling various aspects of development including flowering time and meristem determinacy.
Utilities The morphological changes seen in the overexpression lines demonstrate that G148 could be used to manipulate various aspects of plant development.

The appearance of terminal flowers in 35S::G148 transformants indicated that the gene or its orthologs can modify inflorescence architecture and confer a determinate habit in species where the shoots otherwise show an indeterminate growth pattern. Such changes completely alter the overall plant form, and may, for example, facilitate mechanical harvesting (as already exemplified by the SELF-PRUNING gene, which controls shoot determinacy in tomato, Pnueli L et al. (1998). *Development* 125: 1979-1989).

Additionally, the accelerated switch to reproductive growth seen in 35S::G148 plants, indicated that the gene can be used to manipulate flowering time in commercial species. Specifically, the gene can accelerate flowering or eliminate any requirement for vernalization. In some instances, a faster cycling time might allow additional harvests of a crop to be made within a given growing season. Shortening generation times can also help speed-up breeding programs, particularly in species such as trees, which grow for many years before flowering.

G153 (SEQ ID NO: 43)
Published Information

G153 corresponds to the *Arabidopsis* ANR1 gene. This locus was identified by Zhang and Forde (1998) as a MADS box gene that is rapidly induced in the roots of nitrogen starved seedlings, following exposure to a nitrate source. Additionally, it was shown that transgenic lines in which an antisense clone of ANR1 is overexpressed show altered sensitivity to nitrate and, unlike wild-type plants, do not exhibit lateral root proliferation in response to nitrate treatments. From these data, it was concluded that ANR1 is a key regulator of nutrient-induced changes in root architecture (Zhang and Forde (1998) *Science* 279: 407-409).

However, Wang et al. ((2000) *Plant Cell* 12, 1491-1509) have data that contradicts the results of Zhang and Forde (1998). These authors found that ANR1 is actually repressed, rather than induced, following treatment of nitrogen starved seedlings (grown on 10 mM ammonium succinate as the sole nitrogen source) with 5 mM nitrate.

A phylogenetic analysis of the *Arabidopsis* MADS box gene family situated ANR1 in same clade as three other MADS box genes: AGL16 (G860), AGL17 (G152) and AGL21 (G1760) (Alvarez-Buylla et al. (2000) *Proc Natl Acad Sci U.S.A.* 97: 5328-5333). Two of the genes, AGL17 and AGL21 were recently shown to be expressed in specific zones of the root, indicating that different members of the ANR1 clade may play distinct regulatory roles during root development (Burgeff et al. (2002 *Planta* 214: 365-372).

The ANR1 sequence (GenBank accession AX507709) has also been included in a patent publication (WO0216655A) by Harper et al. (2002).

Experimental Observations

RT-PCR experiments revealed that G153 is up-regulated in leaves in response to heat and *Fusarium* treatments. Lower levels of induction were also observed following auxin, ABA, and cold treatments, indicating that G153 might have a role in a variety of stress responses.

To further assess the function of the gene, 35S::G153 overexpressing lines were generated and subjected to a suite of assays. Around a third of the lines showed a marked acceleration in the onset of flowering, indicating that the gene might impinge on genetic pathways that regulate flowering time.

In addition to the effects on flowering, 35S::G153 lines displayed an enhanced performance in an assay intended to reveal alterations in C/N sensing. 35S::G153 seedlings contained less anthocyanin and in a number of cases were larger than wild-type controls grown on high sucrose/N− plates. Seedlings were also larger and greener on high sucrose/N− plates that had been supplemented with glutamine. Together, these data indicated that overexpression of G153 may alter the ability to modulate carbon and/or nitrogen uptake and utilization.

It should be noted that a closely related gene, G1760, prior to the C/N sensing assay being implemented. Like 35S::G153 transformants, 35S::G1760 lines also exhibited early flowering, and RT-PCR studies showed G1760 to be predominantly expressed in roots and to be stress responsive. Thus, G1760 and G153 could have similar and/or overlapping functions.

Utilities

The response of G153 expression to different physiological treatments indicates that the gene or its equivalogs could be used to improve resistance to a variety of different stresses. In particular, the enhanced performance of 35S::G153 lines under low nitrogen conditions indicated that G153 might be used to engineer crops that could thrive in environments with reduced nitrogen availability.

The finding that 35S::G153 lines make less anthocyanin on high sucrose media containing glutamine indicated that G153 or its equivalogs might be used to modify carbon and nitrogen status, and hence alter assimilate partitioning.

Given the early flowering seen amongst the 35S::G153 transformants, the gene or its equivalogs might also be applied to manipulate the flowering time of commercial species. In particular, G153 could be used to accelerate flowering, or eliminate any requirement for vernalization.

G485 (SEQ ID NO: 105)
Published Information

G485 is a member of the Hap3-like subfamily of CCAAT-box binding transcription factors. G485 corresponds to gene At4g14540, annotated by the *Arabidopsis* Genome Initiative. The gene corresponds to sequence 1042 from Patent Application WO0216655 on stress-regulated genes, transgenic plants and methods of use, in which G485 was reported to be cold responsive in a microarray analysis (Harper et al. (2002) Patent Application WO0216655). No information is available about the function(s) of G485.

Experimental Observations

RT-PCR analyses of the endogenous levels of G485 indicated that this gene is expressed in all tissues and under all conditions tested. Homozygotes for a T-DNA insertion allele of G485 flowered several days later than control plants. G485 was then overexpressed, and gain of function and loss of function studies on G485 revealed opposite effects on flowering time. Under conditions of continuous light, approximately half of the 35S::G485 primary transformants flowered distinctly up to a week earlier than wild-type controls. These effects were observed in each of two independent T1 plantings derived from separate transformation dates. These studies indicate that G485 acts as a floral activator and is also necessary in that role within the plant.

Utilities

Based on the loss of function and gain of function phenotypes, G485 or its orthologs could be used to modify flowering time.

The delayed flowering displayed by G485 knockouts indicated that the gene or its orthologs might be used to manipulate the flowering time of commercial species. In particular, an extension of vegetative growth can significantly increase biomass and result in substantial yield increases.

The early flowering effects seen in the G485 overexpressors could be applied to accelerate flowering, or eliminate any requirement for vernalization.

G627 (SEQ ID NO: 121)
Published Information

G627 corresponds to AGAMOUS-LIKE 19 (AGL19) which was isolated by Alvarez-Buylla et al. (2000) *Plant J.* 24: 457-466. No genetic characterization of AGL19 has been reported, but it was found to be specifically expressed in the outer layers of the root meristem (lateral root cap and epidermis) and in the central cylinder cells of mature roots (Alvarez-Buylla et al. (2000), supra).

Experimental Observations

RT-PCR expression studies failed to detect G627 in any of the tissue types analyzed. This result partially agrees with the data of Alvarez-Buylla et al. (2000), supra, who found that the gene is expressed only in specific regions of the root. It is possible that such regions were not sufficiently represented, for G627 transcript to be detected in the whole root samples analyzed in expression studies. In later experiments, however, a G627 clone was isolated by high cycle PCR from a cDNA sample derived from mixed tissues, and transgenic lines were generated in which this clone was expressed from a 35S promoter.

A substantial proportion of the 35S::G627 lines flowered markedly earlier than control plants. Such effects were observed in both the T1 and T2 generations and indicate that the gene plays a role in the regulation of flowering time.

Utilities

Given the early flowering seen amongst the 35S::G627 transformants, the gene or its orthologs may be used to manipulate the flowering time of commercial species. In particular, G627 could be used to accelerate flowering, or eliminate any requirement for vernalization.

G975 (SEQ ID NO: 161)

Published Information

After its discovery by us, G975 has appeared in the sequences released by the *Arabidopsis* Genome Initiative (BAC F9L1, GenBank accession number AC007591).

Closely Related Genes from Other Species

The non-*Arabidopsis* gene most highly related to G975 (as detected in BLAST searches, 11-5-99) is represented by L46408 BNAF1258 Mustard flower buds *Brassica rapa* cDNA clone F1258. The similarity between G975 and the *Brassica rapa* gene represented by EST L46408 extends beyond the conserved AP2 domain that characterizes the AP2/EREBP family. In fact, this *Brassica rapa* gene appears to be more closely related to G975 than *Arabidopsis* G1387, indicating that EST L46408 may represent a true G975 ortholog. The similarity between G975 and *Arabidopsis* G1387 also extends beyond the conserved AP2 domain.

Experimental Observations

G975 was discovered by us and is a new member of the AP2/EREBP family (EREBP subfamily) of transcription factors. G975 is expressed in flowers and, at lower levels, in shoots, leaves, and siliques. GC-FID and GC-MS analyses of leaves from G975 overexpressing plants have shown that the levels of C29, C31, and C33 alkanes were substantially increased (up to 10-fold) compared to control plants. A number of additional compounds of similar molecular weight, presumably also wax components, also accumulated to significantly higher levels in G975 overexpressing plants. Although total amounts of wax in G975 overexpressing plants have not yet been measured, C29 alkanes constitute close to 50% of the wax content in wild-type plants (Millar et al. (1998) *Plant Cell* 11: 1889-1902), indicating that a major increase in total wax content occurs in these transgenic plants. However, the transgenic plants had an almost normal phenotype (small morphological differences are detected in leaf appearance), indicating that overexpression of G975 is not deleterious to the plant. It is noteworthy that overexpression of G975 did not cause the dramatic alterations in plant morphology that have been reported for *Arabidopsis* plants in which the FATTY ACID ELONGATION1 gene was overexpressed (Millar et al. (1998) supra). G975 could specifically regulate the expression of some of the genes involved in wax metabolism. One *Arabidopsis* AP2 gene was found that is significantly more closely related to G975 than the rest of the members of the AP2/EREBP family. This other gene, G1387, may have a function, and therefore a utility, related to that of G975.

Plants overexpressing G975 were significantly larger and greener than wild-type control plants in a soil-based drought assay.

Utilities

G975 or its equivalogs could be used to improve a plant's tolerance to drought or low water conditions.

G975 or its equivalogs could be used to manipulate wax composition, amount, or distribution, which in turn could modify plant tolerance to drought and/or low humidity or resistance to insects, as well as plant appearance (shiny leaves). A possible application for this gene or its equivalogs might be in reducing the wax coating on sunflower seeds (the wax fouls the oil extraction system during sunflower seed processing for oil). For this purpose, antisense or co-suppression of the gene in a tissue specific manner might be useful.

G975 could also be used to specifically alter wax composition, amount, or distribution in those plants and crops from which wax is a valuable product.

G1011 (SEQ ID NO: 163)

Published Information

G1011 was identified in the sequence of P1 clone MTG10 (gene MTG10.20, GenBank accession number BAB10179.1). No information is available about the function(s) of G1011.

Experimental Observations

The complete cDNA sequence of G1011 was determined, and the initial BAC annotation in GenBank was found to be incorrect. The G1011 cDNA sequence has now been confirmed by a number of full-length cDNA sequences, which have recently been deposited in GenBank.

G1011 function was examined via analysis of a T-DNA insertion mutant for the gene. However, plants that were homozygous for this insertion displayed a wild-type phenotype in all assays performed. Additionally, RT-PCR studies on wild-type plants revealed G1011 expression to be ubiquitously expressed at low levels in a range of tissues.

We have now assessed the role of G1011 by analysis of transgenic *Arabidopsis* lines in which the gene was overexpressed. 35S::G1011 transformants appeared wild-type in the physiology assays, but did displayed a number of interesting developmental changes during the morphological assays. First, around half of the lines were markedly early flowering. Such effects were observed under either inductive (24-hour light) or non-inductive (12-hour light) photoperiodic conditions, indicating that G1011 might have a central role in determining the timing of the floral transition. Interestingly, under 12-hour light conditions, the lines also developed shorter, more rounded leaves than wild type, but this was not seen under continuous light.

As well as the effects on flowering time, many of the 35S::G1011 lines displayed alterations in flower morphology; floral organs often had alterations in shape or number and petals were rather narrow and green. In particular, it was noted that floral organ abscission was somewhat delayed compared to wild-type flowers, with stamens, petals, and sepals persisting following pollination. It is noteworthy that Ferrandiz et al. ((2000) *Plant Cell* 12, 183-198) reported similar phenotypes as a result of overexpression of another MADS gene, AGL15.

Utilities

Based on the phenotypes observed in morphological assays, G1011 could have a number of applications.

Given its effects on the floral transition, G1011 might be used to manipulate the flowering time of commercial species.

In particular, the gene could be use to accelerate flowering or to eliminate any requirement for vernalization.

The effects on flower morphology are also of commercial interest. G1011 might be used to modify flower development, in order to change form of flowers and fruits. This could create attractive new varieties or be used to influence pollination efficiency. The persistence of outer whorl organs following pollination is also of interest; such a trait could be applied to ornamental plants to prolong the life of blooms.

G1274 (SEQ ID NO: 193)
Published Information

G1274 is a member of the WRKY family of transcription factors. The gene corresponds to WRKY51 (At5g64810). No information is available about the function(s) of G1274.

Experimental Observations

RT-PCR analysis was used to determine the endogenous expression pattern of G1274. Expression of G1274 was detected in leaf, root and flower tissues. The biotic stress related conditions, *Erysiphe* and SA induced expression of G1274 in leaf tissue. The gene also appeared to be slightly induced by osmotic and cold stress treatments and perhaps by auxin.

The function of G1274 was studied using transgenic plants in which the gene was expressed under the control of the 35S promoter. G1274 overexpressing lines were more tolerant to growth on low nitrogen containing media. In an assay intended to determine whether the transgene expression could alter C/N sensing, 35S::G1274 seedlings contained less anthocyanins (FIG. 5A) than wild-type controls (FIG. 5B) grown on high sucrose/N– and high sucrose/N/Gln plates. These data together indicated that overexpression of G1274 may alter a plant's ability to modulate carbon and/or nitrogen uptake and utilization.

Figure 5D:
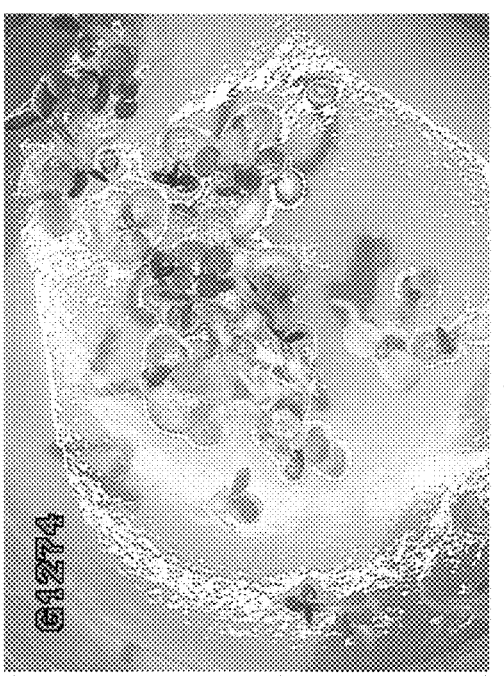

G1274 overexpression and wild-type germination were also compared in a cold germination assay, the overexpressors appearing larger and greener (FIG. 5C) than the controls (FIG. 5D).

FIGS. 6A-6D compare soil-based drought assays for G1274 overexpressors and wild-type control plants, which confirms the results predicted after the performance of the plate-based osmotic stress assays. 35S::G1274 lines fared much better after a period of water deprivation (FIG. 6A) than control plants in (FIG. 6B). This distinction was particularly evident in the overexpressor plants after once again being watered, said plants almost all fully recovered to a healthy and vigorous state in FIG. 6C. Conversely, none of the wild-type plants seen in FIG. 6D recovered after rewatering, as it was apparently too late for rehydration to rescue these plants.

In addition, 35S::G1274 transgenic plants were more tolerant to chilling compared to the wild-type controls, in both germination as well as seedling growth assays.

35S::G1274 overexpression plants were significantly greener and larger than wild-type control plants in a soil-based drought assay.

Overexpression of G1274 produced alterations in leaf morphology and inflorescence architecture. Four out of eighteen 35S::G1274 primary transformants were slightly small and developed inflorescences that were short, and showed reduced internode elongation, leading to a bushier, more compact stature than in wild-type.

In an experiment using T2 populations, it was observed that the rosette leaves from many of the plants were distinctly broad and appeared to have a greater rosette biomass than in wild type.

A similar inflorescence phenotype was obtained from overexpression of a potentially related WRKY gene, G1275. However, G1275 also caused extreme dwarfing, which was not apparent when G1274 was overexpressed.

Utilities

The phenotypic effects of G1274 overexpression could have several potential applications:

The enhanced performance of 35S::G1274 plants in a soil-based drought assay indicated that the gene or its equivalogs may be used to enhance drought tolerance in plants.

The enhanced performance of 35S::G1274 seedlings under chilling conditions indicates that the gene or its equivalogs might be applied to engineer crops that show better growth under cold conditions.

The morphological phenotype shown by 35S::G1274 lines indicate that the gene or its equivalogs might be used to alter inflorescence architecture, to produce more compact dwarf forms that might afford yield benefits.

The effects on leaf size that were observed as a result of G1274 or equivalog overexpression might also have commercial applications. Increased leaf size, or an extended period of leaf growth, could increase photosynthetic capacity, and biomass, and have a positive effect on yield.

G1357 (SEQ ID NO: 207)
Published Information

G1357 corresponds to gene At3g44290, annotated by the *Arabidopsis* Genome Initiative. No information is available about the function(s) of G1357.

Experimental Observations

The complete sequence of G1357 was experimentally determined. G1357 expression was not detected in wild-type plants under our experimental conditions. The function of this gene was analyzed using transgenic plants in which G1357 was expressed under the control of the 35S promoter.

35S::G1357 seedlings were more tolerant to chilling stress in a growth assay and insensitive to ABA in a germination assay. Morphologically, overexpression of G1357 in *Arabidopsis* produced alterations in coloration, leaf shape, and a marked delay in the time to flowering. At the earliest stages, G1357 seedlings appeared normal, but towards the mid-rosette stage, the plants developed a darker green coloration and the leaves became slightly rounder than those of wild-type. Additionally, many lines were also slightly smaller than controls. The majority of lines produced flower buds markedly late, with the most severely affected individuals flowering approximately 1 month later than wild type under continuous light conditions.

In a soil based drought assay, G1357 overexpressing plants were significantly greener and larger than wild-type control plants.

It should be noted that a highly related gene, G1452 (analyzed in phase I) had similar endogenous expression patterns, and produced similar effects on coloration, leaf shape, flowering time, abiotic stress resistance, and ABA sensitivity.

Utilities

The results of physiological assays indicated that G1357 gene or its equivalogs could be used to improve a plant's tolerance to chilling stress and drought.

Enhanced chilling tolerance could also extend the effective growth range of chilling sensitive crop species by allowing earlier planting or later harvest.

The delayed flowering displayed by 35S::G1357 transformants indicated that the gene or its equivalogs might be used to manipulate the flowering time of commercial species. In particular, an extension of vegetative growth can significantly increase biomass and result in substantial yield increases.

Given the effects of G1357 overexpression, it is likely that the activity of the gene or its equivalogs could be modified to accelerate flowering, or eliminate any requirement for vernalization.

Additionally, if the dark coloration of 35S::G1357 lines reflects an increase in biochemical composition, this gene or its equivalogs might be used to improve the nutraceutical value of foodstuffs, or increase photosynthetic capacity to improve yield.

G1452 (SEQ ID NO: 225)
Published Information

G1452 was identified in the sequence of clones T22013, F12K2 with accession number AC006233 released by the *Arabidopsis* Genome Initiative. No information is available about the function(s) of G1452.

Experimental Observations

The function of G1452 was analyzed using transgenic plants in which the gene was expressed under the control of the 35S promoter. Overexpression of G1452 produced changes in leaf development and markedly delayed the onset of flowering. 35S::G1452 plants produced dark green, flat, rounded leaves, and typically formed flower buds between 2 and 14 days later than controls. Additionally, some of the transformants were noted to have low trichome density on leaves and stems. At later stages of life cycle, 35S::G1452 plants developed more slowly and senesced considerably later than wild-type controls. In addition, G1452 overexpressors were more tolerant to osmotic stress, and were insensitive to ABA in separate germination assays.

G1452 expression was not detected in any tissue tested by RT-PCR and was not induced by any environmental stress-related condition tested.

Utilities

On the basis of the analyses performed to date, G1452 or its equivalogs could be use to alter plant growth and development. In addition, G1452 or its equivalogs could be used to alter a plant's response to water deficit conditions and therefore, could be used to engineer plants with enhanced tolerance to drought and salt stress.

G1482 (SEQ ID NO: 233)
Published Information

G1482 was identified as a gene in the sequence of BAC F10A5, GenBank accession number AC006434, released by the *Arabidopsis* Genome Initiative. There is no other published or public information about G1482.

Experimental Observations

The sequence of G1482 was experimentally determined Homozygous plants harboring a T-DNA insertion in G1482 displayed significantly more root growth on MS control plates as well as on different stresses in three separate experiments.

The function of G1482 was studied using transgenic plants in which the gene was expressed under the control of the 35S promoter G1482 overexpression in *Arabidopsis* resulted in visually high levels of the anthocyanin pigment production throughout the plant.

Utilities

Based on the phenotypes produced when this gene is knocked out, G1482 or its orthologs can be used to manipulate root growth, particularly in response to environmental stresses such as drought and low nutrients.

In addition, G1482 or its orthologs could be used to modulate anthocyanin levels. The potential utilities of genes involved in anthocyanin production include alterations in pigment production for horticultural purposes and increase stress resistance perhaps in combination with other transcription factors. Flavonoids have antimicrobial activity and could be used to engineer pathogen resistance. In addition, several flavonoid compounds have health promoting effects such as the inhibition of tumor growth and cancer, prevention of bone loss and the prevention of the oxidation of lipids. Given that the phenylpropanoid biosynthetic pathway (from which anthocyanins are produced) feeds into the pathways for the production of a number of other classes of secondary metabolites, such as lignins and tannins, changing the activity of G1482 or its orthologs might also influence the levels of those types of compounds.

G1510 (SEQ ID NO: 241)
Published Information

G1510 was identified in the sequence of P1 clone MPI10, GenBank accession number AB020747, released by the *Arabidopsis* Genome Initiative. There is no other published or public information about G1510.

Experimental Observations

The 5' and 3' ends of G1510 were experimentally determined by RACE. RT-PCR expression analysis showed that G1510 is expressed in all tissues except roots, suggesting that the gene could have a role within green tissues.

The function of this gene was analyzed using transgenic plants in which G1510 was expressed under the control of the 35S promoter. 35S::G1510 plants showed a dramatic change in coloration and were much darker green compared to controls. Green pigmentation also extended into the hypocotyls and roots from these plants, suggesting that the native function of G1510 could be related to plastid differentiation, chlorophyll production, or the regulation of chloroplast number. 35S::G1510 also exhibited disproportionately long hypocotyls, indicating that the gene could influence light-regulated developmental processes.

Utilities

The increased pigmentation indicated that 35S::G1510 plants had altered levels of chlorophylls or carotenoids. As such the gene or its orthologs could have a number of valuable applications.

Enhanced chlorophyll and carotenoid levels could improve yield and nutritional value in crop plants. For instance lutein, like other xanthophylls such as zeaxanthin and violaxanthin, is an essential component in the protection of the plant against the damaging effects of excessive light. Specifically, lutein contributes to the rapid rise of non-photochemical quenching in plants exposed to high light. Crop plants engineered to contain higher levels of lutein could therefore have improved photo-protection, possibly leading to less oxidative damage and better growth under high light. Additionally, elevated chlorophyll levels might increase photosynthetic capacity, and hence yield.

G1510 or its orthologs might be also applied to improve the nutraceutical value of foodstuffs. For example, consumption of dark green leafy vegetables has been shown in clinical studies to reduce the risk of age-related macular degeneration (ARMD), the leading cause of blindness in elderly people.

G1660 (SEQ ID NO: 263)
Published Information

G1660 was identified by amino acid sequence similarity to other DNA-binding proteins. G1660 is found in the sequence of the chromosome 2 BAC clone F504 (GenBank accession number AC005936, nid=g4038029), released by the *Arabidopsis* Genome Initiative. No information related to the functional characterization of G1660 is currently available from the public literature.

Experimental Observations

The 5' and 3' ends of G1660 were experimentally determined by RACE. The function of G1660 was studied using transgenic plants in which the gene was expressed under the control of the 35S promoter. Plants overexpressing G1660 had more root growth and seedling vigor when grown on media containing high salt, compared to wild-type control plants. Morphological analysis of transgenic plants revealed no phenotypic alterations.

Utilities

Based on the increased salt tolerance exhibited by the 35S::G1660 lines in physiology assays, this gene might be used to engineer salt tolerant crops and trees that can flourish in salinified soils, or under drought conditions.

G1730 (SEQ ID NO: 267)

Published Information

G1730 was identified in the sequence of BAC T32F12, GenBank accession number AC005314, released by the *Arabidopsis* Genome Initiative. There is no other published or public information about G1730.

Experimental Observations

The full-length cDNA clone corresponding to G1730 was isolated from a gene library. Based on RT-PCR experiments, G1730 was highly expressed in all tissues except roots, but was markedly repressed in rosette leaves by cold or osmotic stress.

The function of G1730 was studied using transgenic plants in which the gene was expressed under the control of the 35S promoter. 35S::G1730 plants showed wild-type morphology but displayed an enhanced performance compared to controls when subjected to osmotic stress in both mannitol and glucose germination assays. Given the expression profiles of the endogenous gene, and the putative role of RING C3H2C3 proteins in regulation of ubiquitin-dependent protein turnover, G1730 may act as a modulator of factors involved in the response to abiotic stress.

Utilities

The effects of osmotic stress on G1730 expression, and the phenotype seen in 35S::G1730 lines, indicated that the gene or its orthologs can be used to engineer plants with increased tolerance to abiotic stresses such as drought, salt, or cold.

G1779 (SEQ ID NO: 275)

Published Information

G1779 was identified from the *Arabidopsis* genomic sequence (GenBank accession number AL049483) based on its sequence similarity within the conserved domain to other GATA related proteins in *Arabidopsis*.

Experimental Observations

The function of this gene was initially studied by knockout analysis. Plants homozygous for a T-DNA insertion in G1779 were wild type for all assays performed.

Gene expression profiling using RT-PCR showed that G1779 is expressed in all tissues, albeit at higher levels in leaves.

The function of G1779 was studied using transgenic plants in which the gene was expressed under the control of the 35S promoter. Overexpression of G1779 resulted in plants that showed enhanced tolerance to chilling stress when grown under low temperatures for an extended period of time. The majority of 35S::G1779 plants were wild type in morphological analyses that were performed.

Utilities

G1779 might be used to improve chilling tolerance.

G1792 (SEQ ID NO: 277)

Published Information

G1792 was identified in the sequence of BAC clone K14B15 (AB025608, gene K14B15.14). No information is available about the function(s) of G1792.

Closely Related Genes from Other Species

G1792 shows sequence similarity, outside of the conserved AP2 domain, with a protein from tomato, represented by EST sequence AI776626 (AI776626 EST257726 tomato resistant, Cornell *Lycopersicon esculentum* cDNA clone cLER19A14, mRNA sequence). No functional information is available about this tomato gene.

Experimental Observations

The function of G1792 was studied using transgenic plants in which the gene was expressed under the control of the 35S promoter. 35S::G1792 plants were more tolerant to the fungal pathogens *Fusarium oxysporum* and *Botrytis cinerea*: they showed fewer symptoms after inoculation with a low dose of each pathogen. These results were confirmed using individual T2 lines. FIG. 7C shows a G1792 overexpressing line (labeled G1792-12; on left) and wild-type plants (on right) five days after inoculation with *Botrytis cinerea*, showing the chlorosis and hyphal growth in the latter control plants but not in the former overexpressors. Additional, experiments have confirmed that 35S::G1792 plants also showed increased tolerance to challenge with *Erysiphe*. Five days after inoculation with *Fusarium oxysporum*, the G1792 overexpressors, as seen on the left in FIG. 7D, showed little or no chlorosis, as compared with wild-type plants on the right of FIG. 7D.

The effect of G1792 overexpression in increasing tolerance to pathogens received further, incidental confirmation. T2 plants of 35S::G1792 lines 5 and 12 were being grown (for other purposes) in a room that suffered a serious powdery mildew infection. For each line, a pot of 6 plants was present in a flat containing 9 other pots of lines from unrelated genes. In either of the two different flats, the only plants that were free from infection were those from the 35S::G1792 line. This observation indicated that G1792 overexpression might increase resistance to powdery mildew. Interestingly, G1792 was ubiquitously expressed, but appeared to be induced by salicylic acid.

35S::G1792 overexpressing plants showed more tolerance to growth under nitrogen-limiting conditions. In a root growth assay under conditions of limiting N, 35S::G1792 lines were less stunted. In a germination assay that monitors the effect of C on N signaling through anthocyanin production on high sucrose plus and minus glutamine (Hsieh et al. (1998) *Proc. Natl. Acad. Sci.* U.S.A) 95: 13965-13970), the 35S::G1792 lines made less anthocyanin, showed greater cotyledon expansion and had more root growth on high sucrose medium supplemented with glutamine (FIG. 7A) than control plants (FIG. 7B), indicating that the gene could be involved in the plants' ability to monitor their carbon and nitrogen status.

35S::G1792 overexpressing plants were larger and greener than wild-type control plants in a soil-based drought assay.

G1792 overexpressing plants showed several mild morphological alterations: leaves were dark green and shiny, and plants bolted, subsequently senesced, slightly later than wild-type controls. Among the T1 plants, additional morphological variation (not reproduced later in the T2 plants) was observed: many showed reductions in size as well as aberrations in leaf shape, phyllotaxy, and flower development.

Utilities

G1792 or its equivalogs could be used to engineer pathogen-resistant plants.

In addition, G1792 or its equivalogs could also be used to improve seedling germination and performance under conditions of limited nitrogen, and plants with enhanced drought tolerance.

G1797 (SEQ ID NO: 281)

Published Information

G1797 was identified within P1 clone MJM18 (chromosome 5, GenBank accession AB025623) as one of a pair of novel, highly related, tandemly arranged MADS box genes (the other gene was G1798). A functional characterization of G1797 remains to be published.

Experimental Observations

To assess the function of G1797, transgenic *Arabidopsis* lines were analyzed in which the gene was overexpressed from a CaMV promoter. 35S::G1797 transformants were very early flowering, had curled leaves, and retained outer whorl floral organs for a prolonged period following pollination and silique outgrowth. These phenotypes indicated that G1797 might influence genetic pathways that regulate flowering time or floral organ senescence and abscission. However, despite these changes in growth and development, 35S::G1797 lines displayed a wild type response in all of the physiological assays.

It should be noted that accelerated flowering and changes in flower morphology were also observed as a result of overexpression of the putative paralog, G1798, indicating that the two genes have related functions. Two other related genes, G627 and G1011, also produced very similar effects to G1797 and G1798 when overexpressed.

Interestingly, equivalent effects on perianth organs to those described above were obtained by Fernandez et al. ((2000) *Plant Cell* 12: 183-198) through overexpression of AGAMOUS-LIKE 15 (AGL15). G1797 and AGL15 occupy different clades within the MADS family, but the similarity in phenotype may indicate that they act in common pathways.

Utilities

The accelerated switch to reproductive growth seen in 35S::G1797 plants, indicated that the gene or its equivalogs could be used to manipulate flowering time in commercial species. Specifically, G1797 could be used to accelerate flowering, or eliminate any requirement for vernalization. Conversely, it is possible that the activity of G1797 or its equivalogs could be modified to delay flowering. In particular, an extension of vegetative growth can significantly increase biomass and result in substantial yield increases.

The effects on flower development are also of commercial interest; the persistence of outer whorl organs following pollination in 35S::G1797 lines indicated that the gene or its equivalogs could be applied to ornamental plants to prolong the life of blooms.

G1798 (SEQ ID NO: 283)

Published Information

G1798 was identified within P1 clone MJM18 (chromosome 5, GenBank accession AB025623) as one of a pair of novel, highly related, tandemly arranged MADS box genes (the other gene was G1797). A functional characterization of G1798 remains to be published.

Experimental Observations

To assess the function of G1798, we analyzed transgenic *Arabidopsis* lines in which the gene was overexpressed from a CaMV promoter. 35S::G1798 transformants were very early flowering, had curled leaves, were very small and displayed severe abnormalities in flower development. As a result of such defects, the plants showed very poor fertility and insufficient seed was obtained to perform physiological assays. Additionally, a number of 35S::G1798 lines displayed terminal flowers, indicating that the gene could influence meristem determinacy.

It should be noted that accelerated flowering and changes in flower development were also observed as a result of overexpression of the putative paralog, G1797, indicating that the two genes have related functions. Interestingly, 35S::G1797 lines exhibited delayed floral organ abscission; such a phenotype might also have been prevalent in 35S::G1798 plants, but could have been masked by the severe sterility of these lines. Two other related genes, G627 and G1011 also produced very similar effects to G1797 and G1798 when overexpressed.

Utilities

The accelerated switch to reproductive growth seen in 35S::G1798 plants, indicated that the gene or its equivalogs could be used to manipulate flowering time in commercial species. Specifically, G1798 could be used to accelerate flowering, or eliminate any requirement for vernalization. Conversely, it is possible that the activity of G1798 or its equivalogs could be modified to delay flowering. In particular, an extension of vegetative growth can significantly increase biomass and result in substantial yield increases.

The effects on flower and inflorescence development are also of commercial interest and indicated that the gene or its equivalogs might be used to manipulate floral traits such as sterility or fruit development, or to produce novel plant architectures.

G1816 (SEQ ID NO: 287)

Published Information

G1816 is a member of the MYB-related class of transcription factors. The gene corresponds to TRIPTYCHON (TRY), and has recently been shown to be involved in the lateral inhibition during epidermal cell specification in the leaf and root (Schellmann et al. (2002) *EMBO J.* 21: 5036-5046). The model proposes that TRY (G1816) and CPC (G225) function as repressors of trichome and atrichoblast cell fate. TRY loss-of-function mutants form ectopic trichomes on the leaf surface. TRY gain-of-function mutants are glabrous and form ectopic root hairs.

Experimental Observations

The complete sequence of G1816 was determined The function of the gene was studied using transgenic plants in which G1816 was expressed under the control of the 35S promoter. Consistent with the morphological phenotypes published for the 35S::TRY overexpressors, the transgenic plants were glabrous and form ectopic root hairs. These transgenic lines were also more tolerant to growth under nitrogen-limiting conditions, both in a germination assay as well as a root growth assay on older seedlings. In addition to the nitrogen-limiting tolerance phenotypes observed in these transgenic lines, the 35S::G1816 plants were also insensitive to growth retardation effects of germination on conditions of high glucose, indicating that this gene could play a role in sugar sensing responses in the plant or osmotic stress tolerance. Genes for many sugar-sensing mutants are allelic to genes involved in abscisic acid and ethylene signaling (Rolland et al. (2002) *Plant Cell* 14: Suppl. S185-S205). Therefore, G1816 could also be involved in hormone signaling pathways.

Utilities

The phenotypic effects of G1816 overexpression, such as the increase in root hair formation and the increase in seedling vigor observed in a germination assay on high glucose media, indicated that the gene or its orthologs can be used to engineer plants with increased tolerance to abiotic stresses such as drought, salt, heat or cold.

In addition, the enhanced performance of G1816 overexpression lines under low nitrogen conditions indicated that the gene or its orthologs could be used to engineer crops that could thrive under conditions of reduced nitrogen availability.

The effect of G1816 overexpression on insensitivity to glucose in a germination assay, indicated that the gene or its orthologs could be involved in sugar sensing responses in the plant.

G1816 or its orthologs could also be used to alter anthocyanin production and trichome formation in leaves.

The potential utilities of genes involved in anthocyanin production include alterations in pigment production for horticultural purposes and increase stress resistance perhaps in combination with other transcription factors. Flavonoids have antimicrobial activity and could be used to engineer pathogen resistance. In addition, several flavonoid compounds have health promoting effects such as the inhibition of tumor growth and cancer, prevention of bone loss and the prevention of the oxidation of lipids.

Given that the phenylpropanoid biosynthetic pathway (from which anthocyanins are produced) feeds into the pathways for the production of a number of other classes of secondary metabolites, such as lignins and tannins, changing the activity of G1816 or its orthologs might also influence the levels of those types of compounds.

G1863 (SEQ ID NO: 303)
Published Information

G1863 was identified by amino acid sequence similarity to rice Growth-regulating-factor1 (GRF1), which has a potential role in the regulation of stem growth (Knaap et al. (2000) *Plant Physiol.* 122: 695-704). G1863, which has also been referred to as *Arabidopsis* GRL3, is found in the sequence of chromosome II section 199 of 255 (GenBank accession AC006919.5 GI:6598632), released by the *Arabidopsis* Genome Initiative. No information related to the functional characterization of G1863 is currently available from the public literature.

Experimental Observations

G1863 was found to be ubiquitously expressed, but had lower levels of expression in the stems of shoots than in other tissues. It was also determined that homozygotes for a T-DNA insertion within G1863 showed increased sensitivity to NaCl in germination assays.

35S::G1863 overexpressing transformants displayed a wild-type response in the physiology assays, but did display a number of morphological phenotypes. Plants that overexpress G1863 had larger leaves that had higher levels of chlorophyll per unit area. These plants were dark in coloration, showed changes in leaf shape, and delayed flowering.

Utilities

G1863 or its orthologs could be used to generate salt or drought tolerant crops.

The overexpression data indicate that the gene could have a number of additional applications.

The delayed flowering displayed by 35S::G1863 transformants indicated that the gene or its orthologs might be used to manipulate the flowering time of commercial species. In particular, an extension of vegetative growth can significantly increase biomass and result in substantial yield increases.

Conversely, the activity of G1863 or its orthologs might be modified to accelerate flowering, or eliminate any requirement for vernalization.

This transcription factor or its orthologs could be used to improve plant productivity through increased biomass or yield and/or improve the nutraceutical value of foodstuffs, or increase photosynthetic capacity to improve yield. With regard to the former, consumption of dark green leafy vegetables has been shown in clinical studies to reduce the risk of age-related macular degeneration (ARMD), the leading cause of blindness in elderly people.

The changes in leaf shape shown by 35S::G1863 plants also indicated that the gene or its orthologs could be used to engineer changes in plant form.

G1988 (SEQ ID NO: 327)
Published Information

G1988 (At3g21150) is in P1 clone MSA6 (GenBank accession number AP000604) and was identified based on its sequence similarity within the conserved domain to other CONSTANS-like related proteins in *Arabidopsis*. There is no published or public information about the function of G1988.

Experimental Observations

The function of G1988 was studied using transgenic plants in which the gene was expressed under the control of the 35S promoter. Evidence from physiological and morphological assays indicates that G1988 may play a role in developmental processes regulated by light; 35S::G1988 seedlings displayed longer hypocotyls, elongated petioles, and a number of lines flowered early.

When grown on limited phosphate, all lines appeared larger and had more root growth than controls. Seedlings germinated on plates that contained limited nitrogen (supplemented with glutamine) appeared less stressed than controls.

Utilities

Based on the results from physiological assays, G1988 might be used to engineer plants that show enhanced growth and survivability in low nutrient environments.

G1988 could also have a role in modulating developmental processes regulated by light, such as shade avoidance. Eliminating shading responses could lead to increased planting densities with subsequent yield enhancement. The gene might also be useful in manipulating flowering time.

G2041 (SEQ ID NO: 341 and SEQ ID NO: 2110)
Published Information

The transcriptional regulator G2041 was identified by amino acid sequence similarity to proteins of the SWI/SNF family of chromatin remodeling factors. G2041 is found in the sequence of the chromosome 3, BAC clone T12K4 (AL138640.1 GI:6899910), released by the *Arabidopsis* Genome Initiative. No additional public information related to the functional characterization of G2041 is available.

Experimental Observations

The function of G2041 was analyzed through its overexpression in *Arabidopsis*; 35S::G2041 lines displayed no consistent morphological changes when compared to control plants. However, the overexpression lines were more tolerant to salt stress in a germination assay. It should be noted that since a truncated version of the gene (SEQ ID NO: 2110) was overexpressed, the phenotype obtained could be a dominant negative type effect.

Utilities

The results of physiological assays indicate that G2041 or its equivalogs could be modify abiotic stress responses. Given the salt resistance exhibited by 35S::G2041 transformants, the gene or its equivalogs might be used to engineer salt tolerant crops and trees that can flourish in saline soils, or under drought conditions.

G2133 (SEQ ID NO: 1495)
Published Information

G2133 corresponds to gene F26A9.11 (AAF23336). No information is available about the function(s) of G2133.

Closely Related Genes from Other Species

G2133 does not show extensive sequence similarity with known genes from other plant species outside of the conserved AP2/EREBP domain.

Experimental Observations

The function of G2133 was studied using transgenic plants in which the gene was expressed under the control of the 35S promoter.

G2133 expression was detected in a variety of tissues: flower, leaf, embryo, and silique samples. Its expression might be altered by several conditions, including auxin treatment, osmotic stress, and *Fusarium* infection. Overexpression of G2133 caused a variety of alterations in plant growth and development: delayed flowering, altered inflorescence architecture, and a decrease in overall size and fertility.

At early stages, 35S::G2133 transformants were markedly smaller than controls and displayed curled, dark-green leaves. Most of these plants remained in a vegetative phase of development substantially longer than controls, and produced an increased number of leaves before bolting. In the most severely affected plants, bolting occurred more than a month later than in wild type (24-hour light). In addition, the plants displayed a reduction in apical dominance and formed large numbers of shoots simultaneously, from the axils of rosette leaves. These inflorescence stems had short internodes, and carried increased numbers of cauline leaf nodes, giving them a very leafy appearance. The fertility of 35S::G2133 plants was generally very low. In addition, G2133 overexpressing lines were found to be more resistant to the herbicide glyphosate in initial and repeat experiments.

No alterations were detected in 35S::G2133 plants in the biochemical analyses that were performed.

G2133 is a paralog of G47, the latter having been known from earlier studies to confer a drought tolerance phenotype when overexpressed. It was thus not surprising when G2133 was also shown to induce drought tolerance in a number of 35S::G2133 lines challenged in soil-based drought assays. Results with two of these lines are shown in FIGS. 10A and 10B, which compare the recovery of these lines from eight days of drought treatment with that of wild-type controls. After re-watering, all of the plants of both G2133 overexpressor lines became reinvigorated, and all of the control plants died or were severely affected by the drought treatment.

Utilities

G2133 could be used for the generation of glyphosate resistant plants, and to increase plant resistance to oxidative stress.

G2133 can be used to increase the tolerance of plants to drought and likely to other osmotic stresses as well.

G2142 (SEQ ID NO: 365)

Published Information

G2142 was identified by amino acid sequence similarity to other HLH/MYC proteins. G2142 is found in the sequence of the chromosome 1 BAC clone T6L1 (GenBank accession number AC011665, nid=g6358759), released by the *Arabidopsis* Genome Initiative. No information related to the functional characterization of G2142 is currently available from the public literature.

Experimental Observations

The function of G2142 was studied using transgenic plants in which the gene was expressed under the control of the 35S promoter. A small number of the 35S::G2142 plants displayed a slight acceleration of flowering compared to controls. Additionally, G2142 overexpressors were more tolerant to phosphate deprivation in a root growth assay, but this effect was rather subtle.

Utilities

The results of physiological assays indicate that G2142 could be used to improve plant performance in conditions of limited phosphate.

G2207 (SEQ ID NO: 371)

Published Information

G2207 (At1g20640) was identified as part of the BAC clone F5M15, GenBank accession number AC027665 (nid=8096769).

Experimental Observations

The complete sequence of G2207 was determined. The function of the gene was analyzed using transgenic plants in which a genomic clone for G2207 was expressed under the control of the 35S promoter. In germination assays, 35S:: G2207 lines showed increased tolerance to osmotic stress under conditions of high salt or high sucrose and were less sensitive to abscisic acid. All these phenotypes indicate that G2207 is involved in the plant response to dehydration stress. A small number of the lines also showed delayed flowering, indicating that the gene regulates the timing of the floral transition.

The bZIP-NIN gene G2207 does not share significant homology to any of the bZIP genes, for some of which a role in abscisic acid signaling has been reported (ABF1=G2071, ABF2=G3028, ABF3=G570, ABF4=G1058; Choi et al. (2000) *J. Biol. Chem.* 275: 1723-1730).

Utilities

G2207 appears to affect ABA sensitivity. ABA is one of the key signal molecules in the stress response pathways. G2207 may have a utility in modifying ABA responses such as seed dormancy, seed development, and cold and/or drought tolerances.

In particular, based on the increased tolerance to high levels of salt or sucrose, exhibited by the 35S::G2207 lines in physiology assays, this gene might be used to engineer crops and trees that can flourish in salinified soils, or under drought conditions.

Although the increased sucrose tolerance observed for 35S::G2207 lines is most likely related to a general dehydration stress tolerance, the gene might be involved in sugar sensing. Thus G2207 might also be used to generate crop plants with altered sink source relations.

The late flowering shown by 35S::G2207 lines indicates that the gene might be used to manipulate the flowering time of commercial species. In particular, an extension of vegetative growth can significantly increase biomass and result in substantial yield increases.

Additionally, if the dark coloration of 35S::G2207 lines reflects an increase in biochemical composition, the gene might be used to improve the nutraceutical value of foodstuffs, or increase photosynthetic capacity to improve yield.

G2334 (SEQ ID NO: 393)

Published Information

G2334 was identified by amino acid sequence similarity to the rice Growth-regulating-factor1 (GRF1), which has a potential role in the regulation of stem growth in rice (Knapp et al (2000) *Plant Physiol.* 122: 695-704). It is found in the sequence of chromosome 3, BAC clone F8J2 (AL132969.2 GI:7629988), released by the *Arabidopsis* Genome Initiative. No information related to the functional characterization of G2334 is currently available from the public literature.

Experimental Observations

The function of G2334 was analyzed through its overexpression in *Arabidopsis*; 35S::G2334 lines displayed marked delay in the onset of flowering, developed large wrinkled dark green leaves, and had substantially greater vegetative biomass than wild-type controls.

It should be noted that the effects of G2334 overexpression are very similar to those produced by overexpression of a related gene G1863, indicating that the two genes might have overlapping functions.

Utilities

The overexpression data indicate that G2334 could have a number of applications.

The phenotypes displayed by 35S::G2334 transformants indicated that the gene or its equivalogs might be used to increase size or manipulate the flowering time of commercial species. Conversely, the activity of G2334 or its equivalogs might be modified to accelerate flowering, or eliminate any requirement for vernalization.

Additionally, if the altered coloration of 35S::G2334 plants reflects a change in biochemical composition, the gene or its equivalogs might be used to improve the nutraceutical value of foodstuffs, for example, by reducing the risk of ARMD, or increase photosynthetic capacity to improve yield.

The changes in leaf shape shown by 35S::G2334 plants indicated that the gene or its equivalogs could be used to engineer changes in plant form.

G2717 (SEQ ID NO: 505)
Published Information

G2717 corresponds to gene At1g49950, and it has also been described as Telomere Repeat Binding Factor 1 (TRBF1). No information is available about the function(s) of G2717.

Experimental Observations

The function of the gene was studied using transgenic plants in which the gene was expressed under the control of the 35S promoter. 35S::G2717 lines were wild type with respect to their morphology and development. However, the G2717 overexpressors appeared to be more tolerant to osmotic stress in germination assays. Seedlings from all three transgenic lines were larger than wild-type seedlings at the same developmental stage on control media.

In a soil based drought assay, G2717 overexpressing plants were significantly larger and greener than wild-type control plants.

Utilities

Based on the increased salt, osmotic stress and drought tolerance exhibited by the 35S::G2717 plants in physiology assays, this gene or its equivalogs may be used to engineer salt tolerant crops and trees that can flourish in salinified soils, or under drought conditions.

Since 35S::G2717 seedlings were slightly larger than controls, the gene or its equivalogs could also be used to accelerate the rate of germination and growth of plants.

G2718 (SEQ ID NO: 507)
Published Information

G2718 (AT1G01380) was identified in the BAC clone, F6F3 (GenBank accession AC023628). Two highly related genes, TRY and CPC have been implicated in epidermal cell specification. A lateral inhibition model proposes that TRY (G1816) and CPC (G225) function as repressors of trichome and atrichoblast cell fate (Shellmann et al. (2002) *EMBO J.* 21: 5036-5046). A comprehensive review on epidermal cell-fate specification has been published recently (Schiefelbein (2003) *Curr. Opin. Plant Biol.* 6: 74-78).

Experimental Observations

The function of G2718 was studied using plants in which the gene was expressed under the control of the 35S promoter. Overexpression of G2718 resulted in a glabrous phenotype. The effect was highly penetrant, being observed in all primary transformants and each of three independent T2 lines. All of the T1 lines showed a very strong phenotype and completely lacked trichomes on leaves and stems. A comparably severe effect was observed in one of the three T2 populations, whereas the other two T2 populations each exhibited a weaker phenotype, indicating that the effect might have become partially silenced between the generations. Trichomes were present in these weaker lines, but at a much lower density than in wild type.

In addition to the effects on trichome density, 35S::G2718 transformants were also generally slightly smaller than wild type controls.

The phenotypic effects above were observed in the 35S::G2718 as well as in all 35S lines from members of the G2718 clade (G225, G226, G1816, and G682). Similarly, 35S::TF lines from the G2718 clade all had increased root hair formation, reduced anthocyanin levels, and showed improved growth under nitrogen limiting conditions, indicating that the genes improve nutrient uptake. It should be noted however, that due to the apparent silencing of the transgene in the T2 generation, only two of three 35S::G2718 lines examined displayed these phenotypes.

Utilities

The phenotypic effects of G2718 overexpression, such as the increase in root hair formation and the increase in seedling vigor observed in a root growth assay on N-limiting media, indicates that the gene or its equivalogs could be used to engineer plants with increased tolerance to abiotic stresses such as nutrient limitation, drought, salt, heat or cold.

The enhanced performance of G2718 overexpression lines under low nitrogen conditions indicates that the gene or its equivalogs could be used to engineer crops that could thrive under conditions of reduced nitrogen availability.

G2718 or its equivalogs could also be used to alter anthocyanin production or trichome formation. and production of secondary biochemicals (e.g., lipophilic terpenes) by trichomes.

G2741 (SEQ ID NO: 511)
Published Information

G2741 was identified in the sequence of BAC F12A12, GenBank accession number AL133314, released by the *Arabidopsis* Genome Initiative. No functional information is available about G2741.

Experimental Observations

The function of G2741 was studied using transgenic plants in which the gene was expressed under the control of the 35S promoter. Five of the eighteen 35S::G2741 lines were significantly delayed in flowering and exhibited greater vegetative biomass than wild-type. No altered phenotypes were detected in any of the physiological assays.

It should be noted that G2741 is closely related to G1435, which also produced late flowering plants when overexpressed.

Utilities

The delayed flowering displayed by 35S::G2741 transformants indicated that the gene or its equivalogs might be used to manipulate the flowering time of commercial species. In particular, an extension of vegetative growth can significantly increase biomass and result in substantial yield increases. Given the effects of G2741 overexpression, it is possible that the activity of the gene or its equivalogs could be modified to accelerate flowering, or eliminate any requirement for vernalization.

G2933 (SEQ ID NO: 593)
Published Information

The sequence of G2933 was obtained from *Arabidopsis* genomic sequencing project, GenBank accession number AL138655, nid=6899905, based on its sequence similarity within the conserved domain to other bHLH related proteins in *Arabidopsis*.

Experimental Observations

The function of G2933 was assessed by analysis of transgenic *Arabidopsis* lines in which the cDNA was constitutively expressed from the 35S CaMV promoter. A small number of G2933 overexpression lines produced larger seeds than wild-type controls. The result indicates that G2933 is involved in the regulation of sink-source relationship in plants. In addition, seedlings of 35S::G2933 transgenic lines showed more tolerance to chilling stress in a growth assay. When the assay was repeated on individual lines, all three lines analyzed showed the phenotype.

Utilities

G2933 might be used to modify sink-source relationship and thereby enhance seed yield.

This gene could also be used to generate crop plants that have better growth under cold conditions. The growth of many crops is very sensitive to cool temperatures. A gene that enhances growth under chilling conditions could result in enhanced yields.

G2979 (SEQ ID NO: 607)
Published Information

The transcription factor G2979 was identified by amino acid sequence similarity to the mammalian E2F proteins. It has been referenced in the public literature both as E2L2 and E2Ff (Kosugi and Ohashi, (2002) *J. Biol. Chem.* 277: 16553-16558; Mariconti et al. (2002) *J. Biol. Chem.* 277: 9911-9919). G2979 is found in the sequence of the chromosome 3 BAC T22N4 (AC010676.6 GI:1240872), released by the *Arabidopsis* Genome Initiative. The G2979 product is thought to function as a repressor and be involved in restricting cell proliferation (Kosugi and Ohashi (2002) supra).

Experimental Observations

The function of G2979 was analyzed through its overexpression in *Arabidopsis*; 35S::G2979 lines displayed a mild delay in the onset of flowering, a marked increase in vegetative biomass, and increases in floral organ number. Its seems more likely that increased floral organ number and leaf size are related effects, and could both be due to a change in meristem activity, such as increased numbers of cells being allocated to organ primordia, or such cells going through additional rounds of cell division.

Utilities

Based on the substantially increased size of 35S::G2979 organs, the gene or its equivalogs could be used to increase plant biomass, thus improving yield. The increased flower size seen in such plants indicated that G2979 or its equivalogs could be applied to produce desirable flower and fruit traits.

Additionally, the slight delay in flowering observed in some of the 35S::G2979 lines indicated that the gene or its equivalogs might be used to manipulate the timing of reproductive growth. In particular, an extension of vegetative growth can significantly increase biomass and result in substantial yield increases. Conversely, it is possible that the activity of G2979 or its equivalogs could be modified to accelerate flowering, or eliminate any requirement for vernalization.

G2981 (SEQ ID NO: 609)
Published Information

G2981 is similar in its amino acid sequence to the mammalian DP2a, a dimerization partner to E2F required for the progression and arrest of the cell cycle in animals and plants. G2981 is in chromosome 5, BAC clone F12E4 (GenBank accession AL162751.1 GI:7378607), released by the *Arabidopsis* Genome Initiative. No public information related to the functional characterization of G2981 is available.

Experimental Observations

The boundaries of G2981 were determined by RACE (Rapid Amplification of cDNA Ends; a PCR-based method that facilitates the cloning of full-length cDNA sequences when a partial cDNA sequence is known) and its function was analyzed through overexpression in *Arabidopsis*. 35S::G2981 seedlings were larger and appeared to have less anthocyanin on plates that were nitrogen deficient, but which were supplemented with glutamine and high sucrose levels. This assay monitors the effect of carbon on nitrogen signaling through anthocyanin production.

Utilities

The enhanced performance of G2981 overexpression lines under low nitrogen conditions indicate that the gene could be used to engineer crops that could thrive under conditions of reduced nitrogen availability.

That 35S::G2981 lines make less anthocyanin on high sucrose plus glutamine, indicates G2981 might be used to modify carbon and nitrogen status, and hence assimilate partitioning.

G2982 (SEQ ID NO: 611)
Published Information

G2982 is found in the sequence of the chromosome 5, BAC clone T22P11 (GenBank accession AL162971.1 GI:7413630), released by the *Arabidopsis* Genome Initiative. The gene appears to have a role in cell cycle control (Magyar et al. (2000) *FEBS Lett.* 486:79-87) and its sequence has recently been included in patent publication WO0185946 A2.

Experimental Observations

The function of G2982 was analyzed through overexpression of a genomic clone in *Arabidopsis*. 35S::G2982 transformants displayed increased tolerance to dehydration stress. In all other respects, these transgenic lines appeared wild type.

In a soil based drought assay, G2982 overexpressing *Arabidopsis* plants were significantly greener and larger than wild-type control plants.

Utilities

The response of 35S::G2982 plants to dehydration stress indicated that G2982 or its equivalogs could be used to improve plant tolerance to cold, freezing, drought, and salt conditions.

G2990 (SEQ ID NO: 615)
Published Information

G2990 corresponds to gene MKM21.8 within P1 clone MKM21 (GenBank accession AB016876) derived from chromosome 5. We identified this locus as a novel member of the ZF-HB family and no data regarding its function are currently in the public domain (as of Aug. 5, 2002).

Experimental Observations

The boundaries of G2990 were identified by RACE experiments performed and a full-length clone was then PCR-amplified from cDNA derived from mixed tissue samples. Full-length cDNA sequences for this gene have recently been deposited in GenBank (Accessions AY091034 and AY117347), and the coding sequences are identical to that identified by us.

The function of G2990 was assessed by analysis of transgenic *Arabidopsis* lines in which the cDNA was constitutively expressed from a 35S CaMV promoter. Under normal growth circumstances, 35S::G2990 transformants displayed wild-type morphology. However, two of three independent T2 populations showed an altered response to nitrogen deprivation in plate-based assays, indicating that the gene might be involved in the response to conditions of nutrient limitation.

Utilities

The data from physiological assays, revealing that G2990 can influence the response to nitrogen deprivation, indicate that the gene might have utility in engineering commercial species that can be successfully cultivated in low nitrogen soils or growth media.

G3076 (SEQ ID NO: 655)
Published Information

G3076 (At4g18650) was identified as part of the BAC clone F28A21 (GenBank accession AL035526).

Experimental Observations

The function of G3076 was studied using plants in which the gene was expressed under the control of the 35S promoter.

Overexpression of G3076 produced no consistent alterations in *Arabidopsis* growth and development. However, G3076 overexpressing lines showed more tolerance to a severe drought stress treatment.

Utilities

The reduced sensitivity of 35S::G3076 lines in the dehydration assay indicated that the gene or its equivalogs might be used to engineer crops with increased water use efficiency or increased tolerance to stresses such as drought, salt, freezing and/or chilling stress.

G3083 (SEQ ID NO: 657)

Published Information

G3083 (At3g14880) is part of BAC clone K15M2, GenBank accession number AP000370 (nid=5541653).

Experimental Observations

The 5'- and 3'-ends of G3083 were determined by RACE and the function of the gene was assessed by analysis of transgenic *Arabidopsis* lines in which a genomic clone was constitutively expressed from a 35S promoter. In the physiological analysis, two out of the three 35S::G3083 lines tested, displayed an enhanced ability to germinate on plates containing high levels of sodium chloride. Thus, G3083 can function as part of a response pathway to abiotic stress. 35S::G3083 plants were indistinguishable from wild-type controls in the morphological analysis.

Utilities

Based on the increased salt tolerance exhibited by the 35S::G3083 lines in physiology assays, this gene might be used to engineer salt tolerant crops and trees that can flourish in salinified soils, or under drought conditions.

Example IX

Identification of Homologous Sequences

This example describes identification of genes that are orthologous to *Arabidopsis thaliana* transcription factors from a computer homology search.

Homologous sequences, including those of paralogs and orthologs from *Arabidopsis* and other plant species, were identified using database sequence search tools, such as the Basic Local Alignment Search Tool (BLAST) (Altschul et al. (1990) *J. Mol. Biol.* 215: 403-410; and Altschul et al. (1997) *Nucleic Acid Res.* 25: 3389-3402). The tblastx sequence analysis programs were employed using the BLOSUM-62 scoring matrix (Henikoff and Henikoff (1992) *Proc. Natl. Acad. Sci.* 89: 10915-10919). The entire NCBI GenBank database was filtered for sequences from all plants except *Arabidopsis thaliana* by selecting all entries in the NCBI GenBank database associated with NCBI taxonomic ID 33090 (Viridiplantae; all plants) and excluding entries associated with taxonomic ID 3701 (*Arabidopsis thaliana*).

These sequences are compared to sequences representing genes of the Sequence Listing, for example, SEQ ID NO: 2N−1, wherein N=1-335, using the Washington University TBLASTX algorithm (version 2.0a19MP) at the default settings using gapped alignments with the filter "off". For each of these gene sequences, individual comparisons were ordered by probability score (P-value), where the score reflects the probability that a particular alignment occurred by chance. For example, a score of 3.6e-40 is $3.6 \times 10-40$. In addition to P-values, comparisons were also scored by percentage identity. Percentage identity reflects the degree to which two segments of DNA or protein are identical over a particular length. Examples of sequences so identified are presented in Tables 7, 8 and 9. Paralogous or orthologous sequences were readily identified from proprietary databases and in GenBank. The percent sequence identity among these sequences can be as low as 47%, or even lower sequence identity.

Candidate paralogous sequences were identified among *Arabidopsis* transcription factors through alignment, identity, and phylogenic relationships. A list of paralogs is shown in Table 8. Candidate orthologous sequences were identified from proprietary unigene sets of plant gene sequences in *Zea mays, Glycine max* and *Oryza sativa* based on significant homology to *Arabidopsis* transcription factors. These candidates were reciprocally compared to the set of *Arabidopsis* transcription factors. If the candidate showed maximal similarity in the protein domain to the eliciting transcription factor or to a paralog of the eliciting transcription factor, then it was considered to be an ortholog. Identified non-*Arabidopsis* sequences that were shown in this manner to be orthologous to the *Arabidopsis* sequences are provided in Tables 7 and 9.

Example X

Screen of Plant cDNA Library for Sequence Encoding a Transcription Factor DNA Binding Domain that Binds to a Transcription Factor Binding Promoter Element and Demonstration of Protein Transcription Regulation Activity The "one-hybrid" strategy (L1 and Herskowitz (1993) *Science* 262: 1870-1874) is used to screen for plant cDNA clones encoding a polypeptide comprising a transcription factor DNA binding domain, a conserved domain. In brief, yeast strains are constructed that contain a lacZ reporter gene with either wild-type or mutant transcription factor binding promoter element sequences in place of the normal UAS (upstream activator sequence) of the GALL promoter. Yeast reporter strains are constructed that carry transcription factor binding promoter element sequences as UAS elements are operably linked upstream (5') of a lacZ reporter gene with a minimal GAL1 promoter. The strains are transformed with a plant expression library that contains random cDNA inserts fused to the GAL4 activation domain (GAL4-ACT) and screened for blue colony formation on X-gal-treated filters (X-gal: 5-bromo-4-chloro-3-indolyl-β-D-galactoside; Invitrogen Corporation, Carlsbad Calif.). Alternatively, the strains are transformed with a cDNA polynucleotide encoding a known transcription factor DNA binding domain polypeptide sequence.

Yeast strains carrying these reporter constructs produce low levels of beta-galactosidase and form white colonies on filters containing X-gal. The reporter strains carrying wild-type transcription factor binding promoter element sequences are transformed with a polynucleotide that encodes a polypeptide comprising a plant transcription factor DNA binding domain operably linked to the acidic activator domain of the yeast GAL4 transcription factor, "GAL4-ACT". The clones that contain a polynucleotide encoding a transcription factor DNA binding domain operably linked to GLA4-ACT can bind upstream of the lacZ reporter genes carrying the wild-type transcription factor binding promoter element sequence, activate transcription of the lacZ gene and result in yeast forming blue colonies on X-gal-treated filters.

Upon screening about $2 \times 10^6$ yeast transformants, positive cDNA clones are isolated; i.e., clones that cause yeast strains carrying lacZ reporters operably linked to wild-type transcription factor binding promoter elements to form blue colonies on X-gal-treated filters. The cDNA clones do not cause a yeast strain carrying a mutant type transcription factor binding promoter elements fused to LacZ to turn blue. Thus, a polynucleotide encoding transcription factor DNA binding domain, a conserved domain, is shown to activate transcription of a gene.

Example XI

Gel Shift Assays

The presence of a transcription factor comprising a DNA binding domain which binds to a DNA transcription factor binding element is evaluated using the following gel shift assay. The transcription factor is recombinantly expressed and isolated from *E. coli* or isolated from plant material. Total soluble protein, including transcription factor, (40 ng) is incubated at room temperature in 10 µl of 1× binding buffer (15 mM HEPES (pH 7.9), 1 mM EDTA, 30 mM KCl, 5% glycerol, 5% bovine serum albumin, 1 mM DTT) plus 50 ng poly(dI-dC):poly(dI-dC) (Pharmacia, Piscataway N.J.) with or without 100 ng competitor DNA. After 10 minutes incubation, probe DNA comprising a DNA transcription factor binding element (1 ng) that has been $^{32}$P-labeled by end-filling (Sambrook et al. (1989) supra) is added and the mixture incubated for an additional 10 minutes. Samples are loaded onto polyacrylamide gels (4% w/v) and fractionated by electrophoresis at 150V for 2 h (Sambrook et al. supra). The degree of transcription factor-probe DNA binding is visualized using autoradiography. Probes and competitor DNAs are prepared from oligonucleotide inserts ligated into the BamHI site of pUC118 (Vieira et al. (1987) *Methods Enzymol.* 153: 3-11). Orientation and concatenation number of the inserts are determined by dideoxy DNA sequence analysis (Sambrook et al. supra). Inserts are recovered after restriction digestion with EcoRI and HindIII and fractionation on polyacrylamide gels (12% w/v) (Sambrook et al. supra).

Example XII

Introduction of Polynucleotides into Dicotyledonous Plants

Any of the transcription factor sequences of the invention listed in the Sequence Listing, and paralogous, and orthologous sequences, may be recombined into pMEN20 or pMEN65 expression vectors and then are transformed into a plant for the purpose of modifying plant traits. The cloning vector may be introduced into a variety of cereal plants by means well known in the art such as, for example, direct DNA transfer or *Agrobacterium tumefaciens*-mediated transformation. It is now routine to produce transgenic plants using most dicot plants (see Weissbach and Weissbach, (1989) supra; Gelvin et al. (1990) supra; Herrera-Estrella et al. (1983) supra; Bevan (1984) supra; and Klee (1985) supra). Methods for analysis of traits are routine in the art and examples are disclosed above.

Example XIII

Transformation of Cereal Plants with an Expression Vector

Cereal plants such as, but not limited to, corn, wheat, rice, sorghum, or barley, may also be transformed with the present polynucleotide sequences in pMEN20 or pMEN65 expression vectors for the purpose of modifying plant traits. For example, pMENO20 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art such as, for example, direct DNA transfer or *Agrobacterium tumefaciens*-mediated transformation. It is now routine to produce transgenic plants of most cereal crops (Vasil (1994) *Plant Mol. Biol.* 25: 925-937) such as corn, wheat, rice, sorghum (Cassas et al. (1993) *Proc. Natl. Acad. Sci.* 90: 11212-11216, and barley (Wan and Lemeaux (1994) *Plant Physiol.* 104:37-48. DNA transfer methods such as the microprojectile can be used for corn (Fromm et al. (1990) *Bio/Technol.* 8: 833-839); Gordon-Kamm et al. (1990) *Plant Cell* 2: 603-618; Ishida (1990) *Nature Biotechnol.* 14:745-750), wheat (Vasil et al. (1992) *Bio/Technol.* 10:667-674; Vasil et al. (1993) *Bio/Technol.* 11:1553-1558; Weeks et al. (1993) *Plant Physiol.* 102: 1077-1084), rice (Christou (1991) *Bio/Technol.* 9:957-962; Hiei et al. (1994) *Plant J.* 6:271-282; Aldemita and Hodges (1996) *Planta* 199:612-617; and Hiei et al. (1997) *Plant Mol. Biol.* 35:205-218). For most cereal plants, embryogenic cells derived from immature scutellum tissues are the preferred cellular targets for transformation (Hiei et al. (1997) *Plant Mol. Biol.* 35:205-218; Vasil (1994) *Plant Mol. Biol.* 25: 925-937).

Vectors according to the present invention may be transformed into corn embryogenic cells derived from immature scutellar tissue by using microprojectile bombardment, with the A188XB73 genotype as the preferred genotype (Fromm et al. (1990) *Bio/Technol.* 8: 833-839; Gordon-Kamm et al. (1990) *Plant Cell* 2: 603-618). After microprojectile bombardment the tissues are selected on phosphinothricin to identify the transgenic embryogenic cells (Gordon-Kamm et al. (1990) *Plant Cell* 2: 603-618). Transgenic plants are regenerated by standard corn regeneration techniques (Fromm et al. (1990) *Bio/Technol.* 8: 833-839; Gordon-Kamm et al. (1990) *Plant Cell* 2: 603-618).

The plasmids prepared as described above can also be used to produce transgenic wheat and rice plants (Christou (1991) *Bio/Technol.* 9:957-962; Hiei et al. (1994) *Plant J.* 6:271-282; Aldemita and Hodges (1996) *Planta* 199:612-617; and Hiei et al. (1997) *Plant Mol. Biol.* 35:205-218) that coordinately express genes of interest by following standard transformation protocols known to those skilled in the art for rice and wheat (Vasil et al. (1992) *Bio/Technol.* 10:667-674; Vasil et al. (1993) *Bio/Technol.* 11:1553-1558; and Weeks et al. (1993) *Plant Physiol.* 102:1077-1084), where the bar gene is used as the selectable marker.

Example XIV

Identification of Orthologous and Paralogous Sequences

Orthologs to *Arabidopsis* genes may identified by several methods, including hybridization, amplification, or bioinformatically. This example describes how one may identify homologs to the *Arabidopsis* AP2 family transcription factor CBF1 (polynucleotide SEQ ID NO: 2238, encoded polypeptide SEQ ID NO: 2239), which confers tolerance to abiotic stresses (Thomashow et al. (2002) U.S. Pat. No. 6,417,428), and an example to confirm the function of homologous sequences. In this example, orthologs to CBF1 were found in canola (*Brassica napus*) using polymerase chain reaction (PCR).

Degenerate primers were designed for regions of AP2 binding domain and outside of the AP2 (carboxyl terminal domain):

```
Mol368 (reverse)
                                      (SEQ ID NO: 2246)
5'- CAY CCN ATH TAY MGN GGN GT -3'

Mol378 (forward)
                                      (SEQ ID NO: 2247)
5'- GGN ARN ARC ATN CCY TCN GCC -3'
(Y: C/T, N: A/C/G/T, H: A/C/T, M: A/C, R: A/G )
```

Primer Mol 368 is in the AP2 binding domain of CBF1 (amino acid sequence: His-Pro-Ile-Tyr-Arg-Gly-Val) while primer Mol 378 is outside the AP2 domain (carboxyl terminal domain) (amino acid sequence: Met-Ala-Glu-Gly-Met-Leu-Leu-Pro).

The genomic DNA isolated from *B. napus* was PCR-amplified by using these primers following these conditions: an initial denaturation step of 2 min at 93° C.; 35 cycles of 93° C. for 1 min, 55° C. for 1 min, and 72° C. for 1 min; and a final incubation of 7 min at 72° C. at the end of cycling.

The PCR products were separated by electrophoresis on a 1.2% agarose gel and transferred to nylon membrane and hybridized with the AT CBF1 probe prepared from *Arabidopsis* genomic DNA by PCR amplification. The hybridized products were visualized by colorimetric detection system (Boehringer Mannheim) and the corresponding bands from a similar agarose gel were isolated using the Qiagen Extraction Kit (Qiagen). The DNA fragments were ligated into the TA clone vector from TOPO TA Cloning Kit (Invitrogen) and transformed into *E. coli* strain TOP10 (Invitrogen).

Seven colonies were picked and the inserts were sequenced on an ABI 377 machine from both strands of sense and anti-sense after plasmid DNA isolation. The DNA sequence was edited by sequencer and aligned with the AtCBF1 by GCG software and NCBI blast searching.

The nucleic acid sequence and amino acid sequence of one canola ortholog found in this manner (bnCBF1; polynucleotide SEQ ID NO: 2244 and polypeptide SEQ ID NO: 2245) identified by this process is shown in the Sequence Listing.

The aligned amino acid sequences show that the bnCBF1 gene has 88% identity with the *Arabidopsis* sequence in the AP2 domain region and 85% identity with the *Arabidopsis* sequence outside the AP2 domain when aligned for two insertion sequences that are outside the AP2 domain.

Similarly, paralogous sequences to *Arabidopsis* genes, such as CBF1, may also be identified.

Two paralogs of CBF1 from *Arabidopsis thaliana*: CBF2 and CBF3. CBF2 and CBF3 have been cloned and sequenced as described below. The sequences of the DNA SEQ ID NO: 2240 and 2242 and encoded proteins SEQ ID NO: 2241 and 2243 are set forth in the Sequence Listing.

A lambda cDNA library prepared from RNA isolated from *Arabidopsis thaliana* ecotype Columbia (Lin and Thomashow (1992) *Plant Physiol.* 99: 519-525) was screened for recombinant clones that carried inserts related to the CBF1 gene (Stockinger et al. (1997) *Proc. Natl. Acad. Sci.* 94:1035-1040). CBF1 was $^{32}$P-radiolabeled by random priming (Sambrook et al. supra) and used to screen the library by the plaque-lift technique using standard stringent hybridization and wash conditions (Hajela et al. (1990) *Plant Physiol.* 93:1246-1252; Sambrook et al. supra) 6×SSPE buffer, 60° C. for hybridization and 0.1×SSPE buffer and 60° C. for washes). Twelve positively hybridizing clones were obtained and the DNA sequences of the cDNA inserts were determined. The results indicated that the clones fell into three classes. One class carried inserts corresponding to CBF1. The two other classes carried sequences corresponding to two different homologs of CBF1, designated CBF2 and CBF3. The nucleic acid sequences and predicted protein coding sequences for *Arabidopsis* CBF1, CBF2 and CBF3 are listed in the Sequence Listing (SEQ ID NOs:2238, 2240, 2242 and SEQ ID NOs: 2239, 2241, and 2243, respectively). The nucleic acid sequences and predicted protein coding sequence for *Brassica napus* CBF ortholog is listed in the Sequence Listing (SEQ ID NOs: 2244 and 2245, respectively).

A comparison of the nucleic acid sequences of *Arabidopsis* CBF1, CBF2 and CBF3 indicate that they are 83 to 85% identical as shown in Table 11.

TABLE 11

| | Percent identity[a] | |
|---|---|---|
| | DNA[b] | Polypeptide |
| cbf1/cbf2 | 85 | 86 |
| cbf1/cbf3 | 83 | 84 |
| cbf2/cbf3 | 84 | 85 |

[a]Percent identity was determined using the Clustal algorithm from the Megalign program (DNASTAR, Inc.).
[b]Comparisons of the nucleic acid sequences of the open reading frames are shown.

Similarly, the amino acid sequences of the three CBF polypeptides range from 84 to 86% identity. An alignment of the three amino acidic sequences reveals that most of the differences in amino acid sequence occur in the acidic C-terminal half of the polypeptide. This region of CBF1 serves as an activation domain in both yeast and *Arabidopsis* (not shown).

Residues 47 to 106 of CBF1 correspond to the AP2 domain of the protein, a DNA binding motif that to date, has only been found in plant proteins. A comparison of the AP2 domains of CBF1, CBF2 and CBF3 indicates that there are a few differences in amino acid sequence. These differences in amino acid sequence might have an effect on DNA binding specificity.

Example XV

Transformation of Canola with a Plasmid Containing CBF1, CBF2, or CBF3

After identifying homologous genes to CBF1, canola was transformed with a plasmid containing the *Arabidopsis* CBF1, CBF2, or CBF3 genes cloned into the vector pGA643 (An (1987) *Methods Enzymol.* 253: 292). In these constructs the CBF genes were expressed constitutively under the CaMV 35S promoter. In addition, the CBF1 gene was cloned under the control of the *Arabidopsis* COR15 promoter in the same vector pGA643. Each construct was transformed into *Agrobacterium* strain GV3101. Transformed *Agrobacteria* were grown for 2 days in minimal AB medium containing appropriate antibiotics.

Spring canola (*B. napus* cv. Westar) was transformed using the protocol of Moloney et al. ((1989) *Plant Cell Reports* 8: 238) with some modifications as described. Briefly, seeds were sterilized and plated on half strength MS medium, containing 1% sucrose. Plates were incubated at 24° C. under 60-80 µE/m$^2$s light using a16 hour light/8 hour dark photoperiod. Cotyledons from 4-5 day old seedlings were collected, the petioles cut and dipped into the *Agrobacterium* solution. The dipped cotyledons were placed on co-cultivation medium at a density of 20 cotyledons/plate and incubated as described above for 3 days. Explants were transferred to the same media, but containing 300 mg/l timentin (Smith-Kline Beecham, Pa.) and thinned to 10 cotyledons/plate. After 7 days explants were transferred to Selection/Regeneration medium. Transfers were continued every 2-3 weeks (2 or 3 times) until shoots had developed. Shoots were transferred to Shoot-Elongation medium every 2-3 weeks. Healthy looking shoots were transferred to rooting medium. Once good roots had developed, the plants were placed into moist potting soil.

The transformed plants were then analyzed for the presence of the NPTII gene/kanamycin resistance by ELISA, using the ELISA NPTII kit from 5Prime-3Prime Inc. (Boulder, Colo.). Approximately 70% of the screened plants were NPTII positive. Only those plants were further analyzed.

From Northern blot analysis of the plants that were transformed with the constitutively expressing constructs, showed expression of the CBF genes and all CBF genes were capable of inducing the *Brassica napus* cold-regulated gene BN115 (homolog of the *Arabidopsis* COR15 gene). Most of the transgenic plants appear to exhibit a normal growth phenotype. As expected, the transgenic plants are more freezing tolerant than the wild-type plants. Using the electrolyte leakage of leaves test, the control showed a 50% leakage at −2 to −3° C. Spring canola transformed with either CBF1 or CBF2 showed a 50% leakage at −6 to −7° C. Spring canola transformed with CBF3 shows a 50% leakage at about −10 to −15° C. Winter canola transformed with CBF3 may show a 50% leakage at about −16 to −20° C. Furthermore, if the spring or winter canola are cold acclimated the transformed plants may exhibit a further increase in freezing tolerance of at least −2° C.

To test salinity tolerance of the transformed plants, plants were watered with 150 mM NaCl. Plants overexpressing CBF1, CBF2 or CBF3 grew better compared with plants that had not been transformed with CBF1, CBF2 or CBF3.

These results demonstrate that homologs of *Arabidopsis* transcription factors can be identified and shown to confer similar functions in non-*Arabidopsis* plant species.

Example XVI

Cloning of Transcription Factor Promoters

Promoters are isolated from transcription factor genes that have gene expression patterns useful for a range of applications, as determined by methods well known in the art (including transcript profile analysis with cDNA or oligonucleotide microarrays, Northern blot analysis, semi-quantitative or quantitative RT-PCR). Interesting gene expression profiles are revealed by determining transcript abundance for a selected transcription factor gene after exposure of plants to a range of different experimental conditions, and in a range of different tissue or organ types, or developmental stages. Experimental conditions to which plants are exposed for this purpose includes cold, heat, drought, osmotic challenge, varied hormone concentrations (ABA, GA, auxin, cytokinin, salicylic acid, brassinosteroid), pathogen and pest challenge. The tissue types and developmental stages include stem, root, flower, rosette leaves, cauline leaves, siliques, germinating seed, and meristematic tissue. The set of expression levels provides a pattern that is determined by the regulatory elements of the gene promoter.

Transcription factor promoters for the genes disclosed herein are obtained by cloning 1.5 kb to 2.0 kb of genomic sequence immediately upstream of the translation start codon for the coding sequence of the encoded transcription factor protein. This region includes the 5'-UTR of the transcription factor gene, which can comprise regulatory elements. The 1.5 kb to 2.0 kb region is cloned through PCR methods, using primers that include one in the 3' direction located at the translation start codon (including appropriate adaptor sequence), and one in the 5' direction located from 1.5 kb to 2.0 kb upstream of the translation start codon (including appropriate adaptor sequence). The desired fragments are PCR-amplified from *Arabidopsis* Col-0 genomic DNA using high-fidelity Taq DNA polymerase to minimize the incorporation of point mutation(s). The cloning primers incorporate two rare restriction sites, such as Not1 and Sfi1, found at low frequency throughout the *Arabidopsis* genome. Additional restriction sites are used in the instances where a Not1 or Sfi1 restriction site is present within the promoter.

The 1.5-2.0 kb fragment upstream from the translation start codon, including the 5'-untranslated region of the transcription factor, is cloned in a binary transformation vector immediately upstream of a suitable reporter gene, or a transactivator gene that is capable of programming expression of a reporter gene in a second gene construct. Reporter genes used include green fluorescent protein (and related fluorescent protein color variants), beta-glucuronidase, and luciferase. Suitable transactivator genes include LexA-GAL4, along with a transactivatable reporter in a second binary plasmid (as disclosed in U.S. patent application Ser. No. 09/958,131, incorporated herein by reference). The binary plasmid(s) is transferred into *Agrobacterium* and the structure of the plasmid confirmed by PCR. These strains are introduced into *Arabidopsis* plants as described in other examples, and gene expression patterns determined according to standard methods know to one skilled in the art for monitoring GFP fluorescence, beta-glucuronidase activity, or luminescence.

The promoter region for G1753 is obtained from *Arabidopsis* chromosome 2 clone F1011 (AC006919), gene At2g36450, from position 43906-45410 of the genomic clone. The complement of this sequence is the promoter oriented in the 5'-3' direction, with the translation start codon for G1753 the complement of positions 43903-43905.

The present invention is not limited by the specific embodiments described herein. The invention now being fully described, it will be apparent to one of ordinary skill in the art that many changes and modifications can be made thereto without departing from the spirit or scope of the appended claims. Modifications that become apparent from the foregoing description and accompanying figures fall within the scope of the claims.

All references, publications, patent documents, web pages, and other documents cited or mentioned herein are hereby incorporated by reference in their entirety for all purposes. Although the invention has been described with reference to specific embodiments and examples, it should be understood that one of ordinary skill can make various modifications without departing from the spirit of the invention. The scope of the invention is not limited to the specific embodiments and examples provided.

SEQUENCE LISTING (2247 sequences)

SEQ ID NO: 1 - DNA, 1680 bp, Arabidopsis thaliana
ctctctctctctctttagctctttttttttttttgttttcattaaagtttttattttattttctaccaaccaaaagcttttctctttggtttctcttatttagcttctaaccttgaggagaatataccagaggattgaagtttgaaccttcaaagatcaaaatcaagaaaccaaaaaaaaacaaaaaaaatgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgtatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatctgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttgaatcttttatatttttaaggtttattattatataagaaaaacaaaaatgaacctttgaaatccccacatgttcttggtcatttcattaatcatcggcttatattttgcttattttcccctaaatcctcttgttaacttaggcgaacaaaaaaaattaatggaaatctttttccctccatcggttacaaaaata

SEQ ID NO: 2 - protein, 432 aa, Arabidopsis thaliana
MWDLNDAPHQTQREEESEEFCYSSPSKRVGSFSNSSSSAVVIEDGSDDDELNRVRPNNPLVTHQFFPEMDSNGGGVASGFPRAHWFGVKFCQSDLATGSSAGKATNVAAAVVEPAQPLKKSRRGPRSRSSQYRGVTFYRRTGRWESHIWDCGKQVYLGGFDTAHAAARAYDRAAIKFRGVEADINFNIDDYDDDLKQMTNLTKEEFVHVLRRQSTGFPRGSSKYRGVTLHKCGRWEARMGQFLGKKYVYLGLFDTEVEAARAYDKAAIKCNGKDAVTNFDPSIYDEELNAESSGNPTTPQDHNLDLSLGNSANSKHKSQDMRLRMNQQQQDSLHSNEVLGLGQTGMLNHTPNSNHQFPGSSNIGSGGGFSLFPAAENHRFDGRASTNQVLTNAAASSGFSPHHHNQIFNSTSTPHQNWLQTNGFQPPLMRPS

SEQ ID NO: 3 - DNA, 831 bp, Arabidopsis thaliana
gtgtcggtgaattttttgaaacttcttctcttttgcggtttcgtgttccactcctctcttcttggcccacgtgttcatcaatctctccctccgcatgtaatcgcttcgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaaacaaaaaaaaaaaaaaaaaaaaa

SEQ ID NO: 4 - protein, 196 aa, Arabidopsis thaliana
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 5 - DNA, 1905 bp, Arabidopsis thaliana
atagaaagaagagaagcagaaaccaaaaaaagaaaccatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatggcggctgcgaagaagaagaggggacaagaggatgttgtagttgttggtcagaaacagattgttcatagaaaatctatcgatacttttggacaacgaacttctcaataccgaggcgttacaagacatagatggactggtagatatgaagctcatctatgggacaatagtttcaagaaggaaggtcacagtagaaaaggaagacaagtttatctgggaggttatgatatggaggagaaagctgctcgagcatatgatcttgctgcactcaagtactggggtccctctactcacaccaatttctctgcggagaattatcagaaagagattgaagacatgaagaacatgactagacaagaatatgttgcacatttgagaaggaagagcagtggtttctctaggggtgcttccatctatagaggagtcacaagacatcaccagcatggaaggtggcaagcacggattggtagagtcgctggaaacaaagatctctaccttggaacttttggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttgatcaacttcaatgactaactctggttttcttggtttagttgctaagtgttttggtttatctccggttttatccggtttgaactacaattcggtttagtttcgtcggtataaatagtatttgcttaggagcggtatatgtttcttttgagtagtattcatgtgaaacagaatgaatctctctataacatattattttaatgg

SEQ ID NO: 6 - protein, 555 aa, Arabidopsis thaliana
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 7 - DNA, 553 bp, Arabidopsis thaliana
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttctaaaaaaaaaaaaaaaaa

SEQ ID NO: 8 - protein, 133 aa, Arabidopsis thaliana
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 9 - DNA, 818 bp, Arabidopsis thaliana
ttctctctttcgtaaaaatggcgagttttgaggaaagctctgatttggaagctatacagagccatctcttagaagacttgttggtttgtgatggtttcatgggagattttgacttcgatgcttcttttgtctcaggactttggtgtatagaaccacacgttcctaaacaagaacctgattctccagttcttgatccggattctttcgtcaacgagttcttgcaagtggaaggggaatcatcatcatcatcatcaccagagctgaattcatcgtcatcaacatatgagactgatcagagtgtgaaaaaggcagagaggttcgaagaagaagtagatgctagacattaccgaggagtgaggcgaaggccgtgggggaaatttgcagcagagattcgagatccagcaaagaaaggatcaagaatctggctaggaacatttgagagtgatgttgatgctgcaagagcctatgactgtgcagctttcaagctccggggaagaaaagccgtgctcaacttccctcttgacgccgggaaatatgaagctccagcgaattcaggaaggaaaaggaagagaagtgatgtgcatgaagagcttcaaagaactcagagcaattcatcttcatcttcctgtgatgcattttagcatattaagagtgtgagcagtttccttaagttgtataaagtaattgtacagaggaaacgaattgtgtaggtttagtgtgcttgcaagttgcaacaaatgtgtatggatgttctgtttcttcatgtccctaagatttagaaacatcttcttatttccaagaaaaaaaaaaaaaaaaaa

SEQ ID NO: 10 - protein, 207 aa, Arabidopsis thaliana
MASFEESSDLEAIQSHLLEDLLVCDGFMGDFDFDASFVSGLWCIEPHVPKQEPDSPVLDPDSFVNEFLQVEGESSSSSSPELNSSSSTYETDQSVKKAERFEEEVDARHYRGVRRRPWGKFAAEIRDPAKKGSRIWLGTFESDVDAARAYDCAAFKLRGRKAVLNFPLDAGKYEAPANSGRKRKRSDVHEELQRTQSNSSSSSCDAF

SEQ ID NO: 11 - DNA, 785 bp, Arabidopsis thaliana
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaataaaaaaaaaaaaaaaaaaaaa

SEQ ID NO: 12 - protein, 144 aa, Arabidopsis thaliana
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 13 - DNA, 1043 bp, Arabidopsis thaliana
cattttctgcaacttctccaaatctcatactttccagaaaatcattttcccaagaaaaataaaactttcccctttgttcttctccccccaacagcaatcacggcgtaccaatcggagctaggaggagattcctctcccttgaggaaatctgggagaggaaagatcgaaatcaaacggatcgagaacacaacgaatcgtcaagtcactttttgcaaacgtagaaatggtttgctcaagaaagcttacgagctctctgttctctgtgatgctgaagtcgcactcatcgttttctctagccgtggtcgtctctatgagtactctaacaacagtgtaaaaggtactattgagaggtacaagaaggcaatatcggacaattctaacaccggatcggtggcagaaattaatgcacagtattatcaacaagaatcagccaaattgcgtcaacaaattatcagcatacaaaactccaacaggcaattgatgggtgagacgatagggtcaatgtctcccaaagagctcaggaacttggaaggcagattagagagaagtattacccgaatccgatccaagaagaatgagctcttattttctgaaatcgactacatgcagaaaagagaagttgatttgcataacgataaccagattcttcgtgcaaagatagctgaaaatgagaggaacaatccgagtataagtctaatgccaggaggatctaactacgagcagcttatgccaccacctcaaacgcaatctcaaccgtttgattcacggaattatttccaagtcgcggcattgcaacctaacaatcaccattactcatccgccggtcgccaagaccaaaccgctctccagttagtgtaatattggctgaaggaaatggcctggagtgaataaaaaccagaattgggttgagcaagcaatataaagctaatgcatgttatatatatatttatcccatgaatgttgtatcagtgaattcttatgcttatgttgatgtgaaattaaatatcttaaagacatgtcattaatgtgcttaatttgcttca

SEQ ID NO: 14 - protein, 252 aa, Arabidopsis thaliana
TAYQSELGGDSSPLRKSGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQSQPFDSRNYFQVAALQPNNHHYSSAGRQDQTALQLV

SEQ ID NO: 15 - DNA, 1057 bp, Arabidopsis thaliana
ctttccaattggttcataccaaagtctgagctcttctttatatctctcttgtagtttcttattgggggtctttgttttgtttggttcttttagagtaagaagtttcttaaaaaaggatcaaaaatgggaaggggtagggttcaattgaagaggatagagaacaagatcaatagacaagtgacattctcgaaaagaagagctggtcttttgaagaaagctcatgagatctctgttctctgtgatgctgaagttgctcttgttgtcttctcccataaggggaaactcttcgaatactccactgattcttgtatggagaagatacttgaacgctatgagaggtactcttacgccgaaagacagcttattgcacctgagtccgacgtcaatacaaactggtcgatggagtataacaggcttaaggctaagattgagcttttggagagaaaccagaggcattatcttggggaagacttgcaagcaatgagccctaaagagcttcagaatctggagcagcagcttgacactgctcttaagcacatccgcactagaaaaaaccaacttatgtacgagtccatcaatgagctccaaaaaaaggagaaggccatacaggagcaaaacagcatgctttctaaacagatcaaggagagggaaaaaattcttagggctcaacaggagcagtgggatcagcagaaccaaggccacaatatgcctccccctctgccaccgcagcagcaccaaatccagcatccttacatgctctctcatcagccatctccttttctcaacatgggtggtctgtatcaagaagatgatcctatggcaatgaggaggaatgatctcgaactgactcttgaacccgtttacaactgcaaccttggctgcttcgccgcatgaagcatttccatatatatatttgtaatcgtcaacaataaaaacagtttgccacatacatataaatagtggctaggctcttttcatccaattaatatattttggcaaatgttcgatgttcttatatcatcatatataaattagcaggctcctttctttttttgta

SEQ ID NO: 16 - protein, 256 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNLGCFAA

SEQ ID NO: 17 - DNA, 988 bp, Arabidopsis thaliana
ctcttcaacaaaaagattaaacaaagagagaagaatatggcgagagggaagatccagatcaagaggatagagaaccagacaaacagacaagtgacgtattcaaagagaaggaatggtttattcaagaaagcacatgagctcacggttttgtgtgatgctagggtttcgattatcatgttctctagctccaacaagcttcatgagtatatcagccctaacaccacaacgaaggagatcgtagatctgtaccaaactatttctgatgtcgatgtttgggccactcaatatgagcgaatgcaagaaaccaagaggaaactgttggagacaaatagaaatctccggactcagatcaagcagaggctaggtgagtgtttggacgagcttgacattcaggagctgcgtcgtcttgaggatgaaatggaaaacactttcaaactcgttcgcgagcgcaagttcaaatctcttgggaatcagatcgagaccaccaagaaaaagaacaaaagtcaacaagacatacaaaagaatctcatacatgagctggaactaagagctgaagatcctcactatggactagtagacaatggaggagattacgactcagttcttggataccaaatcgaagggtcacgtgcttacgctcttcgtttccaccagaaccatcaccactattaccccaaccatggccttcatgcaccctctgcctctgacatcattaccttccatcttcttgaataattaaaggctaaaaggtttgctggtgccatcattgtctatctaattatttagtaactacttaaaacataaggcatggtgttgctaaaaccttaaactgtcatgtttcttagttatgtattttaaagcctaaagaaatatggattgtgtgatcagtagtgcttaggcttattgtgtgtggaatgttttcaagacttttatcatgtatcgtattattatattgaccactctacttaattatgctacaaatttactc

SEQ ID NO: 18 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLDELDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 19 - DNA, 914 bp, Arabidopsis thaliana
ggcacgaggagagagaaagagatagagagagaaagatgggtagaggaaagatcgagataaagaggatagagaacgcaaacaacagagtggtgacgttctcaaagaggaggaatggattggtgaagaaggctaaagagatcacagttctttgtgatgcaaaagttgccctcataatctttgcaagtaatggtaagatgattgattactgttgtccttccatggatcttggtgctatgttggaccaataccagaagttatctggcaagaaactatgggatgctaagcatgagaaccttagcaatgagattgataggatcaagaaagagaatgatagcttacaactggagctcaggcatttgaagggagaagatatacagtctctcaacttgaaaaatctgatggctgtcgagcacgccattgaacatggcctcgacaaagtccgagaccaccagatggagatccttatatcaaagaggagaaatgagaagatgatggcggaggagcaacggcaactcactttccagctgcaacaacaggagatggctatagcaagcaacgcaagaggaatgatgatgagagatcatgatgggcagtttggatatagagtgcaaccgattcagccaaatcttcaggaaaagattatgtctttggtcatcgattgatcatcgagattttataatctcatcctgatcaactcctatctatactatcgtggtctttagtttgtctttatcaatctgtgtgtcttaatctcgagcaacatatatactcgctatcagactttttacttaagctatatgtgtgttgtttgcttatgacctctatgtattggttgtgttgtgtgcttaaacgtttcgaactaattgatctgtgtgaaacttattattctgtgataagctatttgtgataaaaaa

SEQ ID NO: 20 - protein, 208 aa, Arabidopsis thaliana
MGRGKIEIKRIENANNRVVTFSKRRNGLVKKAKEITVLCDAKVALIIFASNGKMIDYCCPSMDLGAMLDQYQKLSGKKLWDAKHENLSNEIDRIKKENDSLQLELRHLKGEDIQSLNLKNLMAVEHAIEHGLDKVRDHQMEILISKRRNEKMMAEEQRQLTFQLQQQEMAIASNARGMMMRDHDGQFGYRVQPIQPNLQEKIMSLVID

SEQ ID NO: 21 - DNA, 820 bp, Arabidopsis thaliana
cttcatataatttagttattttaagagaaatgggaaggggtagggttgaattgaagaggatagagaacaagatcaatagacaagtgacattctcgaaaagaagaactggtcttttgaagaaagctcaggagatctctgttctttgtgatgccgaggtttcccttattgtcttctcccataagggcaaattgttcgagtactcctctgaatcttgcatggagaaggtactagaacgctacgagaggtattcttacgccgagagacagctgattgcacctgactctcacgttaatgcacagacgaactggtcaatggagtatagcaggcttaaggccaagattgagcttttggagagaaaccaaaggcattatctgggagaagagttggaaccaatgagcctcaaggatctccaaaatctggagcagcagcttgagactgctcttaagcacattcgctccagaaaaaatcaactcatgaatgagtccctcaaccacctccaaagaaaggagaaggagatacaggaggaaaacagcatgcttaccaaacagataaaggagagggaaaacatcctaaggacaaaacaaacccaatgtgagcagctgaaccgcagcgtcgacgatgtaccacagccacaaccatttcaacacccccatctttacatgatcgctcatcagacttctcctttcctaaatatgggtggtttgtaccaagaagaagaccaaacggcgatgaggaggaacaatctggatctgactcttgaacccatttacaattaccttggctgttacgccgcttgaatagactacatcgatctatatca

SEQ ID NO: 22 - protein, 255 aa, Arabidopsis thaliana
MGRGRVELKRIENKINRQVTFSKRRTGLLKKAQEISVLCDAEVSLIVFSHKGKLFEYSSESCMEKVLERYERYSYAERQLIAPDSHVNAQTNWSMEYSRLKAKIELLERNQRHYLGEELEPMSLKDLQNLEQQLETALKHIRSRKNQLMNESLNHLQRKEKEIQEENSMLTKQIKERENILRTKQTQCEQLNRSVDDVPQPQPFQHPHLYMIAHQTSPFLNMGGLYQEEDQTAMRRNNLDLTLEPIYNYLGCYAA

SEQ ID NO: 23 - DNA, 895 bp, Arabidopsis thaliana
ggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttcccctcataacgattaagagagagacgagagagttcattttatatttataacgcgactgtgtattcatagtttaggttctaataatgataataacaaaactgttgtttctttgcttc

SEQ ID NO: 24 - protein, 248 aa, Arabidopsis thaliana
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 25 - DNA, 1294 bp, Arabidopsis thaliana
ccctcacacatttcttatcttttgctctcaatagattccattgattcaaaacaaaattttcattaagatttcacaacctccacacacttccaaacacaattaaagagaggaaaaagaatcaataaccctataaataaaaaatcagacaaacagaagtttcctcttcttcttccttaagctagtaccttttgttcttgaaattagggttaatttcttttttccaaataccatcaattctccagaccataaaaactcaaaaagatcagatctttcctctgaaaaagagatacccaacttatgtttttgtgtgtctgtatatagataaacattacatacccatatttgtgtatagacataaaaagtggaaattaaggtaacaaaaagaaatgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttgatcggtaccagaaatgcagctatggatccattgaagtcaacaacaaacctgccaaagaacttgagaacagctacagagaatatctgaagcttaagggtagatatgagaaccttcaacgtcaacagagaaatcttcttggggaggatttaggacctttgaattcaaaggagttagagcagcttgagcgtcaactggacggctctctcaagcaagttcggtccatcaagacacagtacatgcttgaccagctctcggatcttcaaaataaagagcaaatgttgcttgaaaccaatagagctttggcaatgaagctggatgatatgattggtgtgagaagtcatcatatgggaggatgggaaggcggtgaacagaatgttacctacgcgcatcatcaagctcagtctcagggactataccagcctcttgaatgcaatccaactctgcaaatggggtatgataatccagtatgctctgagcaaatcactgcgacaacacaagctcaggcgcagccgggaaacggttacattccaggatggatgctctgagaatcatgtactgtgatgaagctcacccacaaaagaccttatatatatataaagtatagatacaagacttggatttgtagacataagtggctaatataatggtcctgaggatcttctagacatttgtatcttttgggaatccttgcttatattaagaattc

SEQ ID NO: 26 - protein, 248 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGWEGGEQNVTYAHHQAQSQGLYQPLECNPTLQMGYDNPVCSEQITATTQAQAQPGNGYIPGWML

SEQ ID NO: 27 - DNA, 1337 bp, Arabidopsis thaliana
agaatggcttagcatctctgcaaaaccaacacaaagctatattctcttaaaaatcagttcaacaaaagaagaacctgaacacagttggcccaccaccaccactaccacaatctcctcctccaccaccaccacctagtcaccggaaaccaattcatgccctagattaagaaccagaatccttttgagacaagatctatatatacactctacacatttacttatacactttatctagatatagatgtgtgtgtgtataaaggttctttttcattacttgttggtttagtgataaaaaggaggagagttttcagttgggttttggtttcttggtgagagaagagagaaaaagagaggatgggaagagggaaagttgagctgaagaggatagagaacaagatcaatagacaagttacttttgcaaagagaagaaatggtttgctcaagaaggcttatgagctttctgtcctttgtgatgctgagattgctcttctcattttctctaaccgtggcaagctctacgaattctgcagcagccctagtggtatggcgaggacggttgataagtatagaaaacatagttatgcaacaatggatccaaatcaatcagctaaagacttgcaggataagtatcaagactacttgaagcttaaatcaagagttgagatccttcaacattcacaaaggcatttgctaggtgaagagctatccgagatggatgtgaatgagcttgagcatctcgaacgccaagtagatgcatcactaagacaaataagatctaccaaggctcggtctatgcttgatcaactatctgacctcaaaactaaggaggaaatgttattggaaaccaatagagatcttaggagaaagttggaggacagtgatgcagcacttactcaatcgttttggggaagttctgctgcagaacaacaacaacaacatcaacaacagcaacaaggcatgagctcttatcaatcaaaccctccaattcaggaagcaggtttcttcaagcctctacaaggcaatgtagcattgcaaatgagcagtcattacaatcacaatcctgcaaatgcaaccaactctgcaacaacatcacagaatgttaatggattcttccctggatggatggtctgaaaacaatacatatctatatatgtacacatatgtgtgttttatagatcaaagatcattgcttgtgtcatttgatttttgccagagaaacatagttcattattacaaaactttgttatataatcaaggctctaatgtcaaacaccagattattacttttttgttctttgttttttggctctcttgaaatataaaatattgttttggga

SEQ ID NO: 28 - protein, 258 aa, Arabidopsis thaliana
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKLEDSDAALTQSFWGSSAAEQQQQHQQQQQGMSSYQSNPPIQEAGFFKPLQGNVALQMSSHYNHNPANATNSATTSQNVNGFFPGWMV

SEQ ID NO: 29 - DNA, 1348 bp, Arabidopsis thaliana
gattcacaaaaacttttcttcagattcacaatctcatcacaacccttcaaaaagagaaaagatctaaagaataaacaagagccctaatatcaaatcacaaccaaaaaaaccaaagaaagctaattaaagttttctctctagctattcctcttcttttcttgttcttgaaaactagggtttacttcaccaaaagataagatctttccccagaaaaagcaatacccaagtcatgtttctgtgtgtctgtatatagataaaacattacataccctaataaggttacacaaatagctataaaagagggaaaataagatagggattttttggggtgaggaaagatgggaagaggaagagtagagctcaagaggatagagaacaaaatcaacagacaagtgacgtttgctaaacgtagaaatggtttgctgaaaaaagcttatgagctttctgttctctgcgatgctgaagtctctctcatcgtcttctccaaccgtggcaagctctacgagttctgcagcacctccaacatgctcaagacactggaaaggtatcagaagtgtagctatggctccattgaagtcaacaacaaacctgctaaagagcttgagaacagctacagagagtacttgaagctgaaaggtagatatgaaaatctgcaacgtcagcagagaaatcttcttggagaggatcttggacctctgaattcaaaggagctagagcagcttgagcgtcaactagacggctctctgaagcaagttcgctgcatcaagacacagtatatgcttgaccagctctctgatcttcaaggtaaggagcatatcttgcttgatgccaacagagctttgtcaatgaagctggaagatatgatcggcgtgagacatcaccatataggaggaggatgggaaggtggtgatcaacagaatattgcctatggacatcctcaggctcattctcagggactataccaatctcttgaatgtgatcccactttgcaaattggatatagccatccagtgtgctcagagcaaatggctgtgacggtgcaaggtcagtcccaacaaggaaacggctacatccctggctggatgctgtgagcgatacttcttcccccaataaagatcttaagcaagtactggtggggtcttcgtggtgtgatcttagatcttatgcatatgaataataatgttattgcacaagacttttgcttttgtagacacaagtggctatagctgtaatagccttcaacatctctcttctgtttcaggatttgtttgtgcctattgtaattgcttatatatgtatggtttgtataatgtgtgaaatgttaacatcgaccatgtctcatctggtg

SEQ ID NO: 30 - protein, 250 aa, Arabidopsis thaliana
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLDANRALSMKLEDMIGVRHHHIGGGWEGGDQQNIAYGHPQAHSQGLYQSLECDPTLQIGYSHPVCSEQMAVTVQGQSQQGNGYIPGWML

SEQ ID NO: 31 - DNA, 963 bp, Arabidopsis thaliana
gaattcatcttcccatcctcacttctctttctttctgatcataattaatcttgctaagccagctagggcttatagaaatggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgctgaggttgctcttgtcatcttctccactcgaggccgtctctacgagtacgccaacaacagtgtgagaggaacaatagaaaggtacaagaaagcttgctccgacgccgttaaccctccgaccatcaccgaagctaatactcagtactatcagcaagaggcgtctaaactccggagacagattcgggacattcagaatttgaacagacacattcttggtgaatctcttggttccttgaactttaaggaactcaagaaccttgaaagtaggcttgagaaaggaatcagtcgtgtccgatccaagaagcacgagatgttagttgcagagattgaatacatgcaaaaaagggaaatcgagctgcaaaacgataacatgtatctccgctccaagattactgaaagaacaggtctacagcaacaagaatcgagtgtgatacatcaagggacagtttacgagtcgggtgttacttcttctcaccagtcggggcagtataaccggaattatattgcggttaaccttcttgaaccgaatcagaattcctccaaccaagaccaaccacctctgcaacttgtttgattcagtctaacataagcttctttcctcagcctgagatcgatctatagtgtcacctaaatgcggccgcgtccctcaacatctagtcgcaagctgaggggaaccactagtgtcatacgaacctccaagagacggttacacaaacggg

SEQ ID NO: 32 - protein, 246 aa, Arabidopsis thaliana
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 33 - DNA, 1093 bp, Arabidopsis thaliana
atttatcgtgtacgatactttattccttttatctattcttgaaaaaaagttaccaattcttgagaagaagaagaaatcagaatcaagagaaggagagagaaagatgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttggaattgaaagcacaatcgaacggtataatcgttgttacaactgctctctaagcaataataagcctgaagagactacacagagttggtgtcaggaggtgacaaagcttaaatccaaatacgaatctcttgttcgtactaacaggaatttgcttggagaagatcttggagaaatgggtgtgaaggaactgcaagcgctcgagaggcagctcgaagccgctcttaccgcgactcgacagcgcaagacacaagttatgatggaagaaatggaagaccttaggaaaaaggagaggcaactaggagacataaacaaacaactcaagattaagtttgaaacggaaggccatgctttcaaaacctttcaagacttatgggcaaactcggcggcatcggtggccggggatccaaacaattctgaatttccggtagagccttctcatcctaatgtattggattgcaacaccgaaccctttttacaaatagggtttcaacaacattactacgtgcaaggtgaagggtcttcggtatcaaagagtaacgtggcaggtgagactaatttcgtccaaggttgggttctttgactctctgttgattagcccacgatgccacggtcaggccaatttcagctctctacagttgttcttttttcaaattagatttctggttttttttttcctataagaaaaacttttgcactagatgtttgtcatttaatttccagctcgtgtgaatctatattcgcatgtatgtgctttgaagaatttctcctcttactcctacttgatctaaaacattatttttcttttgggttt

SEQ ID NO: 34 - protein, 252 aa, Arabidopsis thaliana
MGRGRVEMKRIENKINRQVTFSKRRNGLLKKAYELSVLCDAEVALIIFSSRGKLYEFGSVGIESTIERYNRCYNCSLSNNKPEETTQSWCQEVTKLKSKYESLVRTNRNLLGEDLGEMGVKELQALERQLEAALTATRQRKTQVMMEEMEDLRKKERQLGDINKQLKIKFETEGHAFKTFQDLWANSAASVAGDPNNSEFPVEPSHPNVLDCNTEPFLQIGFQQHYYVQGEGSSVSKSNVAGETNFVQGWVL

SEQ ID NO: 35 - DNA, 906 bp, Arabidopsis thaliana
aagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagttgaacttagtagccagcaggagtatctcaagcttaaggagcgttatgacgccttacaaagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcagcaagatggaatgggagcaggaccaagtgtgaataattacatgttgggttggttaccttatgacaccaactctatttgaatctttctcacttaattaatctctcttttttttgacatttttaagatgatgtttctattttattacctctctcacgttttctgtcttgtgtgcatgtgtctgtgtaatgtttattgcccttctattattcaatgatttctcgac

SEQ ID NO: 36 - protein, 251 aa, Arabidopsis thaliana
MGRGRVELKRIENKINRQVTFAKRRNGLLKKAYELSVLCDAEVALIIFSNRGKLYEFCSSSSMLRTLERYQKCNYGAPEPNVPSREALAVELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 37 - DNA, 905 bp, Arabidopsis thaliana
acgagagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttctagttgaaatcgaaaacgcgcagaaaagggagattgagcttgacaatgagaacatctatctaagaactaaggtagcagaagtggagaggtatcaacaacaccatcatcaaatggttagtggttcagagattaacgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgt

SEQ ID NO: 38 - protein, 230 aa, Arabidopsis thaliana
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 39 - DNA, 914 bp, Arabidopsis thaliana
aaagaagagagagagcgagtgagagatgggaagaggcaaagtggaagtgaagagaattgagaacaagatcactagacaagtaaccttctccaaaagaaaaagtggtttgctcaagaaagcctacgaactctctgttctttgtgatgcagaggtttctctcataatcttctccaccggtggcaagctctacgagttcagcaatgtcggagttggcagaaccattgagaggtactatcgctgtaaagacaatcttttggacaatgatacgcttgaagatactcagggcttgcgtcaagaggtgacaaagctcaaatgcaaatacgaatctcttcttcgcactcataggaatttggttggggaagatcttgaagggatgagtataaaggaattgcagacgctggagagacagcttgaaggagctctttccgcaacccgaaaacaaaagacgcaggttatgatggaacaaatggaagagcttcggagaaaggagagggagctcggagatataaacaataagctaaagcttgagacagaagatcatgattttaaaggctttcaagacctactgcttaacccggtgctcaccgccggttgttccactgatttttccttgcaatcaactcatcaaaattatatatcggattgcaaccttggatattttttacagattgggtttcaacaacactatgagcaaggtgaaggatcttcggtgacaaagagtaatgcaagaagtgatgctgagaccaactttgtccaatgatgggtttcgttgtcttggtttggactcattgagtcacgacgaagcgtttaggtcatttactatcgggacatactcttttttttttttttttctttttttttttcacaagacatactcttttctttaatttcaattatttgttagagttctcgtt

SEQ ID NO: 40 - protein, 244 aa, Arabidopsis thaliana
MGRGKVEVKRIENKITRQVTFSKRKSGLLKKAYELSVLCDAEVSLIIFSTGGKLYEFSNVGVGRTIERYYRCKDNLLDNDTLEDTQGLRQEVTKLKCKYESLLRTHRNLVGEDLEGMSIKELQTLERQLEGALSATRKQKTQVMMEQMEELRRKERELGDINNKLKLETEDHDFKGFQDLLLNPVLTAGCSTDFSLQSTHQNYISDCNLGYFLQIGFQQHYEQGEGSSVTKSNARSDAETNFVQ

SEQ ID NO: 41 - DNA, 921 bp, Arabidopsis thaliana
atgggtcgtggaaaaatcgagataaagaggatcgagaatgcgaatagcagacaagtcactttttccaagaggcgttctgggttacttaagaaagctcgtgagctctctgttctttgtgatgctgaagttgctgtcatcgtcttctctaagtctggcaagctcttcgagtactccagtactggaatgaagcaaacactttccagatacggtaatcaccagagttcttcagcttctaaagcagaggaggattgtgcagaggtggatattttaaaggatcaactttcaaagcttcaagagaaacatttacaactgcagggcaagggcttgaatcctctgacctttaaagagctgcaaagccttgagcagcaactatatcatgcattgattactgtcagagagcgaaaggaacgattgctgactaaccaacttgaagaatcacgcctcaaggaacaacgagcagagttggaaaacgagaccttgcgtagacaggttcaagaactgaggagctttctcccgtcgttcacccactatgttccatcctacatcaaatgctttgctatagatccaaagaacgctctcataaaccacgacagtaaatgcagcctccagaacaccgattcagacacaactttgcaattagggttgccgggagaggcacatgatagaaggacgaatgaaggagaaagagagagcccgtcaagcgattcagtgacaacaaacacgagcagcgaaactgcagaaagaggggatcagtctagtttagcaaattctccacctgaagccaaaagacaaaggttctctgtttagtcctagaaaagtatgggagaaggctactaatgtttcctctttagcaagtatccgattgttttaaaagtaattttagagggatacttgcaaaaagaagagaagattcagttatct

SEQ ID NO: 42 - protein, 268 aa, Arabidopsis thaliana
MGRGKIEIKRIENANSRQVTFSKRRSGLLKKARELSVLCDAEVAVIVFSKSGKLFEYSSTGMKQTLSRYGNHQSSSASKAEEDCAEVDILKDQLSKLQEKHLQLQGKGLNPLTFKELQSLEQQLYHALITVRERKERLLTNQLEESRLKEQRAELENETLRRQVQELRSFLPSFTHYVPSYIKCFAIDPKNALINHDSKCSLQNTDSDTTLQLGLPGEAHDRRTNEGERESPSSDSVTTNTSSETAERGDQSSLANSPPEAKRQRFSV

SEQ ID NO: 43 - DNA, 1098 bp, Arabidopsis thaliana
aaaaaaaagaagcttctcctcttcctctgccttcttctttccatttattgcaaaccctgatcaattggttttggtgttagtcttttggggagagagatggggagagggaagatagttatacgaaggatcgataactctacaagtagacaagtgactttctccaagagaaggagtggtttgcttaagaaagctaaagagttatcgatcctttgtgatgcagaagttggtgttatcatattctctagcaccggaaagctctacgactacgcaagcaattcaagtatgaaaacaatcattgagcggtacaacagagtaaaagaggagcagcatcaacttctgaatcatgcctcagagataaagttttggcaaagagaggttgcaagtttgcagcagcagctccaatatctacaagaatgccacaggaaactagtgggagaggaactttctggaatgaatgctaacgacctacaaaaccttgaagaccagctagtaacaagtctaaaaggtgttcgtctcaaaaaggatcaacttatgacaaatgaaatcagagaacttaatcgtaagggacaaatcatccaaaaagagaatcacgagctacaaaatattgtagatataatgcgtaaggaaaatattaaattgcaaaagaaggttcatggaagaacaaatgcgattgaaggcaattcaagtgtagatccaataagcaatggaaccacaacatatgcaccaccgcaacttcaactcatacaactacaaccagctcctagagaaaaatcaatcagactagggctacaactttcctagcaaaacatgtgggacatcgaacaatatacgaaaagagtttgtatgtcatcttcagtaacaaccaagctggatcatttcattcttggttatgtaattctgtttactactttggagtttaatatgttatatgacaagtttctctttgtcaagttacttgtgtatgtacatcataaaataatgatgtgatgtgagtgccgaacatactagacatcattttaccgtgtgtttttttcgggtacattaaatgtacaaaatccagtctaattggcatttttatacaaaaaaaaaaaaaaaaaa

SEQ ID NO: 44 - protein, 234 aa, Arabidopsis thaliana
MGRGKIVIRRIDNSTSRQVTFSKRRSGLLKKAKELSILCDAEVGVIIFSSTGKLYDYASNSSMKTIIERYNRVKEEQHQLLNHASEIKFWQREVASLQQQLQYLQECHRKLVGEELSGMNANDLQNLEDQLVTSLKGVRLKKDQLMTNEIRELNRKGQIIQKENHELQNIVDIMRKENIKLQKKVHGRTNAIEGNSSVDPISNGTTTYAPPQLQLIQLQPAPREKSIRLGLQLS

SEQ ID NO: 45 - DNA, 1058 bp, Arabidopsis thaliana
cccagagagacataagaaagaaagagagagagagatactttggtcatttcagggttgtcgtttctctctcttgttcttgagattttgaagagagagagatatgggaagaggtagggttcagctgaagaggatagagaacaagatcaataggcaagttactttctcaaagagaaggtctggtttgctcaagaaagctcatgagatctctgttctctgcgatgctgaggttgctctcatcgtcttctcttccaaaggcaaactcttcgaatattccaccgactcttgcatggagaggatacttgaacgctatgatcgctatttatattcagacaaacaacttgttggccgagacgtttcacaaagtgaaaattgggttctagaacatgctaagctcaaggcaagagttgaggtacttgagaagaacaaaaggaattttatgggggaagatcttgattcgttgagcttgaaggagcttcaaagcttggagcatcagctcgatgcagctatcaagagcattaggtcaagaaagaaccaagctatgttcgaatccatatctgcgctccagaagaaggataaagccttgcaagatcacaacaattcgcttctcaaaaagattaaggagagggagaagaaaacgggtcagcaagaaggacaattagtccaatgctccaactcttcttcagttcttctgcctcaatactgcgtaacctcctccagagatggctttgtggagagagttgggggagagaacggtggtgcatcgtcgttgacggaaccaaactctctgcttccggcttggatgttacgtcctaccactacgaacgagtagaactatctcactctttataatataatgataatataattaatgtttaatattttcataacattcagcatttttttggtgacttatactcattattaataccgatatgttttagctagtcatattatatgtatgatggaactccgttgtcgagacgtatgtacgtaagctatcattagattcactgcgtcttaagaacaaagattcatatcttggtaatgatttctcatga

SEQ ID NO: 46 - protein, 242 aa, Arabidopsis thaliana
MGRGRVQLKRIENKINRQVTFSKRRSGLLKKAHEISVLCDAEVALIVFSSKGKLFEYSTDSCMERILERYDRYLYSDKQLVGRDVSQSENWVLEHAKLKARVEVLEKNKRNFMGEDLDSLSLKELQSLEHQLDAAIKSIRSRKNQAMFESISALQKKDKALQDHNNSLLKKIKEREKKTGQQEGQLVQCSNSSSVLLPQYCVTSSRDGFVERVGGENGGASSLTEPNSLLPAWMLRPTTTNE

SEQ ID NO: 47 - DNA, 861 bp, Arabidopsis thaliana
atgggtcgaaagatggtaaagatgacgaggataacgaacgagaaaacgaggataacgacttacaagaagaggaaagcatgtttgtataagaaagccagtgagttctcaacactctgcggtgtggacacttgtgtcattgtgtacggcccgagcagagcaggggacgaaatggtcatggagcccgagttatggccaaaggatgggagcaaagtccgtgaaatcttaaccaagtacagagacactgcgtcaagcagctgcaccaagacatacaccgtgcaagaatgcttggagaaaaacaacactaaggtggagaaaccgacgattgcgacaaagtatcctacatgggacaaaaagctcgaccagtgttctttaaatgacctctatgcggttttcatggcagtagaaaacaagatccaagaggctacgaataggaatcagacatttcctgacactagttgttggtctaatgaccaacttggtttatgcggttacaatcggcaatgttttgagcagtatcagttgtttcctctgcctactatggattacaacgggctctctttcttcccttttaataaccagatgacctcaaatactgcggaagtgtcttccttctcgaatgtgacagagccgatgatagcgaacgggcaaagcttgttttacgggagttgttcggatggtccatatggtccgatggtacagaggacagcttatatggagccaatacattggggtttaggaaacagtatgttcaacaatgtgaagcagttccaagattatcccttcaggtttgcacaagttaatgatttggaggattcaagtaaactttctatgtgagaaatgtcatttgtttcttccgtttga

SEQ ID NO: 48 - protein, 277 aa, Arabidopsis thaliana
MGRKMVKMTRITNEKTRITTYKKRKACLYKKASEFSTLCGVDTCVIVYGPSRAGDEMVMEPELWPKDGSKVREILTKYRDTASSSCTKTYTVQECLEKNNTKVEKPTIATKYPTWDKKLDQCSLNDLYAVFMAVENKIQEATNRNQTFPDTSCWSNDQLGLCGYNRQCFEQYQLFPLPTMDYNGLSFFPFNNQMTSNTAEVSSFSNVTEPMIANGQSLFYGSCSDGPYGPMVQRTAYMEPIHWGLGNSMFNNVKQFQDYPFRFAQVNDLEDSSKLSM

SEQ ID NO: 49 - DNA, 946 bp, Arabidopsis thaliana
aacattatgccttcatctgattccacgatgatgaagaaaggaacaaagcgcaaaatcgaaataaagaaacgagaaaccaaagagcaacgagccgtgacttgctctaaacgccgtcaaactgttttttccaaagccgccgatctctgtcttatctccggtgctaacatcgccgtcttcgtaacctctccctccgatagttccgatgttgtctattccttctccggttactcctctgcctacgaaatcgctgattgttacctaaatcgcaagcctccacccaagattgttaacccggccggatccaaactaggattttggtgggaagaccctgatctctaccattcgtgtgatgatctctctgagttaagcattatcgaggatcgtttacagagaatgaagaagcatgtgatggcttgccttgagaaggaagaaaaatctcaacttgtttctagtttcgaccaaaaccctaatagtacttgttctctcgacgtcgaggattgtgatggatcttcttattcgcaaattgcttctacttttactccaaactctgtcaacgagtattgcagcgatcaaaccttttcttctttccatggcgatcaaaaccctaacctctcgtctccgtcttttgatcaggactgttactcctctctctatcagatctgtggagaatcatcttcacaagttgcttcttttgatcaaaaccctagctccgagatccaaggatttgaaacagaggaagagattaaccaaatcaatctactactacaagaaacacaaacagaggccaatgtcaatttggatgatgagatctgcttttggaatgatctatccaacgatgatgtgtttggtctaaacagctacttcggtctcgataacaccaatgcaatgatcaacttcggagattccgactttagacgtcatgtctgatatgatgtggttgtaatct

SEQ ID NO: 50 - protein, 306 aa, Arabidopsis thaliana
MPSSDSTMMKKGTKRKIEIKKRETKEQRAVTCSKRRQTVFSKAADLCLISGANIAVFVTSPSDSSDVVYSFSGYSSAYEIADCYLNRKPPPKIVNPAGSKLGFWWEDPDLYHSCDDLSELSIIEDRLQRMKKHVMACLEKEEKSQLVSSFDQNPNSTCSLDVEDCDGSSYSQIASTFTPNSVNEYCSDQTFSSFHGDQNPNLSSPSFDQDCYSSLYQICGESSSQVASFDQNPSSEIQGFETEEEINQINLLLQETQTEANVNLDDEICFWNDLSNDDVFGLNSYFGLDNTNAMINFGDSDFRRHV

SEQ ID NO: 51 - DNA, 443 bp, Arabidopsis thaliana
agaagaaaccaaacttgtctatgagagaagatacaatgtttaagaaagccctcgagctttcaactctgtgcgatatcgaagtctgtgtcatactttatagtcgtgacggagaactcatcaagacatggccggaggatcaatccaaggttcgagacatggcagagaggtttagcaaactacacgagagagagcgacgcaagaaaagaaccaacctttctctgtttctacgtaagaagatcctcgacaacagtaagctctcggagaaagtcttagagatgaaggattcattagaaagtggtctacgggtactacaagataagcttctgttactacaacccgagaaaaaccagaccgagttaggtcagatccccgtcatcaacaatggacagaaccattggtgaatatcggtgtgtcaaacacagagcaagacctatcgacgtcac

SEQ ID NO: 52 - protein, 126 aa, Arabidopsis thaliana
MREDTMFKKALELSTLCDIEVCVILYSRDGELIKTWPEDQSKVRDMAERFSKLHERERRKKRTNLSLFLRKKILDNSKLSEKVLEMKDSLESGLRVLQDKLLLLQPEKNQTELGQIPVINNGQNHW

SEQ ID NO: 53 - DNA, 949 bp, Arabidopsis thaliana
gagagagaaagatgggtaggcctccatgctgtgacaagatagggatcaagaaaggaccatggactcctgaagaagatatcattcttgtttcttacattcaagaacatggtcctggaaactggagatcagttcccaccaacactgggttattgagatgcagcaaaagttgtagactgagatggacaaattatctgagacctggaattaaacgtggaaactttactcctcatgaagaaggaatgatcattcacttgcaagccttattgggtaacaaatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcacagaaaacatttcccgccttgtggagggttggatgagagcgtctccaaagagtagtacaagtactactttcttggaacacaaaatgcagaaccggacaaacaatttcatcgatcatcacagtgatcagtttccatacgagcagcttcaaggttctagggaagagggtcatagcaaaggaatcaacggggatgatgaccagggtataaagaattcagagaataacaacggtgatgatgttcatcatgaagatggtgatcatgaggatgatgatgatcataatgcaacaccaccattgacatttattgagaaatggcttttggaggaaacaagtactactgggggtcaaatggaagagatgagccacttgatggagctctctaatatgctttaattgtgacattttctcctttattttttctttatccttgtgaatcttataaatgagactactaattttatatacacaaataaagaaaccagaaagac

SEQ ID NO: 54 - protein, 280 aa, Arabidopsis thaliana
MGRPPCCDKIGIKKGPWTPEEDIILVSYIQEHGPGNWRSVPTNTGLLRCSKSCRLRWTNYLRPGIKRGNFTPHEEGMIIHLQALLGNKWASIASYLPQRTDNDIKNYWNTHLKKKLNKSDSDERSRSENIALQTSSTRNTINHRSTYASSTENISRLVEGWMRASPKSSTSTTFLEHKMQNRTNNFIDHHSDQFPYEQLQGSREEGHSKGINGDDDQGIKNSENNNGDDVHHEDGDHEDDDDHNATPPLTFIEKWLLEETSTTGGQMEEMSHLMELSNML

SEQ ID NO: 55 - DNA, 1164 bp, Arabidopsis thaliana
atgatttacgtagttcccgatctacttgaagaaattttccttggattgcctttaaaatcaatcctcagattcaaaaccgtctcaaaacaatggagatcaatcctggaatcgaagagtttcgcggagaggcgtttgaacgttgagaagaaggagaaaattctggctgttggagaccggactgagttgggattcgaaggtgaggaagagatccagatggtctatttacactgcgatattgacgccacacgaccctctctgacatgtgagggtttggtgtgtatcccagcaccaggttggatcaacgttttgaacccatcgaccagacaactccggagatttccttgtagccctaatcatcacgtgccctctgatcgtattcgttttcagttcagagacgaactatacctcacttcctttccggggaattgggagatgggatttggtagagacaaatttaatggtagctataaagtggtgaggatgtgttttagtcctgtggaaaaatgcgaggttcttgatgttgaaactggggaatggagtgaactgaatccacctcctaacgatattgacgtgggaaggaagtcacgtttcggaatcctagccttggatcttcacacactagagttccacaatgtttccgttccatctacgtgttgcaccatgagtgcccagatggtgaaccttgatgaccgtctagccataactaaaacaaacggtgcgccagaatgggagctagagatactgagcctgatggatgtagacaaagaaatatggagcaagacttactccataactttagccagtatcattattaaccacccatgggagtctagttggttcacggtgttgacggtttctaagctagggaatcttgtcttttgtgacaatcacaagcggttgtttaaatataataccgagacaaatgagatttgctgtctctcctcagatatttctgttatatctccttatctcgaggatttggtaccacttcgtttggactcaggacatgatcatcgggattacaaaatcaggacatctagttgcggattgttttcgaagcatccggaggcagggttattcaaggagatcatcacttttcggtttgtgtttgccactctagttctagttggttatcagtattatagatcattaaaattcaagtag

SEQ ID NO: 56 - protein, 387 aa, Arabidopsis thaliana
MIYVVPDLLEEIFLGLPLKSILRFKTVSKQWRSILESKSFAERRLNVEKKEKILAVGDRTELGFEGEEEIQMVYLHCDIDATRPSLTCEGLVCIPAPGWINVLNPSTRQLRRFPCSPNHHVPSDRIRFQFRDELYLTSFPGNWEMGFGRDKFNGSYKVVRMCFSPVEKCEVLDVETGEWSELNPPPNDIDVGRKSRFGILALDLHTLEFHNVSVPSTCCTMSAQMVNLDDRLAITKTNGAPEWELEILSLMDVDKEIWSKTYSITLASIIINHPWESSWFTVLTVSKLGNLVFCDNHKRLFKYNTETNEICCLSSDISVISPYLEDLVPLRLDSGHDHRDYKIRTSSCGLFSKHPEAGLFKEIITFRFVFATLVLVGYQYYRSLKFK

SEQ ID NO: 57 - DNA, 963 bp, Arabidopsis thaliana
atgggtcggattccatgttgtgaaaaggagaatgtgaagagaggacaatggactcctgaagaagacaacaaattggcttcttatattgctcaacatggtactcgtaattggcgtctcatccctaagaatgctgggttgcaaagatgtgggaagagttgtaggctgcgatggacaaactatctgcgtccggatttgaaacatggccagttctcggaggctgaagaacatatcattgtcaagtttcactctgttcttggtaaccggtggtcgttgattgcggcgcaacttcctggtcggacagacaacgatgtgaaaaattattggaacacgaagctgaagaagaagttgtcaggaatgggaatagatccggtgacccacaagcctttctcgcatctaatggcagagatcaccactacacttaatcctcctcaggtttctcacctagccgaagctgccctcggctgtttcaaggacgagatgcttcacttgctcaccaagaaacgtgttgacctaaaccaaatcaacttttcaaaccataaccctaacccaaacaactttcacgagattgctgataatgaagctggtaagataaagatggatggtttggaccatgggaatgggataatgaagttatgggacatgggtaatggattctcatatggatcctcttcgtcttcgtttgggaatgaagaaagaaatgatggatcagcgtctcctgccgttgcagcttggaggggtcacggaggaatacgtaccgcggtagctgaaaccgcggcagcggaggaggaggagagaaggaagctgaagggagaagtggttgatcaagaggagattggatctgaaggaggaagaggagatggaatgacgatgatgaggaaccatcatcatcatcaacatgtgtttaatgtggataatgtcttgtgggatttacaagctgatgatctcatcaatcatatggtttga

SEQ ID NO: 58 - protein, 320 aa, Arabidopsis thaliana
MGRIPCCEKENVKRGQWTPEEDNKLASYIAQHGTRNWRLIPKNAGLQRCGKSCRLRWTNYLRPDLKHGQFSEAEEHIIVKFHSVLGNRWSLIAAQLPGRTDNDVKNYWNTKLKKKLSGMGIDPVTHKPFSHLMAEITTTLNPPQVSHLAEAALGCFKDEMLHLLTKKRVDLNQINFSNHNPNPNNFHEIADNEAGKIKMDGLDHGNGIMKLWDMGNGFSYGSSSSSFGNEERNDGSASPAVAAWRGHGGIRTAVAETAAAEEEERRKLKGEVVDQEEIGSEGGRGDGMTMMRNHHHHQHVFNVDNVLWDLQADDLINHMV

SEQ ID NO: 59 - DNA, 981 bp, Arabidopsis thaliana
atgtatctgtttatgtataaatgtaacatagttttggaggagactcatgtttttcaaaataccccttgtgatgtttcattgcagaggccatttaatgggtttggagaaaacaatgcattaccattgagaaagatgcatcaagaggagaagaagaagaaacataggggtggacactggacactttcagaggatctcaaactcaaagagcttgtggcggtttttggtcctcagaactggaaattcattggagagaagatggaaccaagaacaagtctaagttgtagacaaaggtggtttaaccagctcgatccgaagattaacaaaagaaatttcactgatgaggaagaagagaagctgcttagagctcacatattatatggtaacaaatggtctaagatcgctaagcttttcaatcgaagaacagaccatgctgttaagaatcattggcacagtctcatgaatagaatcattaggaagcaatcagcttctgacataagatctttcgataacatccagaattatcaaacctccaactttcttcctgctcaatgctcaatatctccaagaaaagaattattcttcatgcatgccattgcaacactcatgtcatcatcatcacttctctaccttccctgcaaattccttggccttattcacacctcatgtctccatctctcaaccatcatcatcatcgttactatcatcatcagaagcagaagatataatgactacaaaaaccccgaggtatatagattttctcggggtaggagattcttgaagaaactacttaagaacttcctaactgtaaccttaattccaatgatgaggaagggtgggcgcgccgacccagctttcttgtacaaagttggcattataagaaagcattgctcatcaatttgttgcaacgaacaggtcactatcagtcaaaataaaatcattatttgccatccagctgatatcccctatagtgagtcgtattaa

SEQ ID NO: 60 - protein, 326 aa, Arabidopsis thaliana
MYLFMYKCNIVLEETHVFQNTPCDVSLQRPFNGFGENNALPLRKMHQEEKKKKHRGGHWTLSEDLKLKELVAVFGPQNWKFIGEKMEPRTSLSCRQRWFNQLDPKINKRNFTDEEEEKLLRAHILYGNKWSKIAKLFNRRTDHAVKNHWHSLMNRIIRKQSASDIRSFDNIQNYQTSNFLPAQCSISPRKELFFMHAIATLMSSSSLLYLPCKFLGLIHTSCLHLSTIIIIVTIIIRSRRYNDYKNPEVYRFSRGRRFLKKLLKNFLTVTLIPMMRKGGRADPAFLYKVGIIRKHCSSICCNEQVTISQNKIIICHPADIPYSESY

SEQ ID NO: 61 - DNA, 624 bp, Arabidopsis thaliana
atggatccacttaaacaggttcaagaagaaatcaattcattgaggtggaaacgttggacactttcagaggatttgaaactaaaagagcttgtggctgtgtatggtcctcaaaaatggccgcacattggaaagcaaatgcaaggcagatcaggtaagtcttgtagatcaaggtggtataaccatttggatccaaggattaggaatgatgtttttagtgacgaggaagaaaaattgctaatcaaagcttacaacgaatggggttgcaaatggtctaagattgctaggcttttccctggaagaacagacagacaaatgcagagactatggcgattgtttgtacgtgataaaagtacaaagatgccacaagaggaaaccactcacctcgaagctaagtatcgcaacgaaacaatgaattacttagctcatcaacgtcgcttctataacatccctaaaggtttcttggcaatgtccacaccgcctgtctccaactctcaaccatcatcatcatcatcatcaccatcattaccatccaaacccgaagatgcaaaggccaatatacccgcaaagtatatagactttctcgggttaggagattctgaaaagaaaaagaagaaactactatag

SEQ ID NO: 62 - protein, 207 aa, Arabidopsis thaliana
MDPLKQVQEEINSLRWKRWTLSEDLKLKELVAVYGPQKWPHIGKQMQGRSGKSCRSRWYNHLDPRIRNDVFSDEEEKLLIKAYNEWGCKWSKIARLFPGRTDRQMQRLWRLFVRDKSTKMPQEETTHLEAKYRNETMNYLAHQRRFYNIPKGFLAMSTPPVSNSQPSSSSSSPSLPSKPEDAKANIPAKYIDFLGLGDSEKKKKKLL

SEQ ID NO: 63 - DNA, 2253 bp, Arabidopsis thaliana
cgctgatccttcacacgcaagctaatgaagcctctcactaatggcgatctgttcaaatccccaactctgatcaagatctccgccttagttttcgtcaccgtcgctttcttctacttaggcaagcattggtccgacgatggctaccaacagctcgtcttcttctcctcttccacttccggtagctcgatcccggaggtctccgtttcaccgaatagtaacagagtctttaatttatcagcgataattcctactaaccatacccagattgaaatccccgccacaatacgacaacaacctccgtcggtggtggcggacacggagaaggttaaggtggaagctaatcctcctcctcctccacctccttctccttcacctcctcctccgcctggtccggttaagagctttgggatagttgatgcgaacggtgtgatgtctgacgattttgaggtgggtgaggttgagagtgatacagtggaagattgggggaatcagactgagatcgttgaggcgaaaagcgacggtgattctaaggctagggttagaattaagaaatttgggatgtgtcctgagagtatgagagagtatataccttgtttggataatactgatgtgataaagaagcttaaatcgacagagcgaggtgagagattcgagcgtcattgtcctgagaaaggtaaaggcttgaattgcttagttccacctcctaaaggttaccgtcagccgattccatggcctaaaagccgtgacgaggtatggtttagcaatgttcctcatactcggcttgttgaagacaaaggaggtcagaactggatttcacgagacaagaacaagttcaagtttcctggaggtggtacacagtttattcatggggctgatcagtacttggaccagatgtctaagatggtttctgatattacgtttggcaagcatattagggttgctatggatgttggttgtggtgtggcgagttttggtgcttatctattgtctcgtgatgtcatgacaatgtctgttgcaccaaaagatgtccatgagaaccaaattcaatttgctcttgagcgtggtgtgcctgctatggcggcagcatttgcgacaaggcgtttgttatatccaagccaagcttttgatcttattcattgttcaagatgtagaatcaactggactcgtgatgatggaattttgctccttgagatcaatagaatgctgcgcgctggaggatattttgcttgggctgcacagcctgtttataagcatgaacccgctttggaagaacaatggacagaaatgctgaatcttactattagcctctgctggaaattggtaaagaaggaaggatacgttgcaatctggcagaagcctttcaacaacgactgctatttgagtcgtgaggctgggactaaacctcctctttgtgatgaatcagatgatcccgataatgtttggtacacaaatctgaaaccttgcatcagtcgcatacctgagaaagggtacggaggaaacgtccccttatggcctgcccgtctgcatactccacctgataggctgcagacgataaaatttgattcctacattgctaggaaagagctattcaaggcagaatcaaaatattggaatgaaataattgggggctatgttcgcgccttaaaatggaaaaagatgaaactaagaaatgttttggacatgagagcaggctttggcggatttgcagctgcactaaatgatcataaactcgattgctgggttctaagcgtggttcctgtcagtgggcctaacacattgcctgtcatttatgaccgtggactgttaggagtgatgcacgattggtgtgaaccatttgatacatacccacggacatatgacttcttacatgcctctggactcttctcgatcgagagaaaaagatgtgagatgtcaaccatattgttagagatggaccggatattaagacccggtggaagagcatacattagggattcaattgatgttatggatgaaattcaagaaatcacaaaggccatgggttggcatacttctctgcgtgacacatccgagggtcctcacgcaagttacaggattctaacatgcgagaagcgtctccttcgagcttaataccacacaagttactgcactagtcaacacaatatattttgtttggtagtatatctcttattgttttcttcttttttctcttaatgtaactgtaaatttgattgtggtgttttactgagtaaaagtttacctcgtcctcaaaaa

SEQ ID NO: 64 - protein, 694 aa, Arabidopsis thaliana
MKPLTNGDLFKSPTLIKISALVFVTVAFFYLGKHWSDDGYQQLVFFSSSTSGSSIPEVSVSPNSNRVFNLSAIIPTNHTQIEIPATIRQQPPSVVADTEKVKVEANPPPPPPPSPSPPPPPGPVKSFGIVDANGVMSDDFEVGEVESDTVEDWGNQTEIVEAKSDGDSKARVRIKKFGMCPESMREYIPCLDNTDVIKKLKSTERGERFERHCPEKGKGLNCLVPPPKGYRQPIPWPKSRDEVWFSNVPHTRLVEDKGGQNWISRDKNKFKFPGGGTQFIHGADQYLDQMSKMVSDITFGKHIRVAMDVGCGVASFGAYLLSRDVMTMSVAPKDVHENQIQFALERGVPAMAAAFATRRLLYPSQAFDLIHCSRCRINWTRDDGILLLEINRMLRAGGYFAWAAQPVYKHEPALEEQWTEMLNLTISLCWKLVKKEGYVAIWQKPFNNDCYLSREAGTKPPLCDESDDPDNVWYTNLKPCISRIPEKGYGGNVPLWPARLHTPPDRLQTIKFDSYIARKELFKAESKYWNEIIGGYVRALKWKKMKLRNVLDMRAGFGGFAAALNDHKLDCWVLSVVPVSGPNTLPVIYDRGLLGVMHDWCEPFDTYPRTYDFLHASGLFSIERKRCEMSTILLEMDRILRPGGRAYIRDSIDVMDEIQEITKAMGWHTSLRDTSEGPHASYRILTCEKRLLRA

SEQ ID NO: 65 - DNA, 2843 bp, Arabidopsis thaliana
gtgtttgtcgtgggtcggtttataatcattatctcccccggaaaacttctcggagaaggagaagaatggttattccggcgacttctaggtttgggtttcgtgctgaattcaacaccaaggagtttcaagcttcctgcatctctctcgctaatgaaatcgatgcggctattgggagaaatgaagttccagggaatattcaagagctcgctttaatcctcaataatgtgtgccgacgtaaatgtgatgattatcaaaccagggcggtggtaatggcgctgatgatctcagtcaagagtgcttgtcagcttggatggttcccggagagagagactcaagaattgttggctatcatagacttgatgtggaatggtttcagctgtcctgaaaatgtcacctcttgtgtaaatagtcccgtcactctaatatcgcaggtcattgagaggttctatccatgtgtgaagctggggcatattcttgtttcttttgaagctaagccagaatcaaagatgatgatgaaggacttccatatttcaaagaagatgccacattctcccaaacagaaagttggattatttgttgttcggacagaggacataagcagatctaattgtattgtacatccacaaggagtcagctttttgttgaatggaaagggcattgacaagagagttaacatctcaatggagtctgggccgcagcttccaactaatgttactgccctgctaaaccttggggcaaatcttctacaagcaataggctgttttggaggtagttacttgattgctattgctttcatggatgtcataccactgcccaacaaaccgttactgaaagattatgttcatcctgaagtcgttggatcaaactcagattgtgacataattgaggggccatcgaggatatctctcagttgtcctatcagccggacgcgtatcaaacttcctgtgaagggtcatgtctgtaaacatcttcagtgttttgatttctggaattatgtcaacatgaacacaagacgaccatcatggcgctgcccgcattgtaatcagtctgtttgctatactgatatccgtgtagatcaaaaactgagaaagattctagaagaagtgggacgtaatgctgcagatgtggttatctctgctgatggaacctggatggttgagacggaaaatgatgaggacgtggaacttgtgccagaaaccactcatgaccatggagacccaaatagtttcatcaacttggggcctactgttaagaatcctgccagagatgagaatgaaatggaaacatccacccaagtcgaagaacataatccttgtttatctgagattcagggtccgtcaaatgacacacataggcctgcttcagattatactatgcttaaccagtctcatacttcaaccaacacactaccacagctgccacgaactttgaatgcctttgatggtcaacaattcgtgaacttaccacaagtaataaacacccgagattcaccagcaagccaagccttacctatgacattctcaccaaccccatctccacaagatatattagctactaatgcggcaaactttggcacatcaatgccggctgctcagtcttctcagtttcaaggctcacatgttacgtcccttggaaattgtgaaggaagaacttctgatttgatggcgagatggaaccacatctatggacgtgttcaaactcaatttccacctgcacctctttcgcatcatcattattcaatgcagaatcagagcccgtcccctgcacagcaaagaccagtgccatcttacattgcacatcctcaaacttttcatgtcaactacggagagaacgctgaccaaagatggatgccgtcttccattgcacatcctcaaactttacctgttaactacggaggaaatactaaccaaagaccgataccatcttccattgcacatcctcaaactttacctgtcaactacagggggaatactgaccatagatcgacgccatattccattacacatctccaaacattacttaactacggagggaacgccgatcaaagaccaatgccatcttccattacaaatctccaaactttacctgccacgtacggagggtacgcccaccaaagaccaatgtcatcttccattacacatccccgaacttcacctgtcaactacggagggacccctgaccaaagaccaatgccatcttccattacacatccccaaactttacctgtcagctacggagggaccacagaccaaatactgaatcctggtggtgcaatgggacagttctcatcacgagagttcatgaatttgactcctgctaacactgagaattggcgcccacaaagccggatgcgaggcagcgtagcacctggtacgggatatgaccatatgatcattcatcctacccgtccagttcatccacaagctcaaacacctcctgcgcctctttcaacatcttatgatggagcagatgaaattcaagcatttatagggcacccaagctatcccgttagtaataacgaaacacaagcgggtaccagttcgttgccagtggcagagggtcttgggtattcagggtcgttttggtcaatgcctcctgagacatggtgatatctgatggcttagagattgtagcacacggtcactaacacaatcagtcagtagtaagtagtaacagtatataactaaggcctttctttttttggtacttacagctttagtcttcgggtacatatatggggctaagttcttgatgtagcgtattcgtgagatttacttcatgtgaaacattagggtatcttttggccgatttactatcacaatatagcaggttcagttcgcttt

SEQ ID NO: 66 - protein, 847 aa, Arabidopsis thaliana
MVIPATSRFGFRAEFNTKEFQASCISLANEIDAAIGRNEVPGNIQELALILNNVCRRKCDDYQTRAVVMALMISVKSACQLGWFPERETQELLAIIDLMWNGFSCPENVTSCVNSPVTLISQVIERFYPCVKLGHILVSFEAKPESKMMMKDFHISKKMPHSPKQKVGLFVVRTEDISRSNCIVHPQGVSFLLNGKGIDKRVNISMESGPQLPTNVTALLNLGANLLQAIGCFGGSYLIAIAFMDVIPLPNKPLLKDYVHPEVVGSNSDCDIIEGPSRISLSCPISRTRIKLPVKGHVCKHLQCFDFWNYVNMNTRRPSWRCPHCNQSVCYTDIRVDQKLRKILEEVGRNAADVVISADGTWMVETENDEDVELVPETTHDHGDPNSFINLGPTVKNPARDENEMETSTQVEEHNPCLSEIQGPSNDTHRPASDYTMLNQSHTSTNTLPQLPRTLNAFDGQQFVNLPQVINTRDSPASQALPMTFSPTPSPQDILATNAANFGTSMPAAQSSQFQGSHVTSLGNCEGRTSDLMARWNHIYGRVQTQFPPAPLSHHHYSMQNQSPSPAQQRPVPSYIAHPQTFHVNYGENADQRWMPSSIAHPQTLPVNYGGNTNQRPIPSSIAHPQTLPVNYRGNTDHRSTPYSITHLQTLLNYGGNADQRPMPSSITNLQTLPATYGGYAHQRPMSSSITHPRTSPVNYGGTPDQRPMPSSITHPQTLPVSYGGTTDQILNPGGAMGQFSSREFMNLTPANTENWRPQSRMRGSVAPGTGYDHMIIHPTRPVHPQAQTPPAPLSTSYDGADEIQAFIGHPSYPVSNNETQAGTSSLPVAEGLGYSGSFWSMPPETW

SEQ ID NO: 67 - DNA, 1536 bp, Arabidopsis thaliana
atgaagagagagcacaaccaccgtgaatcatccgccggagaaggtgggagttcatcaatgacgacggtgattaaagaagaagctgccggagttgacgagcttttggttgttttaggttacaaagttcgatcatccgacatggctgacgtggcacacaagcttgaacagttagagatggttcttggtgatggaatctcgaatctttctgatgaaactgttcattacaatccttctgatctctctggttgggtcgaaagcatgctctcggatcttgacccgacccggattcaagaaaagcctgactcagagtacgatcttagagctattcctggctctgcagtgtatccacgtgacgagcacgtgactcgtcggagcaagaggacgagaattgaatcggagttatcctctacgcgctctgtggtggttttggattctcaagaaactggagtgcgtttagtccacgcgctattagcttgtgctgaagctgttcaacagaacaatttgaagttagccgacgcgctcgtgaagcacgtggggttactcgcgtcctctcaagctggtgctatgaggaaagtcgcgacttacttcgctgaagggcttgcgagaaggatttaccgtatttaccctcgagacgatgtcgcgttgtcttcgttttcggacactcttcagattcatttctatgagtcttgtccgtatctcaagtttgcgcattttacggcgaatcaagcgatacttgaggtttttgctacggcggagaaggttcatgttattgatttaggacttaaccatggtttacaatggccggctttgattcaagctcttgctttacgtcctaatggtccaccggattttcggttaaccgggatcggttattcgttaaccgatattcaagaagttggttggaaacttggtcagcttgcgagtactattggtgtcaatttcgaattcaagagcattgctttaaacaatttgtctgatcttaaaccggaaatgctagacattagacccggtttagaatcagtggcggttaactcggtcttcgagcttcatcgcctcttagctcatcccggttccatcgataagtttttatcgacaatcaaatcaatccgaccggatataatgactgtggtcgagcaagaagcaaaccataacggtaccgtatttctcgatcggttcacggaatcgctacattactattcgagcttattcgactcgctcgagggcccgccaagccaagaccgagtgatgtcggagttattcctaggacggcagatactaaaccttgtggcatgcgaaggagaagaccgggtagagaggcatgagactttaaatcagtggagaaaccggttcggtttaggaggatttaaaccggttagtatcggttcgaacgcgtataagcaagcaagcatgttgttggcactttatgccggggctgatgggtataatgtggaagagaatgaaggttgtttgttgcttggatggcaaacgcgaccgcttattgcaacatctgcgtggcgaatcaatcgtgtggaataa

SEQ ID NO: 68 - protein, 511 aa, Arabidopsis thaliana
MKREHNHRESSAGEGGSSSMTTVIKEEAAGVDELLVVLGYKVRSSDMADVAHKLEQLEMVLGDGISNLSDETVHYNPSDLSGWVESMLSDLDPTRIQEKPDSEYDLRAIPGSAVYPRDEHVTRRSKRTRIESELSSTRSVVVLDSQETGVRLVHALLACAEAVQQNNLKLADALVKHVGLLASSQAGAMRKVATYFAEGLARRIYRIYPRDDVALSSFSDTLQIHFYESCPYLKFAHFTANQAILEVFATAEKVHVIDLGLNHGLQWPALIQALALRPNGPPDFRLTGIGYSLTDIQEVGWKLGQLASTIGVNFEFKSIALNNLSDLKPEMLDIRPGLESVAVNSVFELHRLLAHPGSIDKFLSTIKSIRPDIMTVVEQEANHNGTVFLDRFTESLHYYSSLFDSLEGPPSQDRVMSELFLGRQILNLVACEGEDRVERHETLNQWRNRFGLGGFKPVSIGSNAYKQASMLLALYAGADGYNVEENEGCLLLGWQTRPLIATSAWRINRVE

SEQ ID NO: 69 - DNA, 930 bp, Arabidopsis thaliana
atgaacacaacccaaattctaaacccgacccgacccatttggcccagtttctcttcgtccaaatctcttagcggtgatgctaactgcatggagcagcttctcctccattgcgcaaacgccatcgaatcaaacgacgccacgttggctcaacagatcatttgggtgctcaacaacctcgcttcacccgacggcgactcaactcaaagactcgctgcctctttcctccgcgcgttaatatcacgcaccgcctccaaaagccctgcgtttgcgtttctatcactggctgctacagcttccatatcccagaaaacgctacaccggttctccgtcatagagctcgctgagttcgtcgacttgacgccatggcaccgtttcggattcatagccgccaacgccgcaatcctcgacgccgtagaaggttactcatccgttcacatcgttgacttaagtttgactcactgcatgcaaatccctactcttatagactccatggcaaacaaactccacaaaaaaccgcctccgcttctcaaactcaccgtcattgcttccgacgctgaatttcatccgccgccgttgctcggaatctcctacgaagagctaggttcaaagctagtaaacttcgcaaccacacgtaacgttgcaatggagtttagaatcatatcttcttcttactccgacggcctctcctcccttatcgaacaactaagaatcgacccattcgtcttcaacgaagctctcgtcgttaactgccacatgatgcttcactatatccccgacgaaatattaacttcgaatctccgatcagttttcttgaaagaacttcgagatctaaacccaacgatcgtaacccttatcgacgaagactcggatttcacgtcgactaactttatctccaggtttatcttttttcggttctatttcaaaatttaa

SEQ ID NO: 70 - protein, 309 aa, Arabidopsis thaliana
MNTTQILNPTRPIWPSFSSSKSLSGDANCMEQLLLHCANAIESNDATLAQQIIWVLNNLASPDGDSTQRLAASFLRALISRTASKSPAFAFLSLAATASISQKTLHRFSVIELAEFVDLTPWHRFGFIAANAAILDAVEGYSSVHIVDLSLTHCMQIPTLIDSMANKLHKKPPPLLKLTVIASDAEFHPPPLLGISYEELGSKLVNFATTRNVAMEFRIISSSYSDGLSSLIEQLRIDPFVFNEALVVNCHMMLHYIPDEILTSNLRSVFLKELRDLNPTIVTLIDEDSDFTSTNFISRFIFFRFYFKI

SEQ ID NO: 71 - DNA, 1056 bp, Arabidopsis thaliana
atgggatcaccattgtgcgagcatttggctaggctttgtcttcaatgtgatttgaagttacactctaagagtagtaccgctcttgtagaatcccttgaacaagggttgtgcctatgccaatcatgcttttcaaatcccaatgtaatctcgcgttttcttcttcttcttagaaacgatgctagtgattattcggcatataattttccactggatcttgattcctcttcttcgtcttgttcatcttcttttatcgatcgcaattgggaattttcccttggttccttacctctcaataatgaggactcatcatcatcttttgaaatccttcaaatatttgaagatcatacaaagaattatagtgatcaacaagtgttgacgcttcagcccgattatttggacataattcctaaggatagttcatgctcaggcttcaaaagctacgaaactaaagaagatatagagaatgttttgatgaacacttttgatggcgccgaggcagcagtattagacctaaaacaatataaccccgaggaagatttgatcctcacggagctaatcgatgaattagcaagagacaattcagagaccacgccgaccaatactttaccaacttcagcatctggtatgtcatcggatatacataaagattacaacactgaagctttggctaatgcaagttctcaagattattttataaaccaaatgattggctcaaaagcaaaggaagagaccaatgatcttgcaatactccctaacgctcttgttcaacttgactgtggacaatcgcagttgatacttaccgatgagatgttaccatgggagaatcaaacatttgtacctgttaagggatttagtccgaaagatcgagaagaggccaagaaaagatatttcgaaaagaagaagaaacgcaagtttgggaaacaaattagatatgaatctcgaaaatctacagcagatacgaagaaaagaatgaaaggaagatttacaaaagctggtgctgattatgactatgacccacgagctaatgatattaacaaagggaaaatacaaacatga

SEQ ID NO: 72 - protein, 351 aa, Arabidopsis thaliana
MGSPLCEHLARLCLQCDLKLHSKSSTALVESLEQGLCLCQSCFSNPNVISRFLLLLRNDASDYSAYNFPLDLDSSSSSCSSSFIDRNWEFSLGSLPLNNEDSSSSFEILQIFEDHTKNYSDQQVLTLQPDYLDIIPKDSSCSGFKSYETKEDIENVLMNTFDGAEAAVLDLKQYNPEEDLILTELIDELARDNSETTPTNTLPTSASGMSSDIHKDYNTEALANASSQDYFINQMIGSKAKEETNDLAILPNALVQLDCGQSQLILTDEMLPWENQTFVPVKGFSPKDREEAKKRYFEKKKKRKFGKQIRYESRKSTADTKKRMKGRFTKAGADYDYDPRANDINKGKIQT

SEQ ID NO: 73 - DNA, 2481 bp, Arabidopsis thaliana
cataagtgaacacagaagaagcggtggctctgagccggcgaaatctcctttctcatccctaaaattttcatgtccatcttgcctcctccgattatccaaggtcacaattcgtcttctccttcttcagattcctctctaaaccctagctctgagcatggcaacaactcttcttcttctctctctcctcttccctcctctcctccttcccggatctcttcttccaccggaactcgattctccggacattctgaatcctctcacaatttctccggtggctctagggaaccgagtgttgcagctgaggagggacatagccgtggatcttccaaagagatgacacaaaatggagcagggaaggagagtttttccccacctaatgcagataagcgtgaccattttcgatatgatggtcgaaggaataggtctagagggagaggtactggagctgctggttcttcttcttctcaattgcagcataattccggaccttttaattctcctagaggcggtgtttcgcatcataatccaactggtagaagagctaatatgataagtgggaatcatttactgaattttcagtatgatccgatttcgcaaccgcaatctaggggtcctcctccgcctcaaagaaggcaacaatataaggggaggccttttaacaaggatttgtttcttaaggccaattataagtttgttgtgttggacactggagatcattctcctgattcaatggatcctgataaaatgctgcagtgggatgatattatttgtgtaaggtattctactccgtctcctgtccagtgtccgatttgcttggagtatcctctatgtccgcagattacttcctgtgggcatattttctgtttcccgtgtattctacagtacctgttgactggtgttgataaccacaaggtggactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcagtctgttgatggtcagcacattatccttcacactttgaatgtgaagtgccttctgcatcactatggaagctatgactttcttccaccaagattgagtggaaagatactggaaatggaaaccattacccaatcagaagcgataaggagacgctaccgctttttaagtcatttttctttatcaactacacttcagatatgtgagattgatatgaaggaatccttgcctcctgatgcatttgctccatttatacatgaaattaagaagcgtgagaagcagcggaaagaacgtgcttggaaggatcgaaaaaataaaatcaaagctgaagtagctgcagctgcagagcttgtaccattgatggccagttttgggcagtcgtcttctagtgatgactttcccccattttccttggatgactttgaagctctgggaaactctgccccaatatcatcaagccctccaaacattggagagagaagttccttctcacatgtgacaaggctcggtttcgcagctggtcacgactccccaaacctgaataacgagccaacaaacgttcaaagcagcagcagcagcagtgaagtctcaaacgcaaccacaggtgcaagaaacacaaacataacatcctttgcgagtgtagcttcaagaacaacaacaccaatggcaccaaccgtcaaagagcccggtaagagagggaagaaacagagccgagtacttctatcgacaactagtgtacgccgttactgaaaaggcctatggatttgtgtatgtataataatcttttcatctaagaaaaactgagtaaagaaagaaccagagattatggtgagtgagtaagtg

SEQ ID NO: 74 - protein, 772 aa, Arabidopsis thaliana
MSILPPPIIQGHNSSSPSSDSSLNPSSEHGNNSSSSLSPLPSSPPSRISSSTGTRFSGHSESSHNFSGGSREPSVAAEEGHSRGSSKEMTQNGAGKESFSPPNADKRDHFRYDGRRNRSRGRGTGAAGSSSSQLQHNSGPFNSPRGGVSHHNPTGRRANMISGNHLLNFQYDPISQPQSRGPPPPQRRQQYKGRPFNKDLFLKANYKFVVLDTGDHSPDSMDPDKMLQWDDIICVRYSTPSPVQCPICLEYPLCPQITSCGHIFCFPCILQYLLTGVDNHKVDCFKRCPLCFVMISPRELYTVYIENVKQYSVGDPIEFVLLTRKKDSFAPTRKNEHDLAVPNGENEIYDPFSKFTFTQDVDLSVRQAVSELDSWIARADPQLVEDLEKHLYVNAALERLEQRKLYWNEHKLSIYSKVCTTARNQTQSLSPPDVSRVGYQAPMGGHGAPDSGSNDQDKSTEDSSADKSDGESQSSLEKGCDNDLGHPLEDQDAPSSSSCNGSKGFLSHQIDTKDLKDNDAYNFYQSVDGQHIILHTLNVKCLLHHYGSYDFLPPRLSGKILEMETITQSEAIRRRYRFLSHFSLSTTLQICEIDMKESLPPDAFAPFIHEIKKREKQRKERAWKDRKNKIKAEVAAAAELVPLMASFGQSSSSDDFPPFSLDDFEALGNSAPISSSPPNIGERSSFSHVTRLGFAAGHDSPNLNNEPTNVQSSSSSSEVSNATTGARNTNITSFASVASRTTTPMAPTVKEPGKRGKKQSRVLLSTTSVRRY

SEQ ID NO: 75 - DNA, 717 bp, Arabidopsis thaliana
atggagtgtgtagaagcatttctcggtgatttttccgtcgacgatcttctcgacctctctaacgccgacacttctttagagtcgtcttcgtcacaaagaaaagaagacgaacaagaacgtgagaaatttaagagcttttctgaccaaagtacccgtctttcaccgccagaggatctcttatcttttcccggcgacgctccggttggtgatttggaggacttagagtggttatccaacttcgtggaggattctttctcagaatcgtatatttcgagtgatttcccggtgaatccagtcgcgtcggtggaggttcggagacagtgcgttcctgttaaacctagaagcaaacgccgccgcaccaacggccgtatctggtctatggagtctccatctcctctgctatccaccgctgttgccagaaggaagaagagagggagacagaaggtggatgcatcgtacggtggcgtagtccagcagcagcagctgaggcggtgctgcagccattgtggagtccagaagacgcctcaatggagaatgggtccattaggtgcgaagacactgtgtaatgcttgtggggtccggtttaagtcgggtcgacttttacccgaatatagacccgcttgtagcccaacattcaccaacgagattcactctaactctcaccggaaagtgttggagctacggctcatgaaagtggcggatccggctcgggtttaa

SEQ ID NO: 76 - protein, 238 aa, Arabidopsis thaliana
MECVEAFLGDFSVDDLLDLSNADTSLESSSSQRKEDEQEREKFKSFSDQSTRLSPPEDLLSFPGDAPVGDLEDLEWLSNFVEDSFSESYISSDFPVNPVASVEVRRQCVPVKPRSKRRRTNGRIWSMESPSPLLSTAVARRKKRGRQKVDASYGGVVQQQQLRRCCSHCGVQKTPQWRMGPLGAKTLCNACGVRFKSGRLLPEYRPACSPTFTNEIHSNSHRKVLELRLMKVADPARV

SEQ ID NO: 77 - DNA, 775 bp, Arabidopsis thaliana
ctcacgcaacttcctctcttctcaagattcttctccatacttcaccttcttctatatatctctctgctctcaaattaggttttaaattttctatagcaatggcgcttgaagctcttaattcaccaagattggtcgaggatcccttaagattcaatggcgttgagcagtggaccaaatgtaagaaacgatccaaacgttcgagatctgatcttcatcataaccaccgtctcactgaggaagagtatctagctttctgtctcatgcttcttgctcgggatggcggcgatcttgactctgtgacggttgcggagaagccgagttataagtgtggcgtttgttacaagacgttttcgtcttaccaagctctcggcggtcataaagcgagccaccggagcttatacggtggtggagagaatgataaatcgacaccatccaccgccgtgaaatctcacgtttgttcggtttgcgggaaatctttcgccaccggtcaagctctcggcggccacaagcggtgccactacgatggtggcgtttcgaactcggaaggtgtggggtctactagccacgtcagcagtagtagccaccgtggatttgaccttaatattataccggtgcagggattttcgccggacgacgaagtgatgagtccgatggcgactaagaagcctcgcctgaagtaagtctttgttgaagacctggaagtttatcaaatgtaaatatcaaatttcaatttcaaggaacagttttgttgattctattaccaatacacaatacg

SEQ ID NO: 78 - protein, 193 aa, Arabidopsis thaliana
MALEALNSPRLVEDPLRFNGVEQWTKCKKRSKRSRSDLHHNHRLTEEEYLAFCLMLLARDGGDLDSVTVAEKPSYKCGVCYKTFSSYQALGGHKASHRSLYGGGENDKSTPSTAVKSHVCSVCGKSFATGQALGGHKRCHYDGGVSNSEGVGSTSHVSSSSHRGFDLNIIPVQGFSPDDEVMSPMATKKPRLK

SEQ ID NO: 79 - DNA, 537 bp, Arabidopsis thaliana
atgaagagagaaagatctgatttcgaagaatccctcaagaatattgacattgctaaatgtctgatgatactagcacaaacctccatggtcaaacagatcggtttgaaccaacataccgagagccatacaagcaaccaattcgaatgcaaaacatgtaacaagagattttcttcgtttcaagcccttggtggccaccgggcaagccataagaagccaaagctcaccgttgagcagaaagatgtgaaacatcttagcaacgattataaaggaaatcattttcacaagtgttccatatgcagtcagagttttgggaccggacaggctttaggtggtcacatgagacggcataggtcaagcatgacggtcgagccatcgttcatctctccgatgattccatccatgccggttttgaaacgatgcggtagtagtaagaggattttgagtttggatttgaatctgactccgttagagaatgatcttgaatatatctttgggaagacatttgtcccaaaaatagatatgaagttcgttctttag

SEQ ID NO: 80 - protein, 178 aa, Arabidopsis thaliana
MKRERSDFEESLKNIDIAKCLMILAQTSMVKQIGLNQHTESHTSNQFECKTCNKRFSSFQALGGHRASHKKPKLTVEQKDVKHLSNDYKGNHFHKCSICSQSFGTGQALGGHMRRHRSSMTVEPSFISPMIPSMPVLKRCGSSKRILSLDLNLTPLENDLEYIFGKTFVPKIDMKFVL

SEQ ID NO: 81 - DNA, 577 bp, Arabidopsis thaliana
tcctctgtagcttaagaacctctcaaaaatggcggaaccaccaccgtcttaccttcatttcgtaggtcctgcaaaaactcgatcatcaagcaaacgccactctttctcctcctctgcacatccagcttcccaccgtctctttccatgtcagtactgtcctcgaaagttctacacatctcaagctctcggcggtcaccaaaacgctcacaaacgcgaacgcgccgctgctcgtcgtaacctcggcgtcctcgctaactctccacccatcctcgacgacaacaacacgtttcttcgtccttacccttgcttttaccaaaacccatttcaaggatctacttctggaaacgaaccgcttcaggaacagccgacgatgatgacgatggatggctacgatccgtttcatccgtatccgtatgtgtacccttttgcattatccggtaacaacaacgacggaggaaacggcgttatggaagaagacgagcctctcgatctagacctttctctccgtttataagttatctctgctttcttctctgttttgttttttgttcagatgactcttttaagtacaactttg

SEQ ID NO: 82 - protein, 161 aa, Arabidopsis thaliana
MAEPPPSYLHFVGPAKTRSSSKRHSFSSSAHPASHRLFPCQYCPRKFYTSQALGGHQNAHKRERAAARRNLGVLANSPPILDDNNTFLRPYPCFYQNPFQGSTSGNEPLQEQPTMMTMDGYDPFHPYPYVYPFALSGNNNDGGNGVMEEDEPLDLDLSLRL

SEQ ID NO: 83 - DNA, 774 bp, Arabidopsis thaliana
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 84 - protein, 257 aa, Arabidopsis thaliana
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 85 - DNA, 1379 bp, Arabidopsis thaliana
atgcagaattcataaacaccgctctggaattttactttttaggataacaaaggagggtcattttatctgttaatgggtgaagagatatctagcactgtgaacctggatttgaatctgggtcctgatcctgagttaggtctcgagccagcgacgaattatgctcggtctgattggggtaatggacttgctgctagggaatccgaatctctgagaaggtttagaagtcggtaccggtcacgtttcagacggattgatatgcttccggttcttgctgagacacatagcccggcgatggaattgagtcagttgttgatcacttctggaaatgtagttgctttgcctgctggtgagggaagcatggctagtggagaaagggtcatcgaggactccaaaaagtgcgagaatgggagcaaagtgatggcagaagacaatgtaacagaggagaaaagagatgttgagaagagcgttggcagcgatgggagctttttcgattgttatatatgtttggatttgtccaaggatccagttgttactaattgtggccacctttactgttggtcttgcctttaccagtggctacaggtttcagaggcaaaagaatgcccggtttgtaaaggggaggtatctgtgaaaacagtgactccaatctatggacgtgggatacagaaaagagaatctgaggaggtttcaaacaccaagatcccttcgagaccccaagcacgacgcacagagagtttgaggactacacttaacaggtcaggtcatataccaacggaaatatttagacatttgcaggataggcttgaaagggaatctagtacaggagaaagacgcgccagaccatctcttaaccggtttatgacttcgaggggagttagagcagaggagaaccagtctagtgaagcactggttgaaccttcatcagatgagattaacgatattgatctgatcttaaataatgcccctgaaaatgaagaggaaaacgaaaacctaagctcgtcacgtgctttggcaacccagagacgatgggcacagatgtatgggagggtgtcgtcgtttactttgagctctgctgaaagattagcggatacttatttgataacacatgcattggggaggaaccaagaacaaaacagcagtcctcctgttggtgttgaagacagggattcgttctcaagcatagtaggtgtgataaactcggagagtcaagttgaaacggcggctgagattaattcaatgttgactgtatcgacttcttcgtctgttagaagacatgagaacagttcaagggtctctgatgttgacagtgcagattctcgtccactgaggagaagaaggagattagcttagaagagaatggaggagaagaaagaggaagc

SEQ ID NO: 86 - protein, 425 aa, Arabidopsis thaliana
MGEEISSTVNLDLNLGPDPELGLEPATNYARSDWGNGLAARESESLRRFRSRYRSRFRRIDMLPVLAETHSPAMELSQLLITSGNVVALPAGEGSMASGERVIEDSKKCENGSKVMAEDNVTEEKRDVEKSVGSDGSFFDCYICLDLSKDPVVTNCGHLYCWSCLYQWLQVSEAKECPVCKGEVSVKTVTPIYGRGIQKRESEEVSNTKIPSRPQARRTESLRTTLNRSGHIPTEIFRHLQDRLERESSTGERRARPSLNRFMTSRGVRAEENQSSEALVEPSSDEINDIDLILNNAPENEEENENLSSSRALATQRRWAQMYGRVSSFTLSSAERLADTYLITHALGRNQEQNSSPPVGVEDRDSFSSIVGVINSESQVETAAEINSMLTVSTSSSVRRHENSSRVSDVDSADSRPLRRRRRLA

SEQ ID NO: 87 - DNA, 1805 bp, Arabidopsis thaliana
attccctctcttcgatttttaattccttgctcctctgctcgtttctctaccggcgacgtaacctctctgtctctgttctgttccttgcctgctcgaggtgtgcatcttcttggaatcagctgactttgcggtcaatcggatttcttgggattgtttggagaaactttggaggtgatggacaacaaaaatgatcaggatattgatgttagatcagtggttgaagctgtttccgccgatctttcctttggtgctcccctctatgtggttgagagcatgtgcatgcgctgccaagaaaatggaacaaccagatttctattgaccttaattcctcacttcagaaaggtcttaatatctgcatttgaatgtccgcattgcggggaaaggaataatgaagttcagttcgcaggcgagattcaaccccgtggatgctgttacaatctagaggttctagctggtgatgtgaagatatttgaccggcaagttgtgaaatctgaatcagccactattaagattcctgaactggattttgagattccaccagaggcccaacgtggaagtttgtctactgtggaagggatattagcacgggctgctgatgaactgagtgcccttcaagaagaacgcaagaaagttgatcctaaaactgctgaagcaatagaccaattcttgtccaaactgagagcttgtgctaaagcagagacatccttcaccttcattttggatgatcctgctggaaacagtttcattgagaacccacatgctccatcaccagatccctctctaaccatcaaattctatgagcgaacaccagagcaacaagcaacacttggatatgttgctaacccatctcaggctggacaatcagaaggaagccttggcgcaccttctactaaaacagcttatgtacctaatggaacaatcggagcaactgctggtcatcgcgcgattgctcagagtaatagcactgatatttccgacaacttgttcagatactctgcgcctgaagaggtgatgactttcccttcaacttgcggagcatgtacggagccgtgtgagacacggatgttcgtgactaaaatcccgtactttcaggaagttattgtcatggcatctacatgtgacagttgtggctatcgtaattctgagttgaagcctggtggtgcaattcctgaaaagggaaagaagattactctctctgtgaggaacattacagaccttagccgagatgttatcaagtcggacactgcaggagtgataatcccagaacttgatctggagctagctggtggtacacttggtggaatggtaacaacagttgaagggttggttacacagatcagagaaagcctagcgagagttcacggattcacttttggtgatagtatggaagagagtaagttgaacaaatggagagaatttggagccaggctcactaagctcctaagctttgaacagccgtggacattgattcttgatgatgaattagcaaattcctttattgcaccagtaacagatgatatcaaagatgaccatcagctcacatttgaagagtacgagaggtcatgggatcaaaacgaggagttgggtctcaacgacatagatacttcttcagctgatgctgcttatgaatccacagagacgactaaattaccttaagattagttggtcttacatgatttaattttagatggtgatgatcagactgatggatccatatgttgttgtattgtaacaattaaagaatcaaagaacaaattcctctttttaatctattaaaaaaaaaacttttgagccaaaaaaaaaac

SEQ ID NO: 88 - protein, 493 aa, Arabidopsis thaliana
MDNKNDQDIDVRSVVEAVSADLSFGAPLYVVESMCMRCQENGTTRFLLTLIPHFRKVLISAFECPHCGERNNEVQFAGEIQPRGCCYNLEVLAGDVKIFDRQVVKSESATIKIPELDFEIPPEAQRGSLSTVEGILARAADELSALQEERKKVDPKTAEAIDQFLSKLRACAKAETSFTFILDDPAGNSFIENPHAPSPDPSLTIKFYERTPEQQATLGYVANPSQAGQSEGSLGAPSTKTAYVPNGTIGATAGHRAIAQSNSTDISDNLFRYSAPEEVMTFPSTCGACTEPCETRMFVTKIPYFQEVIVMASTCDSCGYRNSELKPGGAIPEKGKKITLSVRNITDLSRDVIKSDTAGVIIPELDLELAGGTLGGMVTTVEGLVTQIRESLARVHGFTFGDSMEESKLNKWREFGARLTKLLSFEQPWTLILDDELANSFIAPVTDDIKDDHQLTFEEYERSWDQNEELGLNDIDTSSADAAYESTETTKLP

SEQ ID NO: 89 - DNA, 2253 bp, Arabidopsis thaliana
gtctccccattaggcacattgttgagggcagggtagtctcgtgagttctcttctcctgagtgtaactgtggttaaaagcttagccaagatgcagggggagagggccagtcttggctatttatcagaggccttgaactttgagcatggttcttcttcaagtaatggtgtgatagatcattgggagaatattcacagtcttggtgataatgacttgcaggattacatgattgcaaattctgaatcaaatacttcgcttgcaaactcagtttatcacgagcaacagggtttacgcagatttagccttggtgaggctagctctagtggcacgaaggatgaagcttccagtcacaatgagcaacgaatggaaacaagatgctttgacggacgaggaaatgaaataattgatttagacccagtgtttgcgcagccatcaggcacaaatcaacctgttcagaatgtcaatctgaatgcagagtatatagaaattcacgaggatattaatccatatagaggtcggtctggcttcatagaagctaatggaccagggaccagggtctcacaacctggcagatcttttgaagagaacggtgttggaacaggttcttctgtagagggacgtcgtgcatcctgcaaaagaaaagctcttgaaggcagtattagtcaatcttcttcaggaggttatcatgatttccagcgtggagaaagcagttcgtggaccccaggttctacggtttttaggccaggaaatggtttaaacatatctggctcccttgacaatggaccaagaggaatggtctccggtactgtaccaaattttcctgtttctgcaccaaattttcctgtttctgccattgcagagagctccagtagaaatatatgcgtcaggagtaatccctcagatcatcaagaaactgtaaacccatctacctttgctgcgggaactgttgtcaggcggcctgtccctccatcccagttgaacttgtcaagacacttaccagcagatcagcattcattggacttgagacctggacagtcttttgtcgtttctcgtaacccaaattctactcctgtgagcataccacctggttcaaggactatgctaccaccatttcggtggactgggagctcactagtgggtggaacatcgaactctactgcgcccgttgagagaaatcttcatctagatgaaaccaggtcaagaagcatacccgggaatactcttgagattcccatgtttgcagctcctgaggtaggaaattttgcccgtagtcagagtagcagaaatgtaacaaatggaaacctgaatagtgcatcatcagtgtccaggacaggctcaacaacaagtgttccaccaccaccaccaccatcttctaatctagcgtggacttcttaccagaattcaccacattatcaaagaagaaggactgaaaggtctgaacttgcacgtaggtccttgctttcttcccttgcagcagatgctacaaaccagagatctggtgatcatccaacacttcgttcgttggcccctcctgcctcttcggatgggcttgtgcttcagcctggtggtgataatagtcagatgcataatcgggcttactcgagagcaggtccgttgtttgataggcaaggggatagtgtggttggtattcctcatcctttgcgggccttggcagctgcaagcagaggaagaagcagacttatggtgtcccagatgcagaatgtcttggatgtcatgcgtagggatgctaataataacaacttgcggcttgaggacgttatgcttctaaatcactcagtactatttgatggggctactggtcatgaccggtatagagacatgcgacttgatgtggacaacatgtcatatgaggaattgttggcactagaagagcggattggagatgtttgtaccggtgtaaacgaggaaaccatatcaaaccggttaaagcaacgaaaatacaaaagcaacacaaaatctccacaagatgcagagccatgctgtgtttgtcaggaggaatacaccgaaggagaagacatggggacactagaatgtgggcatgaattccatagccaatgcattaaagaatggctgaaacagaagaatctttgcccaatctgcaagactacaggcttgaacaccgcgaagaagcggaggatagcatgatgatttctcgaaagagctttttttttttcttaactattcaattttataatcaaaaatgaaagaaacagaaggtaccctaagcccaaggg

SEQ ID NO: 90 - protein, 691 aa, Arabidopsis thaliana
MQGERASLGYLSEALNFEHGSSSSNGVIDHWENIHSLGDNDLQDYMIANSESNTSLANSVYHEQQGLRRFSLGEASSSGTKDEASSHNEQRMETRCFDGRGNEIIDLDPVFAQPSGTNQPVQNVNLNAEYIEIHEDINPYRGRSGFIEANGPGTRVSQPGRSFEENGVGTGSSVEGRRASCKRKALEGSISQSSSGGYHDFQRGESSSWTPGSTVFRPGNGLNISGSLDNGPRGMVSGTVPNFPVSAPNFPVSAIAESSSRNICVRSNPSDHQETVNPSTFAAGTVVRRPVPPSQLNLSRHLPADQHSLDLRPGQSFVVSRNPNSTPVSIPPGSRTMLPPFRWTGSSLVGGTSNSTAPVERNLHLDETRSRSIPGNTLEIPMFAAPEVGNFARSQSSRNVTNGNLNSASSVSRTGSTTSVPPPPPPSSNLAWTSYQNSPHYQRRRTERSELARRSLLSSLAADATNQRSGDHPTLRSLAPPASSDGLVLQPGGDNSQMHNRAYSRAGPLFDRQGDSVVGIPHPLRALAAASRGRSRLMVSQMQNVLDVMRRDANNNNLRLEDVMLLNHSVLFDGATGHDRYRDMRLDVDNMSYEELLALEERIGDVCTGVNEETISNRLKQRKYKSNTKSPQDAEPCCVCQEEYTEGEDMGTLECGHEFHSQCIKEWLKQKNLCPICKTTGLNTAKKRRIA

SEQ ID NO: 91 - DNA, 2409 bp, Arabidopsis thaliana
atgaacttcggtagtctcttcgataacacacccggtggtggctctaccggagcaagacttctctccggtttaagttatggcaaccacaccgccgcaactaacgtcttacccggtggtgctatggctcaagcggcagcggctgctagtctcttctctcctcctctaacgaaatctgtttacgcttcttctggcctctctctagccctcgagcaaccggagagaggaaccaaccgtggagaagcatcgatgaggaacaataataacgtcggaggaggaggcgatactttcgatgggagtgtgaacagaagaagccgagaagaagaacatgagagtagatctggtagtgataacgttgaaggtatctccggtgaagatcaagacgctgctgataagcctcctcggaagaaacgttatcaccgacacactcctcaacaaatccaagaactcgaatctatgttcaaagagtgtccgcatccagacgagaaacaaagattagaactaagtaagagactttgcttagagacaagacaagtcaagttctggttccagaatcgtcgcactcagatgaagactcaattagagaggcatgagaacgcgttattgagacaagagaacgataagttaagagctgagaacatgtctattcgtgaagcaatgaggaatccaatctgcaccaattgtggtggacctgccatgcttggtgatgtctctcttgaagaacatcatctccgtatcgaaaacgctcgtttaaaagacgagcttgatcgtgtctgtaacctcaccggtaagttccttggccaccaccataatcaccactacaactcctccttagaactcgctgtcggcaccaacaacaacggtggacatttcgctttccctcctgatttcggcggtggtggtggttgcttacctccgcagcagcagcagtcgacggtgattaatgggattgatcagaagtcagttttgctggagctggctttaactgctatggatgagttagtgaagcttgctcagagtgaagaaccgttatgggtcaaaagcttggacggtgagagagacgagcttaaccaagatgagtacatgagaacattttcatctactaaaccaaccggtttagctactgaagcttctagaacctctggtatggtcatcatcaatagcttagctctcgtcgagactttaatggactccaatcggtggacggagatgttcccgtgtaacgtcgcaagagctacaaccaccgacgttatatccggtgggatggctggaacaataaatggtgcacttcaactgatgaatgcagagctacaagttttgtctccactggttccggttcgtaatgttaatttcctccggttctgcaaacagcacgcggagggtgtgtgggcggtggtggatgtatcaattgatcctgtcagggaaaactctggtggtgccccggtaatccggcgactaccatcaggatgtgtggtgcaggatgtgtctaatggatactctaaggtcacgtgggtggagcatgcagaatacgacgagaaccaaatccaccagctgtacaggccgttgctacggtcaggccttggttttggctctcaaagatggctcgctacacttcagagacagtgcgagtgtctcgccatcctcatttcttcctccgttacatctcacgacaacacatcaataacgcctggtggtcgaaaaagcatgctgaagttagctcaacgcatgacgttcaacttctgttcgggaatctcggcgccgtcggtccacaattggagcaagctcactgttggaaatgttgacccggacgttcgagttatgacccgtaagagtgtggacgatccaggagagcctccggggattgttttgagtgctgccacttctgtttggctacctgctgcaccacagcgtctgtatgatttcttgcggaacgaacggatgagatgcgaatgggatattctatccaacggtggtcccatgcaggagatggcccatatcaccaaaggtcaagatcagggtgtctctctgctccgctccaatgcaatgaacgcgaatcagagtagtatgctaattcttcaggagacatgcattgacgcatctggagcgcttgtagtatacgcgcctgtcgacattcccgccatgcatgtggtgatgaacggtggtgattcatcctacgtggctctccttccgtccggtttcgctgttcttcctgacggaggcattgacggtggtgggtcaggtgatggtgaccagcgaccggttggtggtggatccctcttgacagtggcgtttcaaatccttgtaaacaatctcccaacggcaaaactcacggttgagtcggtggagactgtcaacaacctaatatcatgcaccgttcagaagattcgtgccgctttacaatgcgaaagctga

SEQ ID NO: 92 - protein, 802 aa, Arabidopsis thaliana
MNFGSLFDNTPGGGSTGARLLSGLSYGNHTAATNVLPGGAMAQAAAAASLFSPPLTKSVYASSGLSLALEQPERGTNRGEASMRNNNNVGGGGDTFDGSVNRRSREEEHESRSGSDNVEGISGEDQDAADKPPRKKRYHRHTPQQIQELESMFKECPHPDEKQRLELSKRLCLETRQVKFWFQNRRTQMKTQLERHENALLRQENDKLRAENMSIREAMRNPICTNCGGPAMLGDVSLEEHHLRIENARLKDELDRVCNLTGKFLGHHHNHHYNSSLELAVGTNNNGGHFAFPPDFGGGGGCLPPQQQQSTVINGIDQKSVLLELALTAMDELVKLAQSEEPLWVKSLDGERDELNQDEYMRTFSSTKPTGLATEASRTSGMVIINSLALVETLMDSNRWTEMFPCNVARATTTDVISGGMAGTINGALQLMNAELQVLSPLVPVRNVNFLRFCKQHAEGVWAVVDVSIDPVRENSGGAPVIRRLPSGCVVQDVSNGYSKVTWVEHAEYDENQIHQLYRPLLRSGLGFGSQRWLATLQRQCECLAILISSSVTSHDNTSITPGGRKSMLKLAQRMTFNFCSGISAPSVHNWSKLTVGNVDPDVRVMTRKSVDDPGEPPGIVLSAATSVWLPAAPQRLYDFLRNERMRCEWDILSNGGPMQEMAHITKGQDQGVSLLRSNAMNANQSSMLILQETCIDASGALVVYAPVDIPAMHVVMNGGDSSYVALLPSGFAVLPDGGIDGGGSGDGDQRPVGGGSLLTVAFQILVNNLPTAKLTVESVETVNNLISCTVQKIRAALQCES

SEQ ID NO: 93 - DNA, 2388 bp, Arabidopsis thaliana
atggaggagagtgaaacaaaggggagaatcagtcaagaaactgataaggcttgtgtttcagttgagagaattgggtctactttactctcatcatttgtgaagaaaggtaaagaagtatcaaataagagaaattctaagcagaataagcgaaaagcggaagaagaactctgttcgaaatcaagaaccaagaagtactctcggggatgggtccgttgtgaggaaatggaggaggagaaggttaagaaaacaagaaagaggaaaagtaagagacagcaaaaggataataaggttgaggttgatgattctttaaggttgcaaaggaggacaaggtatttgctcattaagatgaagatgcagcagaatcttatcgatgcatacgcaactgaaggttggaaaggtcagagccgggaaaagataagaccagacaaggagcttgagagagcccggaaagagatcttaaactgcaagcttggactacgcgacgccattcgccaactggatctgcttagttctgtgggaagcatggaagagaaagtgatagcttcagatggatctattcatcatgatcatatattttgtgcagaatgcaattctcgagaagcttttccagacaatgatataatactttgtgatggaacgtgtaatcgagcatttcaccagaaatgccttgaccctcctttggaaacagaaagcatacctcccggagatcagggctggttttgcaaattttgtgattgcaaaattgaaattatcgacacaatgaatgcacaaattggaactcatttccctgtggacagcaactggcaggatatcttcaatgaagaagctagtcttcctattggatctgaagctacagttaacaatgaagcagattggccttcggatgactccaaggatgatgattatgaccctgaaatgagggaaaacggtggaggaaacagcagcaacgttagtggtgatggtggtggtgataacgatgaagaaagcatttcaactagcttgagcttatcatctgatggtgttgccctttcaacgggatcatgggaaggccatagactcagcaatatggtggagcagtgcgaaacaagtaatgaagaaactgtatgtgggccaagacagcgaaggactgttgactatacacagttgtactatgaaatgtttggaaaggatgcagttttgcaagagcaaggtagtgaagatgaagactggggtccgaatgacagaaggaagagaaaaagggaatctgatgcaggaagcacacttgtaactatgtgtgaaagcagtaagaaagatcaagatgttgtagaaacgctagaacagagtgagagagattctgtctctgtggaaaataaaggaggtcgaaggcggatgttcagactcccaagaaatgcagttgagctacgtcaagtatttgcagagactgagcttccctcaaaagctgtgagggatcgtcttgcaaaagagctgagtcttgatccagagaaggtcaataaatggtttaaaaatactcggtatatggcactgcggaataggaagactgagagcgtgaaacaacctggggattctaagacagtctctggaggagattctggaccagaagcagtcatggagaacaacactgaaacaaatgaagttcaagatactttggatgacactgttccacccggatttgacgctacaaatcaaaacatactctccccatgtaataacaaccaggaggaatttcaacaggaaaatgtctcttttccttcacccacagatgaaagtcaacagtatctggaacaaaacgattcttctttcgttctagtgccacatgaaaagcaaagcagcgaaattagcttaaagacggctgtagaggagaatgagacagaaagcaagatgatgaaagagccacatgaagagctaagcagtgaaatgagcctaaagacggctgctgaggagaaggagacagagagcaagatgatagaagagccacatgaagagctaagcagagaaatgagcttaaagacggctgtagaggagaaggagacagagagcaagatgatggaagagccacatgatgagctaaacagcgaaatgagcttaagtacagcggtagaggagaaggagacagggagcaagatgacggaagagtcacatgaagagctaagcaacgaaatgagcttagaagagaaggagacggggagaaagatgacggaagaggaagaattggaagcagtaatggagatgctttgtagaacagaaaacaagttactggacgtgacgcagaggcttgatagatttaaaacaccaaaaggccgaaaaaagttaggcaattcttcttctcctttacttgaagaagactcagtagtgtatgttccaatagcagagatcaaggagaaaaggtaa

SEQ ID NO: 94 - protein, 795 aa, Arabidopsis thaliana
MEESETKGRISQETDKACVSVERIGSTLLSSFVKKGKEVSNKRNSKQNKRKAEEELCSKSRTKKYSRGWVRCEEMEEEKVKKTRKRKSKRQQKDNKVEVDDSLRLQRRTRYLLIKMKMQQNLIDAYATEGWKGQSREKIRPDKELERARKEILNCKLGLRDAIRQLDLLSSVGSMEEKVIASDGSIHHDHIFCAECNSREAFPDNDIILCDGTCNRAFHQKCLDPPLETESIPPGDQGWFCKFCDCKIEIIDTMNAQIGTHFPVDSNWQDIFNEEASLPIGSEATVNNEADWPSDDSKDDDYDPEMRENGGGNSSNVSGDGGGDNDEESISTSLSLSSDGVALSTGSWEGHRLSNMVEQCETSNEETVCGPRQRRTVDYTQLYYEMFGKDAVLQEQGSEDEDWGPNDRRKRKRESDAGSTLVTMCESSKKDQDVVETLEQSERDSVSVENKGGRRRMFRLPRNAVELRQVFAETELPSKAVRDRLAKELSLDPEKVNKWFKNTRYMALRNRKTESVKQPGDSKTVSGGDSGPEAVMENNTETNEVQDTLDDTVPPGFDATNQNILSPCNNNQEEFQQENVSFPSPTDESQQYLEQNDSSFVLVPHEKQSSEISLKTAVEENETESKMMKEPHEELSSEMSLKTAAEEKETESKMIEEPHEELSREMSLKTAVEEKETESKMMEEPHDELNSEMSLSTAVEEKETGSKMTEESHEELSNEMSLEEKETGRKMTEEEELEAVMEMLCRTENKLLDVTQRLDRFKTPKGRKKLGNSSSPLLEEDSVVYVPIAEIKEKR

SEQ ID NO: 95 - DNA, 2061 bp, Arabidopsis thaliana
atgaatggacaaggtgatttggatgcggttggaaacattccaaaaccaggtgaagctgaaggcgatgagattgatatgattaatgatatgtctggtgttaatgatcaagatggtggaaggatgagaagaacccataggcgcactgcttatcaaactcaagaacttgaaaatttctacatggaaaatcctcatcccactgaagaacagaggtacgagcttggacaaaggcttaatatgggtgtcaatcaagtcaagaattggttccagaataaaagaaatctcgagaagatcaataatgaccaccttgagaatgtaactcttagagaagagcatgacagattgctagcaactcaggatcagcttagaagcgcaatgctacgtagtttatgcaacatttgtggtaaggcaactaattgtggagacactgaatatgaggtgcaaaaacttatggctgagaatgctaacttggagcgggagatagaccagttcaattccagatacctttctcatcccaaacaaaggatggtcagtacatccgaacaggcgccttcttcttcctctaatccaggaataaatgcaacaccagtacttgattttagtggtggaactaggacgtctgagaaggagacatcaatttttctgaatcttgccattacggctttgagagagttgattacattgggagaagtggactgtccattttggatgatagatccaatcgttagatccaaaggagtatcaaagatctatgagaagtatagaagttctttcaacaatgtcacaaaacctcccgggcaaattgtggaggcttcaagagctaaaggtttagttcccatgacttgcgtgactctggtcaagactcttatggacacaggcaaatgggtcaacgtgtttgcacctatagtccctgtggcatcaacccataaagtgatatctaccggttctggtggcaccaaaagtggctcactccaacagattcaagcagaatttcaagtaatttctccgctggtaccaaagagaaaagtaacgtttattagatactgcaaagagatcagacagggcttatgggtggtcgtcgacgttactcctactcaaaatccgactttgctgccctatggttgttctaagaggctaccctcaggccttatcatagacgacctgtccaatgggtactcccaggttacatggattgaacaagcggaatataatgagagtcacatccaccaactctaccagcctttgattggctatgggatcgggctaggtgcaaagagatggctcgcgacgctgcagagacactgcgaaagcctctcgaccctttcatctaccaacttgactgaaattagtccaggattgtctgcaaaaggtgcaactgaaatagtgaagctagcacagcgaatgactctcaactactacagaggtattacgagtccttcggtggacaagtggcagaaaattcaggtggagaatgtggcacaaaacatgagtttcatgatccgaaagaacgtgaatgagcctggtgagctaactgggattgtgctgagtgcatccacttctgtttggctcccagtgaaccagcatacactctttgctttcattagccacctgagtttcagacacgagtgggatatcttgaccaatgatactaccatggaagaaacaatccggattcaaaaagcaaaacgccatggaaacatcatctctcttctgaaaatcgttaataatggtatgctggttctgcaagagatttggaatgatgcatcaggtgcaatggtggtgtatgcaccagtggaaaccaattctattgagctggtcaagagaggtgaaaattcagattctgtgaagtttcttccttcgggattttcgatagtgccagatggagtaaatgggtcatatcatagaggcaatactggtggaggatgtctactgacatttggacttcagatcttggtgggcatcaatccaactgctgcactcattcaaggtactgtcaaaagtgtcgagacactcatggctcatactattgtcaagatcaaatccgcgttagatttacagacgtaa

SEQ ID NO: 96 - protein, 686 aa, Arabidopsis thaliana
MNGQGDLDAVGNIPKPGEAEGDEIDMINDMSGVNDQDGGRMRRTHRRTAYQTQELENFYMENPHPTEEQRYELGQRLNMGVNQVKNWFQNKRNLEKINNDHLENVTLREEHDRLLATQDQLRSAMLRSLCNICGKATNCGDTEYEVQKLMAENANLEREIDQFNSRYLSHPKQRMVSTSEQAPSSSSNPGINATPVLDFSGGTRTSEKETSIFLNLAITALRELITLGEVDCPFWMIDPIVRSKGVSKIYEKYRSSFNNVTKPPGQIVEASRAKGLVPMTCVTLVKTLMDTGKWVNVFAPIVPVASTHKVISTGSGGTKSGSLQQIQAEFQVISPLVPKRKVTFIRYCKEIRQGLWVVVDVTPTQNPTLLPYGCSKRLPSGLIIDDLSNGYSQVTWIEQAEYNESHIHQLYQPLIGYGIGLGAKRWLATLQRHCESLSTLSSTNLTEISPGLSAKGATEIVKLAQRMTLNYYRGITSPSVDKWQKIQVENVAQNMSFMIRKNVNEPGELTGIVLSASTSVWLPVNQHTLFAFISHLSFRHEWDILTNDTTMEETIRIQKAKRHGNIISLLKIVNNGMLVLQEIWNDASGAMVVYAPVETNSIELVKRGENSDSVKFLPSGFSIVPDGVNGSYHRGNTGGGCLLTFGLQILVGINPTAALIQGTVKSVETLMAHTIVKIKSALDLQT

SEQ ID NO: 97 - DNA, 2821 bp, Arabidopsis thaliana
cggggtacccaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtgattcgattgacagaaaaagactaatttaaatttacgttagagaactcaaatttttggttgttgtttaggtgtctctgttttgttttttaaaattattttgatcaaa

SEQ ID NO: 98 - protein, 842 aa, Arabidopsis thaliana
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 99 - DNA, 2779 bp, Arabidopsis thaliana
gcctagttagtgttgagtgtgggagagacaaaacagaacattgaaaaatctctctgtatgatggcttcattgtcttgtgttgaagacaagatgaaaacaagttgtttggttaatggtggaggaactataacaacaacaacatctcaatctaccttgcttgaagagatgaagctgttgaaagaccagtcaggtacaagaaagccggtaataaactcggagctatggcacgcttgtgcaggccctttggtgtgtctccctcaagttgggagcttagtgtattacttctcacaaggtcatagcgagcaggttgctgtttcaaccagaagatcagcaacaacacaagttcctaattatccgaaccttccatctcagttgatgtgtcaagtccataatgttactcttcatgctgacaaagacagtgacgaaatctatgctcagatgagtcttcaacctgttcactctgagagagatgtgttccctgtaccagactttggaatgctgagaggaagtaagcacccgactgagtttttctgcaaaacacttactgcaagtgacacaagcacacatggaggtttctcagtgccacgtagagctgcagagaagctatttccaccattggactactcagcacagccgccaacgcaagagcttgtagttcgagatcttcatgagaatacttggacatttcgccatatctaccgagggcaaccaaagagacatctcctaactacaggatggagtttgttcgttggatcgaagagattgagagctggggattctgttttgttcatcagggatgagaagtcacaacttatggtcggtgttaggcgtgccaatcgccaacaaacagcacttccttcatcagttctctcagcggatagtatgcacatcggtgttcttgctgctgctgctcacgcaaccgccaaccgtactccttttttgatattctataatccaagagcttgtccagcagagttcgtgatccctctagctaagtaccgtaaggcgatatgcgggtctcagctctcagttggtatgagatttggaatgatgtttgaaactgaagattccgggaaacgaaggtacatgggaactattgttggaatcagcgatttggatccgttgagatggcctggttctaagtggcgtaaccttcaggtagaatgggatgagcctggatgtaatgataaacctactcgggtcagtccatgggatatcgaaacacctgaaagtctcttcatttttccttctctgacctcaggactcaaacgtcagctccatccatcttactttgctggtgaaactgaatggggtagcttgataaaacggccacttatacgtgttcctgattccgcgaatgggattatgccatatgcatctttccctagtatggcttcggagcagcttatgaaaatgatgatgaggcctcacaacaaccaaaatgtaccatctttcatgtctgagatgcagcagaatattgtaatggggaatggaggtttgctaggagatatgaagatgcagcaacccctgatgatgaaccagaaatctgagatggtgcagccacaaaacaagctaacagtgaacccatctgcttctaatacgagtggccaagaacagaatctttcacagagtatgagtgctcctgctaaacctgagaactctacactctctggttgcagctctggtagagtccaacatggacttgagcagtcaatggaacaggcaagccaggttactacatccacagtgtgtaatgaggaaaaggttaatcagctacttcagaaaccgggtgcttcgtcgcctgtacaagctgatcaatgtcttgacattactcatcagatttaccaaccacagtctgatccaataaatggattctctttcctggaaactgatgagctgacatcacaagtctcttccttccagtctcttgccggatcatacaagcaaccattcattctatcctcccaggattcttcagctgttgtgttaccggattccacaaactcaccgctgtttcatgatgtgtgggacactcagttgaacggtctcaagtttgaccagttcagtcccttgatgcagcaggacctttatgctagtcagaatatctgtatgagtaatagcacaaccagtaacattctagatcctccactctcaaacacagtccttgatgacttctgtgccatcaaagacactgatttccagaaccacccttctggttgtttggttggaaacaacaacactagctttgctcaagatgtccagtcgcagatcacatcagctagctttgcagactcacaggccttctctcgccaagattttccagataattctggaggcactggtacatcttcaagcaatgttgattttgatgattgtagtctgcggcaaaatagtaaaggctcatcatggcagaaaattgcgacaccccgcgtccgaacctacactaaggttcaaaaaaccgggtcagtcgggagatcaattgatgtcacaagctttaaagactacgaggagctaaaatctgctatcgaatgcatgtttggattggaaggactactaactcacccacaaagctcgggttggaagcttgtatatgttgattatgagagtgatgttctgcttgtaggagatgatccatgggaagagtttgtgggatgcgtaaggtgcataaggatattgtcgccaactgaggtccagcagatgagtgaagaagggatgaagcttttgaacagcgcaggcattaacgatcttaagacttctgtttcataaatgtaacaatata

SEQ ID NO: 100 - protein, 902 aa, Arabidopsis thaliana
MMASLSCVEDKMKTSCLVNGGGTITTTTSQSTLLEEMKLLKDQSGTRKPVINSELWHACAGPLVCLPQVGSLVYYFSQGHSEQVAVSTRRSATTQVPNYPNLPSQLMCQVHNVTLHADKDSDEIYAQMSLQPVHSERDVFPVPDFGMLRGSKHPTEFFCKTLTASDTSTHGGFSVPRRAAEKLFPPLDYSAQPPTQELVVRDLHENTWTFRHIYRGQPKRHLLTTGWSLFVGSKRLRAGDSVLFIRDEKSQLMVGVRRANRQQTALPSSVLSADSMHIGVLAAAAHATANRTPFLIFYNPRACPAEFVIPLAKYRKAICGSQLSVGMRFGMMFETEDSGKRRYMGTIVGISDLDPLRWPGSKWRNLQVEWDEPGCNDKPTRVSPWDIETPESLFIFPSLTSGLKRQLHPSYFAGETEWGSLIKRPLIRVPDSANGIMPYASFPSMASEQLMKMMMRPHNNQNVPSFMSEMQQNIVMGNGGLLGDMKMQQPLMMNQKSEMVQPQNKLTVNPSASNTSGQEQNLSQSMSAPAKPENSTLSGCSSGRVQHGLEQSMEQASQVTTSTVCNEEKVNQLLQKPGASSPVQADQCLDITHQIYQPQSDPINGFSFLETDELTSQVSSFQSLAGSYKQPFILSSQDSSAVVLPDSTNSPLFHDVWDTQLNGLKFDQFSPLMQQDLYASQNICMSNSTTSNILDPPLSNTVLDDFCAIKDTDFQNHPSGCLVGNNNTSFAQDVQSQITSASFADSQAFSRQDFPDNSGGTGTSSSNVDFDDCSLRQNSKGSSWQKIATPRVRTYTKVQKTGSVGRSIDVTSFKDYEELKSAIECMFGLEGLLTHPQSSGWKLVYVDYESDVLLVGDDPWEEFVGCVRCIRILSPTEVQQMSEEGMKLLNSAGINDLKTSVS

SEQ ID NO: 101 - DNA, 733 bp, Arabidopsis thaliana
ttactcatttgtcttaacctaaaattattataaaaaggatagagagagagagagagagctagagatatgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgggctgaagaagaagacatgtgcaatgagaagagtcacgtgctaacgtacgcagataaggaaggtgactggatgatggttggagatgttccttgggagatgttcttgtctactgtgagaagactgaagatttcaagagctaattaccactactgatatataagtctacgtacttgttgtgtttaaatcgaagtaatgccaagaaaaaagtttttgcctgatgtaaatcaatggtcggatatttataatattattttcatttttctttaaaaaaaaaaaaaaaaaaaaaaaaaaa

SEQ ID NO: 102 - protein, 175 aa, Arabidopsis thaliana
MGRGRSSSSSSIESSSKSNPFGASSSTRNLSTDLRLGLSFGTSSGTQYFNGGYGYSVAAPAVEDAEYVAAVEEEEENECNSVGSFYVKVNMEGVPIGRKIDLMSLNGYRDLIRTLDFMFNASILWAEEEDMCNEKSHVLTYADKEGDWMMVGDVPWEMFLSTVRRLKISRANYHY

SEQ ID NO: 103 - DNA, 1002 bp, Arabidopsis thaliana
atgttggactacgaatgggataatccttcctccatcgttctctccggagatgaaagaaacccggactctgacccgacccggtcatccttctcctttttcgaccccatctcccattacaacaacgaccaccgtcacatcaccatttctcctcccctcctctcttccttctctaaccaacaacaacagcatcacctcaccctctacggtcagaccaacagcaacaaccagtttcttcatcatcaccatcaccaccactccttgtacgggtccaccaccaccaccactccttacggcgcctccgatcccatctaccatccccactcttccgctccgccagcctccttgttctcctacgaccagacaggaccgggctcgggatccggatcttcctacaacttcctcatccccaagacagaagtggatttcacgtccaacaggatcgggctgaacctgggaggccgtacgtacttctcagcggcggacgacgacttcgtgagcaggctatacaggaggtctcgaccaggtgagtcagggatggcgaactcgctgagcacgccgcggtgccaagcagagggatgcaacgcggatctgagccacgcgaaacactaccacagaaggcacaaagtgtgcgaattccactcaaaagcatcgacggttgtagccgccggactaagccaaaggttttgccagcaatgcagcaggttccatttgctgtcggaattcgacaacgggaaacggagctgccgtaagcgacttgctgaccataaccgccgccgccgtaaatgtcaccaatcagcctccgccacccaagacaccggcaccggcaagactactccaaagtcaccgaacgattcgggtgttaaagcgtcatcgtcaccgtcgtccaacgcgccgcctacgatatcactggagtgcttccggcaaaggcagttccaaacgacagcgtcttcatccacgtcagcgtcttcgtcttcaaattcaatgtttttctccagcggatag

SEQ ID NO: 104 - protein, 333 aa, Arabidopsis thaliana
MLDYEWDNPSSIVLSGDERNPDSDPTRSSFSFFDPISHYNNDHRHITISPPLLSSFSNQQQQHHLTLYGQTNSNNQFLHHHHHHHSLYGSTTTTTPYGASDPIYHPHSSAPPASLFSYDQTGPGSGSGSSYNFLIPKTEVDFTSNRIGLNLGGRTYFSAADDDFVSRLYRRSRPGESGMANSLSTPRCQAEGCNADLSHAKHYHRRHKVCEFHSKASTVVAAGLSQRFCQQCSRFHLLSEFDNGKRSCRKRLADHNRRRRKCHQSASATQDTGTGKTTPKSPNDSGVKASSSPSSNAPPTISLECFRQRQFQTTASSSTSASSSSNSMFFSSG

SEQ ID NO: 105 - DNA, 486 bp, Arabidopsis thaliana
atggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaa

SEQ ID NO: 106 - protein, 161 aa, Arabidopsis thaliana
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 107 - DNA, 1071 bp, Arabidopsis thaliana
atggggaaaactaacttggcacctggttttcggtttcatccgactgatgttgaacttgtgagatactacttgaagaggaaagttatgggaaaaaagttccaagttgatgccattgctgaggtcgacatttacaagttcgaacctcctgatttacccgacaaatcatgtctagggactggagatcttaagtggtacttcttctgtccaagagaaaagaagtatcccaaaggcggtaaggcaaaccgctctactgaatgtggttactggaagaccacagggagagacagagatgtttcttataatgacgaagtcactgggaagataagaactctgatttatcactacgggaaaatacctcgcggtgatcggactgattgggtcatacatgaatatagacttgaagacaaagtactggctcaaaagaatgttcctcaggatacttatgtgctttgcgttctctttaagaaaaatggacttggaccaagacatggatctcaatatggtgctccatttaaggaagaggattggagtgataaggaagaagaatatactcagaatcatcttgtagctggtcctagtaaagaaaccagtctagctgctaaggcctcacactcgtacgctcctaaggatggtttgacaggagtgatctcagaatcttgcgtctctgatgtgccgccactaactgccacagtgcttccacctctaacaagtgatgttatagcttacaatcccttttcttcttcacctcttcttgaggttcctcaagtatctctcgatggtggcgagttaaattcgatgcttgatctcttttctgttgacaatgacgactgtttacttttcgacgatttcgactaccataatgaggtaagacatcctgatggttttgtaaacaaggaagctccggtgttcttaggagatggcaatttcagtggaatgtttgacctgagcaatgaccaagtcgtagagctacaggatctgatacagtcacccactcctcatcctccttctcctccagctcaagctagtattcctgatgactcaagaagcaacggtcagactaaggacgattaa

SEQ ID NO: 108 - protein, 356 aa, Arabidopsis thaliana
MGKTNLAPGFRFHPTDVELVRYYLKRKVMGKKFQVDAIAEVDIYKFEPPDLPDKSCLGTGDLKWYFFCPREKKYPKGGKANRSTECGYWKTTGRDRDVSYNDEVTGKIRTLIYHYGKIPRGDRTDWVIHEYRLEDKVLAQKNVPQDTYVLCVLFKKNGLGPRHGSQYGAPFKEEDWSDKEEEYTQNHLVAGPSKETSLAAKASHSYAPKDGLTGVISESCVSDVPPLTATVLPPLTSDVIAYNPFSSSPLLEVPQVSLDGGELNSMLDLFSVDNDDCLLFDDFDYHNEVRHPDGFVNKEAPVFLGDGNFSGMFDLSNDQVVELQDLIQSPTPHPPSPPAQASIPDDSRSNGQTKDD

SEQ ID NO: 109 - DNA, 1275 bp, Arabidopsis thaliana
atggatcctgaaggtttcacgagtggcttattccggtggaacccaacgagagcattggttcaagcaccacctccggttccacctccgctgcagcaacagccggtgacaccgcagacggctgcttttgggatgcgacttggtggtttagagggactattcggtccgtacggtatacgtttctacacggcggcgaagatagcggagttaggttttacggcgagcacgcttgtgggtatgaaggacgaggagcttgaagagatgatgaatagtctctctcatatctttcgttgggagcttcttgttggtgaacggtacggtatcaaagctgccgttagagctgaacggagacgattgcaagaagaggaggaagaggaatcttctagacgccgtcatttgctactctccgccgctggtgattccggtactcatcacgctcttgatgctctctcccaagaagatgattggacagggttatctgaggaaccggtgcagcaacaagaccagactgatgcggcggggaataacggcggaggaggaagtggttactgggacgcaggtcaaggaaagatgaagaagcaacagcagcagagacggagaaagaaaccaatgctgacgtcagtggaaaccgacgaagacgtcaacgaaggtgaggatgacgacgggatggataacggcaacggaggtagtggtttggggacagagagacagagggagcatccgtttatcgtaacggagcctggggaagtggcacgtggcaaaaagaacggcttagattatctgttccacttgtacgaacaatgccgtgagttccttcttcaggtccagacaattgctaaagaccgtggcgaaaaatgccccaccaaggtgacgaaccaagtattcaggtacgcgaagaaatcaggagcgagttacataaacaagcctaaaatgcgacactacgttcactgttacgctctccactgcctagacgaagaagcttcaaatgctctcagaagagcgtttaaagaacgcggtgagaacgttggctcatggcgtcaggcttgttacaagccacttgtgaacatcgcttgtcgtcatggctgggatatagacgccgtctttaacgctcatcctcgtctctctatttggtatgttccaacaaagctgcgtcagctttgccatttggagcggaacaatgcggttgctgcggctgcggctttagttggcggtattagctgtaccggatcgtcgacgtctggacgtggtggatgcggcggcgacgacttgcgtttctag

SEQ ID NO: 110 - protein, 424 aa, Arabidopsis thaliana
MDPEGFTSGLFRWNPTRALVQAPPPVPPPLQQQPVTPQTAAFGMRLGGLEGLFGPYGIRFYTAAKIAELGFTASTLVGMKDEELEEMMNSLSHIFRWELLVGERYGIKAAVRAERRRLQEEEEEESSRRRHLLLSAAGDSGTHHALDALSQEDDWTGLSEEPVQQQDQTDAAGNNGGGGSGYWDAGQGKMKKQQQQRRRKKPMLTSVETDEDVNEGEDDDGMDNGNGGSGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAAAALVGGISCTGSSTSGRGGCGGDDLRF

SEQ ID NO: 111 - DNA, 1374 bp, Arabidopsis thaliana
atggctgatccggcgattaagctctttggaaagacgattcctttacctgagcttggtgttgttgattcttcttctagctataccggatttttaaccgaaactcagattcctgttcggttatcagattcgtgtaccggcgatgatgatgatgaagagatgggtgattccggtttaggacgagaagaaggtgatgatgttggtgatggtggaggagagagcgagactgataaaaaggaagaaaaagatagtgagtgtcaggaagagtcattgaggaatgaatctaatgatgttactactactacatcgggtataactgaaaaaacggaaacaacaaaagctgcaaagacgaatgaagagtcaggtggtactgcttgctctcaagaggggaagttaaagaaacctgataagattctaccgtgtccgcgatgtaacagcatggaaaccaagttctgttactacaacaactataatgttaaccaacctcgccatttctgcaagaaatgtcagagatattggacagctggtggaacgatgaggaatgttccggttggtgctgggagacgtaagaataagagtccagcttctcattataaccgtcatgtaagtataacatctgcggaagctatgcagaaggtggcgagaactgatcttcaacatcctaatggtgcaaatcttctcacttttggctctgattctgtgctttgtgaatctatggcttctggattgaatcttgttgagaagtcattgttgaagacacaaactgtattgcaagaacccaatgaaggcttgaagattacggttccgttaaaccagacaaacgaagaagctggaacagtcagcccgttaccaaaagttccatgctttccaggaccaccaccaacttggccttacgcttggaacggagtttcgtggacgattttaccgttttaccctccaccggcttactggagctgcccgggggtttcaccgggggcatggaacagcttcacatggatgccacaacccaattcaccatctggttccaatccaaattctcctacactaggtaaacattcacgtgacgagaacgctgctgaaccaggaaccgcttttgatgaaaccgagtcacttggtagggagaaaagcaaacccgagagatgcttgtgggttcccaagacgctgaggattgatgatccagaggaagctgctaaaagttccatctgggaaacattagggatcaaaaaagacgaaaatgcggatactttcggagctttcagatcatcaaccaaagaaaaaagcagtctttctgaaggaagacttccgggaagaagaccggagttgcaagcgaatcctgctgctctttctaggtcagcaaacttccatgagagctcatag

SEQ ID NO: 112 - protein, 457 aa, Arabidopsis thaliana
MADPAIKLFGKTIPLPELGVVDSSSSYTGFLTETQIPVRLSDSCTGDDDDEEMGDSGLGREEGDDVGDGGGESETDKKEEKDSECQEESLRNESNDVTTTTSGITEKTETTKAAKTNEESGGTACSQEGKLKKPDKILPCPRCNSMETKFCYYNNYNVNQPRHFCKKCQRYWTAGGTMRNVPVGAGRRKNKSPASHYNRHVSITSAEAMQKVARTDLQHPNGANLLTFGSDSVLCESMASGLNLVEKSLLKTQTVLQEPNEGLKITVPLNQTNEEAGTVSPLPKVPCFPGPPPTWPYAWNGVSWTILPFYPPPAYWSCPGVSPGAWNSFTWMPQPNSPSGSNPNSPTLGKHSRDENAAEPGTAFDETESLGREKSKPERCLWVPKTLRIDDPEEAAKSSIWETLGIKKDENADTFGAFRSSTKEKSSLSEGRLPGRRPELQANPAALSRSANFHESS

SEQ ID NO: 113 - DNA, 1888 bp, Arabidopsis thaliana
tagccgacctctcttctctcttctgaaaaaaacaccaaaggagctttaaatgctccgttacataatctctatctctttccaagaatatagagaaaggaaaataatatacaagaattaaaagaaggtatatcatcatctctctagctagtgatcaaagcaccgtcatcatcatcatatatcatcagcttgcctcagaggagaagaccaacataagagagatcgaagatcaaaatctatctctcttcatcatcttctgctgttactatcatatcacacgctctctcaaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaaccaaaaacaaaaacaagagaataggttgattagttagccgccagcttgacctctttatcatatatatcgtctctctactcaaatacagtgcaattagggaaaattgtttggcttctttttggtatatgattcttactattatgtttttaatcaaga

SEQ ID NO: 114 - protein, 460 aa, Arabidopsis thaliana
MQGHHQNHHQHLSSSSATSSHGNFMNKDGYDIGEIDPSLFLYLDGQGHHDPPSTAPSPLHHHHTTQNLAMRPPTSTLNIFPSQPMHIEPPPSSTHNTDNTRLVPAAQPSGSTRPASDPSMDLTNHSQFHQPPQGSKSIKKEGNRKGLASSDHDIPKSSDPKTLRRLAQNREAARKSRLRKKAYVQQLESCRIKLTQLEQEIQRARSQGVFFGGSLIGGDQQQGGLPIGPGNISSEAAVFDMEYARWLEEQQRLLNELRVATQEHLSENELRMFVDTCLAHYDHLINLKAMVAKTDVFHLISGAWKTPAERCFLWMGGFRPSEIIKVIVNQIEPLTEQQIVGICGLQQSTQEAEEALSQGLEALNQSLSDSIVSDSLPPASAPLPPHLSNFMSHMSLALNKLSALEGFVLQADNLRHQTIHRLNQLLTTRQEARCLLAVAEYFHRLQALSSLWLARPRQDG

SEQ ID NO: 115 - DNA, 1921 bp, Arabidopsis thaliana
ccaagatcatgacccaagtcaaccactctctctcataattcagacacagtactcaactttaaagacactcttttaagactttccatcaggaccaagctgagaaagagaaagcaataaagaaagaaagaaaaggaaataaagcttcaataccaaacccttctttaataaattttgccttttggttgtctcctctttatcaatcactttggttccatacttttaaattcagttcttcacgatatctagatatgtctttgacaatggctgatggtgtagaagctgcagcaggaagaagtaaaagacaaaacagcttattaagaaaacaacttgctttagctgtaagaagtgttcaatggagctacgcaatcttctggtcgtcttcacttactcaacctggggttttggagtggggagaaggatgttacaatggagatatgaagaagaggaagaagagttatgaatctcattataaatatgggttgcaaaaaagcaaggagcttcggaaactttatttgtctatgcttgaaggagacagtggtactactgttagtactactcatgataatctcaatgatgatgatgataattgtcacagtacaagtatgatgctgtcaccagatgacctctctgatgaagagtggtactatttagtctccatgtcctatgtcttctctccttcacaatgtttgcctggaagagcttcagcgacgggtgagaccatatggctctgcaacgctcaatatgcggagaacaagctcttctctcgttctttgttagcaagaagcgcatcaattcagactgttgtgtgtttcccttacttgggcggagtcattgagctgggcgtcactgaattgatttcagaagaccataacctgcttcgaaacatcaaatcttgcttgatggaaatatctgcacaccaagacaacgatgacgagaagaagatggagattaagatcagtgaagagaagcatcagcttccattaggtatttctgatgaagacttgcattacaaaagaaccatttcaacagtactcaactactccgcagatagatcaggtaagaacgataagaacattcgtcatcgtcagccaaatattgttacttctgaacctggctcaagtttcttgcggtggaagcaatgtgagcagcaagtctcgggttttgttcagaaaaaaaagtcacagaatgtgttgcggaagatattgcatgatgtccctttgatgcacacaaagagaatgttcccaagtcagaactctggtctgaatcaagatgatccttcagatagaagaaaagagaacgaaaagttcagtgtccttagaactatggttcccactgtcaacgaggttgataaagaatcgatactaaacaacacaatcaagtacctgcaagaactggaggcaagagtagaagagctagaatcttgtatgggatcagttaattttgtagaaagacaaagaaagacgacagagaaccttaacgactctgtgttgatcgaagagacatcagggaactacgatgatagcacgaagatcgatgacaattcaggagaaaccgaacaagtcactgttttcagagataagacacatttgagagttaaactcaaagaaacagaagttgtgatcgaagtaagatgttcttacagagactacatagttgcggacatcatggaaactctgagcaatcttcacatggatgctttctctgttagatctcacacgctcaataagttcctcacattgaatctcaaggccaagtttcgcggggctgcagttgcgtccgtaggaatgattaagcgagagctgagaagagtcattggtgatttgttttaatgttcttcttagtaaaaattcttatattttcttaaacttttgatgaaatgttatatttatctagactttcgtgaaccgatatgcgatgtgcc

SEQ ID NO: 116 - protein, 526 aa, Arabidopsis thaliana
MSLTMADGVEAAAGRSKRQNSLLRKQLALAVRSVQWSYAIFWSSSLTQPGVLEWGEGCYNGDMKKRKKSYESHYKYGLQKSKELRKLYLSMLEGDSGTTVSTTHDNLNDDDDNCHSTSMMLSPDDLSDEEWYYLVSMSYVFSPSQCLPGRASATGETIWLCNAQYAENKLFSRSLLARSASIQTVVCFPYLGGVIELGVTELISEDHNLLRNIKSCLMEISAHQDNDDEKKMEIKISEEKHQLPLGISDEDLHYKRTISTVLNYSADRSGKNDKNIRHRQPNIVTSEPGSSFLRWKQCEQQVSGFVQKKKSQNVLRKILHDVPLMHTKRMFPSQNSGLNQDDPSDRRKENEKFSVLRTMVPTVNEVDKESILNNTIKYLQELEARVEELESCMGSVNFVERQRKTTENLNDSVLIEETSGNYDDSTKIDDNSGETEQVTVFRDKTHLRVKLKETEVVIEVRCSYRDYIVADIMETLSNLHMDAFSVRSHTLNKFLTLNLKAKFRGAAVASVGMIKRELRRVIGDLF

SEQ ID NO: 117 - DNA, 1380 bp, Arabidopsis thaliana
atggagtctgtacggtgtccacctcccaaggctctatctcctactacatctgctgcatctggaggcgaaaagaaaccagctcctagtaacaacaatgagacttcaactctaaagccgtcaatagaaatagcagagatcacaagtgcttgggcgtctgcagaaatagttaaagtggaaaagccagttgatgcatctgcaaacattcaaggatcctcaaatggcaaggaagcagcagtttcacaactgaatacgcagccccccaaggaagaaatgccgcagcaggttgcttctggggagcaagcaggaaaaaggaagaagaagaaacctcggatgagtggaaccgatctagcaggccctgactatatgatgcccatgggcccaggtcccggtaatcagtacttcaatggtttccaacccggcttcaacggcgttcaacatgggttcaatggcgttcaacctgggttcaatggctttcatcatggtttcaatgggtttccaggcccttttcctggtgcgatgcctccttttgttggctatggatttggcggtgtgatccatccagatcctttcgctgcacagggctttgggttccctaatataccaccaccttatagggaccttgcggagatggggaatcgtatgaatctccagcatcctataatggggagagaagaatttgaagctaagaaaactgagatgaaaagaaagcgtgaaaacgagattcgacgatcggaaggagggaatgtcgtcagggacagtgaaaagagcagaataatgaacaactcggcagtcacttcctcacccgtgaagccaaaatctagacaaggacctccgccgccgatttcgtctgattacgaccgtcgcaggcgatcggatagatcgtcaccggagcgtcagtcatctcgaaggttcacctctcctcctcgatcatccagcaggaaatctgagcgtgatcgtcaccatgacctcgattccgaacacgaccgccgccgtgaccgtcccagagagacagatcgcaagcaccgtaagagatccgaaaagtcatcatcggatccaactgtagagatagacgataacaataagtctaacgtgttcactcggataagctttccagaggaatcttctggcaaacaacgaaagacatcaaagtcttctccagcgcctccagagagctcagtcgccccagtttcatcgggtcgtcgtcatcacagtcgaagagaaagagagatggtggaatacgattcaagtgatgatgaagacagacatttcaagaggaagccatcaaggtacaagcgatctccttcggttgcaccttctgacgccggtgatgagcatttccgtcattctaagcgatctaaaggagaaagagcgcgagcttga

SEQ ID NO: 118 - protein, 459 aa, Arabidopsis thaliana
MESVRCPPPKALSPTTSAASGGEKKPAPSNNNETSTLKPSIEIAEITSAWASAEIVKVEKPVDASANIQGSSNGKEAAVSQLNTQPPKEEMPQQVASGEQAGKRKKKKPRMSGTDLAGPDYMMPMGPGPGNQYFNGFQPGFNGVQHGFNGVQPGFNGFHHGFNGFPGPFPGAMPPFVGYGFGGVIHPDPFAAQGFGFPNIPPPYRDLAEMGNRMNLQHPIMGREEFEAKKTEMKRKRENEIRRSEGGNVVRDSEKSRIMNNSAVTSSPVKPKSRQGPPPPISSDYDRRRRSDRSSPERQSSRRFTSPPRSSSRKSERDRHHDLDSEHDRRRDRPRETDRKHRKRSEKSSSDPTVEIDDNNKSNVFTRISFPEESSGKQRKTSKSSPAPPESSVAPVSSGRRHHSRREREMVEYDSSDDEDRHFKRKPSRYKRSPSVAPSDAGDEHFRHSKRSKGERARA

SEQ ID NO: 119 - DNA, 2291 bp, Arabidopsis thaliana
ccactatttctcctttctcagctgctttcaccattttctctttttctcctccatcaatctttctcacggttttctagggttttatatatgctttcctcttcatccatgtcatcgtcttcgttatctgctagattttgcttcaaccacgaatgttttgagttcaaactcgaccattgccgtcctggttggcgtctccgttctggcgatttcgtcgacctctgtgatcgttgcgcctctgcgtatgaacaaggaaagttttgtgacgtatttcaccaaagggcttctggatggaggtgttgtgagtcatgtggaaagcgaattcattgtggatgtattgcgtctgcttctgcttatacgttaatggatgctggaggaattgagtgtttggcttgcgcaagaaaaaagtttgctttgggacccaatttttcgccatcaccgtcctttcttttccagtctccaatttctgagaaattcaaggacttgtcgatcaactggagttcttcaactagatcaaatcagataagctaccagcctcctagttgtttagatccttcagttctgcagtttgattttcgtaatcgtggaggtaataatgaatttagtcaacctgcttctaaagaaagggtcactgcatgtaccatggagaaaaaaaggggaatgaatgacatgatagggaaattaatgagtgaaaactcgaaacattatagagtatctccttttccaaatgtcaatgtatatcacccactgatctcactaaaggagggtccatgtgggacacagcttgcgtttcctgtgccaattacaacaccaattgagaaaactggtcactctagactagatggaagtaatttatggcacacacgtaattcttctccgctaagtcgcttacacaatgacttgaatggtggagcagactcgccattcgaaagcaaaagtcgtaatgtgatggctcatcttgagacgccaggaaaatatcaggtggttccacgattttggcccaaggtttcatataaaaaccaagttctgcagaatcaatcaaaagaatctgaatccgttgtcactcctctctttgagaagatcctgagtgcaactgatactggaaagcggctggtcctgccaaagaaatatgcagaggctttcttgccccaactttcccacaccaaaggtgtgcctctcacagtacaggacccaatgggtaaagagtggagatttcagtttcgcttttggcccagcagcaaaggcagaatatatgttctagagggagtaactccattcatacagaccttgcagttgcaggctggtgatacagtcatattcagtcgattagatccagaaaggaagttaattttgggattcagaaaggcttcgattactcaatcgtctgatcagcaggctgatccggctgatatgcattcaccgtttgaagttaagaagtctgcttatataactaaagaaaccccaggagtagaatgttcctctggtaagaagaaaagcagcatgatgattacaagaagtaaacgtcaaaaagttgaaaagggagacgacaacttgctgaagctaacatgggaagaagctcaaggatttctcctgcctcctcccaacctcactccatctagagttgtgatagaggattacgagtttgaggagtatgaggaggctccaatcatcgggaagcctactgatgttgcaggtttcagatcaacgtgcactgaagttgaaggactgttgatatcaccaacaaccacaaagcacccacgacatagagatggctgtacttgcatcatttgcatacaatccccaagtgggataggtcctaaacacgaccgatgctgttcttgtgcagtctgcgacactaacaaacgccgtaggcgttccctgttgctacggagggaaaagaagcagatggagaaagaagacaatgcgcgcaagttgctcgagcaactgaattctgataatggacttcaccaatctgctaacaacagtgagaatcatgagcgtcatgcttcgcctttgaaagttcaattagatttgaacttcaaaccagaaaaggacgaagaatctctccctggttctaacaaaactaccaagagcgagactctgcctcatgatgacacagtaaagtctagcttcacgtcaccaagctcatcaagtgctcatagccaaaataacaaggaagatgaaggaaaactcaagacaaccacagaaattgcagacaccaccaccacaagctccatgtagattttgcagactcttatagctgcaaggtgaatagattatgatgggaaacacca

SEQ ID NO: 120 - protein, 716 aa, Arabidopsis thaliana
MLSSSSMSSSSLSARFCFNHECFEFKLDHCRPGWRLRSGDFVDLCDRCASAYEQGKFCDVFHQRASGWRCCESCGKRIHCGCIASASAYTLMDAGGIECLACARKKFALGPNFSPSPSFLFQSPISEKFKDLSINWSSSTRSNQISYQPPSCLDPSVLQFDFRNRGGNNEFSQPASKERVTACTMEKKRGMNDMIGKLMSENSKHYRVSPFPNVNVYHPLISLKEGPCGTQLAFPVPITTPIEKTGHSRLDGSNLWHTRNSSPLSRLHNDLNGGADSPFESKSRNVMAHLETPGKYQVVPRFWPKVSYKNQVLQNQSKESESVVTPLFEKILSATDTGKRLVLPKKYAEAFLPQLSHTKGVPLTVQDPMGKEWRFQFRFWPSSKGRIYVLEGVTPFIQTLQLQAGDTVIFSRLDPERKLILGFRKASITQSSDQQADPADMHSPFEVKKSAYITKETPGVECSSGKKKSSMMITRSKRQKVEKGDDNLLKLTWEEAQGFLLPPPNLTPSRVVIEDYEFEEYEEAPIIGKPTDVAGFRSTCTEVEGLLISPTTTKHPRHRDGCTCIICIQSPSGIGPKHDRCCSCAVCDTNKRRRRSLLLRREKKQMEKEDNARKLLEQLNSDNGLHQSANNSENHERHASPLKVQLDLNFKPEKDEESLPGSNKTTKSETLPHDDTVKSSFTSPSSSSAHSQNNKEDEGKLKTTTEIADTTTTSSM

SEQ ID NO: 121 - DNA, 699 bp, Arabidopsis thaliana
atggtgaggggcaaaacggagatgaagaggatagagaacgcaacaagcaggcaagtgacgttttcgaagagaagaaatggactcttgaagaaagccttcgaattatcggtcctttgtgatgctgaagttgctttggttatcttctctccaagatccaaactctatgagttctctagctctagtatagcagcaacaattgaacgctatcagagacgaataaaagaaattgggaataatcataagagaaatgataattctcagcaagcgagagacgaaacatctggattgacaaaaaagattgaacagctagagatatctaaacgaaaattgcttggagaaggcattgatgcatgttccatcgaggagctgcaacagttagagaatcagttggaccgaagcttgagcaggataagagccaagaagtaccaattactccgtgaagaaattgagaagttgaaggcagaggagaggaatctcgttaaggaaaataaagatctgaaggagaagtggcttggaatgggaacagcaacaatagcatcatcacaatcaacgttatcatcatcagaagtgaacatagatgacaatatggaagtggagactggtttgttcattggacctcctgagacaagacaatccaaaaaattccctcctcaaaattaatcttacaacttcttcaaaaagaatgttttaactatatga

SEQ ID NO: 122 - protein, 219 aa, Arabidopsis thaliana
MVRGKTEMKRIENATSRQVTFSKRRNGLLKKAFELSVLCDAEVALVIFSPRSKLYEFSSSSIAATIERYQRRIKEIGNNHKRNDNSQQARDETSGLTKKIEQLEISKRKLLGEGIDACSIEELQQLENQLDRSLSRIRAKKYQLLREEIEKLKAEERNLVKENKDLKEKWLGMGTATIASSQSTLSSSEVNIDDNMEVETGLFIGPPETRQSKKFPPQN

SEQ ID NO: 123 - DNA, 1029 bp, Arabidopsis thaliana
atggatacggctcagtggccacaggagattgtagtgaagcccttggaagaaatagtaacaaacacatgcccaaagccgcaaccgcaaccgcttcaaccgcagcagccaccgtcggtgggtggagagaggaaggcaaggccagaaaaggatcaagctgtaaactgtccgagatgtaactcaaccaacacaaagttttgttactacaacaattatagtttgacgcagccaagatacttctgcaaaggttgtagaaggtattggaccgaaggcggttcgcttaggaacattcctgttggcggtggctcaagaaagaacaagagatctcactcttcttcttctgatattagtaacaatcactcggattctacacaaccagctacaaagaagcatctctctgatcatcaccaccacctcatgagcatgtctcaacaaggtttgaccggtcaaaaccctaaattccttgagacgacccaacaagatctcaatttaggtttttcaccacatgggatgattaggaccaacttcactgacctcatccacaacattggcaacaacaccaacaagagcaacaacaataacaatccattgattgtttcttcatgttctgccatggctacttcttctctggatctcataagaaacaatagtaacaatgggaattcttcaaattcttccttcatgggatttccagttcataatcaagatccagcatcaggagggttttcaatgcaagatcattacaagccttgcaacacaaacaccacactgctagggttttcattagatcatcatcataataatggatttcatggagggtttcaaggaggagaagaaggtggagaaggtggtgatgatgtgaatggaaggcacttgtttccttttgaggatttgaaattgccagtttcttcttcatcagcaacaattaatgtcgacattaatgaacatcagaagcgaggaagcggtagtgatgcagctgctacgtctggtgggtattggactgggatgttgagtggaggatcatggtgctaa

SEQ ID NO: 124 - protein, 342 aa, Arabidopsis thaliana
MDTAQWPQEIVVKPLEEIVTNTCPKPQPQPLQPQQPPSVGGERKARPEKDQAVNCPRCNSTNTKFCYYNNYSLTQPRYFCKGCRRYWTEGGSLRNIPVGGGSRKNKRSHSSSSDISNNHSDSTQPATKKHLSDHHHHLMSMSQQGLTGQNPKFLETTQQDLNLGFSPHGMIRTNFTDLIHNIGNNTNKSNNNNNPLIVSSCSAMATSSLDLIRNNSNNGNSSNSSFMGFPVHNQDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 125 - DNA, 869 bp, Arabidopsis thaliana
ttctgctctgttttggtaaattgaggaaatggaagagaggcataagtgcaagttatgttggaagagcttcgctaatggaagggctttgggaggtcacatgaggtctcacatgctcattcaccctctccccagtcagcccgagtcatattcgtcttccatggctgatccagggtttgttcttcaggacagagagagtgaaaccgagtcgtccaagaagccctcccgcaaacgatccagacttaaccggagatccatctcatcattacgtcatcaacaatccaacgaagaagggaaaagtgaaaccgcaagagcagcagatatcaagatcggggttcaagaactcagtgagtcgtgtacggagcaggaaccgatgagttcggtgtcggacgctgcaacaacggaagaagacgtggccttgagtctcatgttgctgtcgagagacaagtgggagaaggaggaagaggaaagtgatgaagagagatggaagaagaagaggaataagtggttcgagtgcgagacttgcgagaaagtgtttaagtcgtatcaggcgttagggggacacagagcaagccacaagaagaagatagcagaaacagatcaattaggctcagatgagttgaagaagaagaagaagaagagtactagtagtcaccatgaatgtccaatctgtgccaaagtcttcacatctggtcaagctctcggaggtcacaaaagatctcacgcttccgctaataatgaattcacgagaagatcaggaataataattagcttgatagatctaaatctcccagcgccatcggaggaggaagagatggcctcgtcggttttttaatgcttgatcagattggtcaaactatagtaattaccac

SEQ ID NO: 126 - protein, 267 aa, Arabidopsis thaliana
MEERHKCKLCWKSFANGRALGGHMRSHMLIHPLPSQPESYSSSMADPGFVLQDRESETESSKKPSRKRSRLNRRSISSLRHQQSNEEGKSETARAADIKIGVQELSESCTEQEPMSSVSDAATTEEDVALSLMLLSRDKWEKEEEESDEERWKKKRNKWFECETCEKVFKSYQALGGHRASHKKKIAETDQLGSDELKKKKKKSTSSHHECPICAKVFTSGQALGGHKRSHASANNEFTRRSGIIISLIDLNLPAPSEEEEMASSVF

SEQ ID NO: 127 - DNA, 606 bp, Arabidopsis thaliana
atgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttga

SEQ ID NO: 128 - protein, 201 aa, Arabidopsis thaliana
MSGGGDVNMSGGDRRKGTVKWFDTQKGFGFITPSDGGDDLFVHQSSIRSEGFRSLAAEESVEFDVEVDNSGRPKAIEVSGPDGAPVQGNSGGGGSSGGRGGFGGGGGRGGGRGGGSYGGGYGGRGSGGRGGGGGDNSCFKCGEPGHMARECSQGGGGYSGGGGGGRYGSGGGGGGGGGGLSCYSCGESGHFARDCTSGGAR

SEQ ID NO: 129 - DNA, 2562 bp, Arabidopsis thaliana
ctctcatccatggcggatttcttctatcttcattaaatatttccctctttattaaaatctcatgaatttcaacggttttctcgacgacggtgctggagcctcaaagctactctctgatgctccgtacaacaaccacttctctttctccgccgtagacaccatgctcggaagcgccgccattgctccttctcagtctcttcctttctcttcttcaggcctctctctcggactccaaacaaatggagaaatgagtagaaacggagagattatggagtcaaacgtaagtcgtaagagtagtagaggagaagatgtagaaagcagatctgaaagtgataacgctgaagctgtctccggtgacgatttagatacctccgatagacctttaaagaagaagaaacgttaccatcgtcacactcctaaacaaattcaagacctcgaatcggtttttaaagagtgtgcacatccagacgagaagcaacgtcttgatcttagccgtcgacttaacttagatcctcgtcaagtcaagttctggttccagaatcgtcgtactcagatgaagactcaaatcgaacgacatgagaatgctttgttgaggcaagagaacgataagcttcgagctgagaatatgtctgtacgcgaagctatgagaaaccctatgtgtggtaattgcggcggacctgccgttatcggtgagatctcaatggaagagcaacatctgagaattgaaaactctcgtctcaaagatgagttagaccgagtctgtgccttaaccggtaagtttcttggccggtctaatggttcacatcatataccggactcagcacttgttctcggcgttggtgttggttctggtggatgtaatgttggtggtggtttcactctctcttctccgctgttgcctcaagcttctcctagatttgagatttctaatggaaccggttctggtttggtggctacggttaaccgtcaacaaccggttagtgttagtgattttgatcagagatcgaggtatttggatttagctcttgcggctatggatgagcttgtgaagatggctcagacacgtgagccgctctgggttcgaagctcggattctggttttgaagtgctgaaccaggaagagtacgacacaagtttctctcggtgtgttggaccaaaacaagatgggtttgtctcagaagcttctaaagaagctggaactgttatcatcaatagcttagcgctcgttgaaaccttaatggactcggaacggtgggcggaaatgtttcctagtatggtctcaagaacttcaaccacagagattatctctagtggcatgggagggcgaaatggtgcacttcacctgatgcacgcagagcttcaactgctgtctccactcgtgccggttagacaagtgtcgttcttgcggttctgtaaacagcacgcggaaggtgtttgggcagtcgtggatgtctcaattgattccattagagaaggttcttcttcgagctgtagaagattaccatccggttgcctcgtacaagacatggccaatggctactcaaaggtaacatggatcgagcacacggagtatgacgaaaaccacatccaccgtttataccgcccattactcaggtgcggtctagcgtttggtgcgcatcgatggatggctgcattacaacgtcaatgcgaatgcctcacgattctcatgtcctccactgtttccacttccactaatccatcccctataaactgcaatgggagaaaaagcatgctaaagctagcgaagaggatgactgataatttctgtggaggggtttgtgcttcgtcgttacagaaatggagcaaactcaacgttggcaacgtcgacgaagacgttaggataatgactaggaagagtgtaaacaatcctggcgagccgcctgggataattctaaatgcggcgacgtcagtttggatgccggtatctccgaggcggttgtttgacttccttggaaacgaacggcttagatcggaatgggatatcttatccaacggtggaccaatgaaagagatggcccatatagctaaaggccatgaccgttccaactccgtctccctcctccgtgccagcgcgataaatgcgaatcagagtagtatgctgatattacaagagacaagcatagacgctgcaggagcggttgtcgtgtacgcgcctgttgatatcccagcaatgcaagctgtgatgaacggtggagattctgcttacgtggcactccttccttcaggattcgccattctccctaacggtcaggctggtacgcaacgctgcgccgcagaggaacgtaacagtattggtaacggtgggtgcatggaggaaggagggtcgttactaacggtggcgtttcagatactggtgaatagtttgcctacggctaagctaacggtggaatctgtggagacggttaataatttgatatcgtgcaccgttcagaagattaaagctgctcttcattgtgatagcacctgatcatcgagatcagacgatggaggagattgagtcaagaacgaacctcattttgtgatgaatccgtttttgtgatg

SEQ ID NO: 130 - protein, 808 aa, Arabidopsis thaliana
MNFNGFLDDGAGASKLLSDAPYNNHFSFSAVDTMLGSAAIAPSQSLPFSSSGLSLGLQTNGEMSRNGEIMESNVSRKSSRGEDVESRSESDNAEAVSGDDLDTSDRPLKKKKRYHRHTPKQIQDLESVFKECAHPDEKQRLDLSRRLNLDPRQVKFWFQNRRTQMKTQIERHENALLRQENDKLRAENMSVREAMRNPMCGNCGGPAVIGEISMEEQHLRIENSRLKDELDRVCALTGKFLGRSNGSHHIPDSALVLGVGVGSGGCNVGGGFTLSSPLLPQASPRFEISNGTGSGLVATVNRQQPVSVSDFDQRSRYLDLALAAMDELVKMAQTREPLWVRSSDSGFEVLNQEEYDTSFSRCVGPKQDGFVSEASKEAGTVIINSLALVETLMDSERWAEMFPSMVSRTSTTEIISSGMGGRNGALHLMHAELQLLSPLVPVRQVSFLRFCKQHAEGVWAVVDVSIDSIREGSSSSCRRLPSGCLVQDMANGYSKVTWIEHTEYDENHIHRLYRPLLRCGLAFGAHRWMAALQRQCECLTILMSSTVSTSTNPSPINCNGRKSMLKLAKRMTDNFCGGVCASSLQKWSKLNVGNVDEDVRIMTRKSVNNPGEPPGIILNAATSVWMPVSPRRLFDFLGNERLRSEWDILSNGGPMKEMAHIAKGHDRSNSVSLLRASAINANQSSMLILQETSIDAAGAVVVYAPVDIPAMQAVMNGGDSAYVALLPSGFAILPNGQAGTQRCAAEERNSIGNGGCMEEGGSLLTVAFQILVNSLPTAKLTVESVETVNNLISCTVQKIKAALHCDST

SEQ ID NO: 131 - DNA, 1254 bp, Arabidopsis thaliana
tcgacccacgcgtccgaaacagaaaccgatcaaaggatgggtcttaatctgaatttgtctatctactctttaccaaaacccttatctcaatttctcgatgaagtgtcgaggatcaaagacaatcattccaaactgtctgaaatcgatggttatgtcggaaaattagaggaagaaaggaacaaaatcgatgtttttaaacgagaactccctttatgcatgctcttattgaacgaagcgattggggcgttgaaggatgaggctagaaaagggttatcactgatggcatctaatgggaaattcgatgatgttgaaagggcaaaaccggaaactgataagaagagctggatgagctctgcccagttatggatctcgaaccctaattcccaattccgatcgacaaatgaagaagaagaagatcggtgtgtgagtcagaacccatttcagacatgtaattaccctaatcaaggaggggtatttatgccatttaaccgtcccccacctcctccaccaccagctcctctgtctctcatgactccaacatcagagatgatgatggattatagcagaattgagcagagtcatcatcatcatcaattcaataaaccttcttcacagagtcatcacattcagaagaaagagcagagaaggagatggtcacaggaacttcaccgtaaatttgttgatgctcttcataggcttggagggccacaagttgctacaccaaagcagattagagatttgatgaaagttgatggtttaaccaatgatgaagtcaagagccatttacaaaaatatagaatgcatatccgtaagcatccgctgcatccgacaaagactttgtcatcgtcggatcagccaggtgtgttagagagagaatcgcagagcttaataagtttgtcgaggtcggattcgccacaaagcccacttgttgcaagagggttgttcagtagtaatgttggtcatagctcagaggaagatgaggaggaggaggatgaagaggaggagaagtctgatggacgtagtagctgtagaaatgatgaaacaaagaagaagagacaagtgttggatcttgagctttgaaagtctgcatagtgaatgatataatctttaccaacttatgttatatatgctcaaaactttgagtttgttcgggagtttttgtagatgtaaacatgagagttgaaataaggaagaggattttgagcaaaaagtagggtttgtttttgcaagaggaaatagatagagaagagtggc

SEQ ID NO: 132 - protein, 347 aa, Arabidopsis thaliana
MGLNLNLSIYSLPKPLSQFLDEVSRIKDNHSKLSEIDGYVGKLEEERNKIDVFKRELPLCMLLLNEAIGALKDEARKGLSLMASNGKFDDVERAKPETDKKSWMSSAQLWISNPNSQFRSTNEEEEDRCVSQNPFQTCNYPNQGGVFMPFNRPPPPPPPAPLSLMTPTSEMMMDYSRIEQSHHHHQFNKPSSQSHHIQKKEQRRRWSQELHRKFVDALHRLGGPQVATPKQIRDLMKVDGLTNDEVKSHLQKYRMHIRKHPLHPTKTLSSSDQPGVLERESQSLISLSRSDSPQSPLVARGLFSSNVGHSSEEDEEEEDEEEEKSDGRSSCRNDETKKKRQVLDLEL

SEQ ID NO: 133 - DNA, 1182 bp, Arabidopsis thaliana
ctttttgaaataaataacattatacccctcctttttcccataaaattcatcaagattatctcaaaatcattcaccaattctctcttcttatggagcttttcccttcacaacctgacttgtacttgaagatcagccgaagaagagaagaagaacaagaaaaagaaagtcaagaactacaagaacaagaagtcgaaaggagattagggtttcagagtaaagcctcagatttagacaacaagtcttcaaataatctcatccacactctccagttcacttcaaacaatgaagccaccaagattaatagtaatcaagaacacaaggaatctctcgatcaagacttgagatctatttttatgatgagaccaataagaggaatccctctttaccagaatcaagtccttgaccactactactactcatctacctctcccaatcctttcttcttcagtgaagtcaacggtcaacatgctagtcgtcgcttaatcacaaaccctaattgtagttttaatctccacaaccgtcatcggcgtcaagctcaaccgcagccgccaagattcaccgccaaaagaggagtaagggctccaaggatgcggtggacgacgaccctccacgcccattttgtacacgctgttcaattattgggtggtcatgaaagagcaaccccaaaatcagtacttgagctgatggatgtgcaagatctcacattggctcatgttaaatcccatctacagatgtatcgaaccatcaagtctactgaaaaacctacaacgtcatcagggcagtcagattgtgagaatggatcacaagtaaacagtgagagagaagcaagaaatctcacgggtctatggaataactcctcaagtgaagctcggttccagttgaaggcaaaggcatcatcaggtgtagacatttcatccaatgagaatgaatggaagaatcgaagatgtccaagcaacgaacggttgtcgtcagattcgtcaagccttacagggacaagaccagagactgaaactcccaatcttgatttcactttagctacaccaaacctctctccctaattttcttatatatactaaaaatacatattatctgttaaaaattatataaatctcaaacttaaaagtttatgcttttgaaaaaatatatatgaaatgacgtttatttcttccttaaaaaaaaaaa

SEQ ID NO: 134 - protein, 322 aa, Arabidopsis thaliana
MELFPSQPDLYLKISRRREEEQEKESQELQEQEVERRLGFQSKASDLDNKSSNNLIHTLQFTSNNEATKINSNQEHKESLDQDLRSIFMMRPIRGIPLYQNQVLDHYYYSSTSPNPFFFSEVNGQHASRRLITNPNCSFNLHNRHRRQAQPQPPRFTAKRGVRAPRMRWTTTLHAHFVHAVQLLGGHERATPKSVLELMDVQDLTLAHVKSHLQMYRTIKSTEKPTTSSGQSDCENGSQVNSEREARNLTGLWNNSSSEARFQLKAKASSGVDISSNENEWKNRRCPSNERLSSDSSSLTGTRPETETPNLDFTLATPNLSP

SEQ ID NO: 135 - DNA, 885 bp, Arabidopsis thaliana
atggaccatcatcagtatcatcatcatgatcaataccaacatcagatgatgactagtactaacaataattcctataacaccatcgtcacaacacaaccaccaccaacaacaacaacaatggattcaacaacagcaacaactatgataatggatgacgagaagaagttgatgacgacaatgagcactaggccgcaagaaccaagaaactgtccaagatgcaactcaagcaacaccaagttttgttattacaacaactacagcttagcacagcctaggtacttgtgtaagtcttgtcggagatattggactgaaggtggctctctccgtaacgtccccgtaggcggaggttctagaaagaacaagaagcttccatttcctaattcctctacttcttcttccaccaagaacctcccggatctcaaccctcctttcgtcttcacatcatcagcttcatcatcaaaccctagcaagacgcatcaaaacaataatgacctcagcctatccttctcctcccctatgcaagacaagcgagctcaagggcattacggtcatttcagtgagcaagttgtgacaggagggcagaactgtcttttccaagctcctatgggaatgattcagtttcgtcaagagtatgatcatgagcaccccaaaaagaatcttgggttttcattagacaggaacgaggaagagattggtaatcatgataacttcgttgttaatgaggaaggaagtaagatgatgtatccttatggagatcatgaagaccgtcaacaacatcaccatgtgagacacgatgatggtaataagaagagagaaggtggttcaagcaatgagctatggagcggaatcatcctaggtggtgatagtggtggaccaacatggtga

SEQ ID NO: 136 - protein, 294 aa, Arabidopsis thaliana
MDHHQYHHHDQYQHQMMTSTNNNSYNTIVTTQPPPTTTTMDSTTATTMIMDDEKKLMTTMSTRPQEPRNCPRCNSSNTKFCYYNNYSLAQPRYLCKSCRRYWTEGGSLRNVPVGGGSRKNKKLPFPNSSTSSSTKNLPDLNPPFVFTSSASSSNPSKTHQNNNDLSLSFSSPMQDKRAQGHYGHFSEQVVTGGQNCLFQAPMGMIQFRQEYDHEHPKKNLGFSLDRNEEEIGNHDNFVVNEEGSKMMYPYGDHEDRQQHHHVRHDDGNKKREGGSSNELWSGIILGGDSGGPTW

SEQ ID NO: 137 - DNA, 672 bp, Arabidopsis thaliana
atggatacgaccctttctcccgccgtggaggcggaacaaatcgccgactcaacgatcgacactgtttctcgtttgatcgccggcgttttctccggcgcacttactggaatcttcgctatggctggagcttttactggagctgtaactggtgcggtggcaggaagagctgcacagtatggagttctccgtggggctgcacttggcgctgttgctggagctatcctctctgttgaagtgttggaggcttctcgtgcgtattggtatttagagctgtcaggatcaaggggtccatcatctatggcagattttgtagagcaactgtttcgtgggagactggtagatgaacaacttatgtcaacaatgataaattcacaccattggcagttaaggatttccgatgtaagttatgaagagcgggaggatgtttatggtgaactggaagctagaggcttatcgggtgactctttaaggaaactaccatgctatataatgtcaagtgaaatggtcaggaggcaggtcactcactgcacaatttgtctgcaggacatcaaaacaggggaaatcacacgaagcttaccgaaatgtgatcatacgtttcatctggtatgtgttgataaatggctcatcagacacgggtcatgccccatttgcagacaggcagttaaagattaa

SEQ ID NO: 138 - protein, 223 aa, Arabidopsis thaliana
MDTTLSPAVEAEQIADSTIDTVSRLIAGVFSGALTGIFAMAGAFTGAVTGAVAGRAAQYGVLRGAALGAVAGAILSVEVLEASRAYWYLELSGSRGPSSMADFVEQLFRGRLVDEQLMSTMINSHHWQLRISDVSYEEREDVYGELEARGLSGDSLRKLPCYIMSSEMVRRQVTHCTICLQDIKTGEITRSLPKCDHTFHLVCVDKWLIRHGSCPICRQAVKD

SEQ ID NO: 139 - DNA, 1570 bp, Arabidopsis thaliana
ggaacaagattggacgaaagctaaaggtattgcatccatttaaaaagttcatggataggtggtccagtaaaagagccatggaggcgagacctgactctaagaagaagggtggtgttgtttttagagatagatttaacagcaatagttgcaaggttcctatttgtagtgatgagaaaaaatcaatgaactttactaggtttgttggctcttcagataagaaagagaaatcagtgttgtctacataccgctcttcgccaaacgggaaggaagtaattggaacttcctctaagatttgtatctctagctcctcttctgtgaaaagtggtgagaagcaaccgttttctcagatagccattgattcatcagagagcagcagaggtagtgaagacgaggtagagtcagaaatcttgcaagttcctcttggaagagataaaagaagaatgaacaataaacttatttatggaaaagttataacacctgaagcggaatgctcaaagttgccatcaagctcaagaatcaagagaggttttaggcagagatttgggttgagcaagcaagagtttcatcctggtccatctggccagtcaacatctgctaaccggggatgcagcccgttgttgtcaggtgtcattccaagtggttttggattggacaaaagattaagtcggaaggcagatacaatcagtaagacaaaagtttacggagaaagcagttctagctcctcagctagggggaagaatgtaacagaacctccaccagttgaagtgagacgtcgtagttttaatccgagaggttctgtttctgatagtagacgggctagacactgcattttggatgatgacaacgatgttgcttcagttgggagtcagagattggcaaatagaaataatagtcgcattagagggagtggtagagacggtttatcctctgtcacggcagcagagatgtctcagactgaaacatcaaacaatctcaattctcctgtctctttggagctgttctctggttttccagaatttggcctctctggttccttattgagtcatgacagttttcgcagttataatttagatgggatctccgagattctgccagaacttgataggatcgaacaagatatcgaacttaattatgaggatctgcttatcatggaaacaggtttacttctcggtggactaagcttccatgaccaacaccgagacatgaggctagacatcgataacatgtcatatgaggaactattagctctagaagagaggattggtacagtaagcactgctttgacagaagaagcaatatcaaagtgcttgaaaacaagtatctatcagatgaaacctttgagttatgggtctatcaccaaaagtcctagtgataacaaggaagatgccaaatgcagcatctgccaggaagaatatacgattggagatgaagttgggaggctacactgtgagcacacataccatgtgaagtgtgtgcaagagtggttgcggataaagagttggtgcccaatctgcaaagccacagccgaaacctcctctaaataaccgtcttcttcttcttcctcgttcgt

SEQ ID NO: 140 - protein, 497 aa, Arabidopsis thaliana
MDRWSSKRAMEARPDSKKKGGVVFRDRFNSNSCKVPICSDEKKSMNFTRFVGSSDKKEKSVLSTYRSSPNGKEVIGTSSKICISSSSSVKSGEKQPFSQIAIDSSESSRGSEDEVESEILQVPLGRDKRRMNNKLIYGKVITPEAECSKLPSSSRIKRGFRQRFGLSKQEFHPGPSGQSTSANRGCSPLLSGVIPSGFGLDKRLSRKADTISKTKVYGESSSSSSARGKNVTEPPPVEVRRRSFNPRGSVSDSRRARHCILDDDNDVASVGSQRLANRNNSRIRGSGRDGLSSVTAAEMSQTETSNNLNSPVSLELFSGFPEFGLSGSLLSHDSFRSYNLDGISEILPELDRIEQDIELNYEDLLIMETGLLLGGLSFHDQHRDMRLDIDNMSYEELLALEERIGTVSTALTEEAISKCLKTSIYQMKPLSYGSITKSPSDNKEDAKCSICQEEYTIGDEVGRLHCEHTYHVKCVQEWLRIKSWCPICKATAETSSK

SEQ ID NO: 141 - DNA, 1790 bp, Arabidopsis thaliana
gagagagtctctgtctctgtaaaagatatttgagcttgagaagaacagaagaaacttccaggatcaatcaatcgatcaactttagtgaactaactcttgatttttcattcgaagttatggaatcggttcccgaatccgtaccatcgccgaactcgaatacaccgtcaataccaccgccggtgaactccgtaccgcctttcttgagtaaaacctacgacatggttgatgatccgttgaccaatgaggtcgtttcgtggagcagcgggaacaacagcttcgtcgtctggagtgccccggagttctcgaaggtgctcttgcccaagtatttcaagcacaacaacttctccagcttcgtcagacagttaaatacttatggtttcagaaaagttgatcctgaccgatgggaatttgcaaatgaaggatttcttagaggccgaaaacaactactgaagagtattgtcaggagaaaaccttcgcatgtgcagcagaatcagcaacaaactcaagttcagagctcatctgttggtgcttgtgtcgaggtggggaagtttggaatagaagaagaagtggaaagacttaagcgggataagaatgttcttatgcaagaactcgtcaggttaaggcagcaacagcaagctactgaaaaccaactgcagaatgtgggacagaaagttcaggtgatggagcaaaggcaacaacaaatgatgtcgtttttagcaaaggctgttcaaagtccaggtttcttaaaccagttagtacaacagaataataatgatggcaacagacaaattccaggaagcaacaaaaagaggagacttcctgtagatgagcaggagaatcgtggtgacaatgtggctaatggtcttaaccgccagattgttagatatcagccgtcgataaacgaagcagcacaaaatatgcttcgacagttcttaaatactagtacctcacctcggtatgaatcagtttcaaacaatcctgacagtttcctattgggtgatgttcccagttctacctctgtagacaatgggaacccttcaagtagagtttctggagtaacattggccgagttttcacccaacacagttcagtcagcaacgaatcaagtacccgaagcaagtttggctcatcatcctcaagctggtctggttcagccaaatataggtcaaagtccggctcaaggagcagcacctgcagactcttggagccctgaatttgatttagttggatgcgagacagatagtggagagtgttttgatccaataatggctgttttagatgagtcagaaggcgatgcaatttctcctgaaggtgagggcaagatgaatgagttactggagggagtccctaagctgcccggaatccaagatccattctgggaacagttcttttctgttgaactcccagcgattgcagatacagacgatattctatcaggatcagtggagaataatgacttggtattggaacaagaaccaaacgagtggacccgtaatgaacaacaaatgaagtatcttactgaacaaatgggactgctttcctcagaagcacagaggaaataaagattttcaggggaggttgcaaaaggagatatgaaggaacgaggaatatatcagatggtgtgtataccctttacatttttacttaaatgaaaaaaaaacagagagaagaaacataaaagatttaccaccaagcttgtgaatagttagtagagatcggtttttgtgttgtttatattatacttttgtgtgaaaacgttcatcttgttcaattatcaaaaaaaaaaaaaa

SEQ ID NO: 142 - protein, 481 aa, Arabidopsis thaliana
MESVPESVPSPNSNTPSIPPPVNSVPPFLSKTYDMVDDPLTNEVVSWSSGNNSFVVWSAPEFSKVLLPKYFKHNNFSSFVRQLNTYGFRKVDPDRWEFANEGFLRGRKQLLKSIVRRKPSHVQQNQQQTQVQSSSVGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYESVSNNPDSFLLGDVPSSTSVDNGNPSSRVSGVTLAEFSPNTVQSATNQVPEASLAHHPQAGLVQPNIGQSPAQGAAPADSWSPEFDLVGCETDSGECFDPIMAVLDESEGDAISPEGEGKMNELLEGVPKLPGIQDPFWEQFFSVELPAIADTDDILSGSVENNDLVLEQEPNEWTRNEQQMKYLTEQMGLLSSEAQRK

SEQ ID NO: 143 - DNA, 1248 bp, Arabidopsis thaliana
ccaccaccaacaacaaacatataaaccataaggaaaacagagaaagagagagatggaggacgacaatagtaacaacaacaacaacaacaacgtgatcgcacctttcatcgtgaaaacatatcagatggtcaatgatccttccaccgattggctcatcacttggggacctgctcacaacagtttcatagtcgttgatccactcgacttctcgcaacgaatcttacctgcttatttcaaacacaacaatttcagcagttttgttcgtcaactcaacacctatgggtttaggaaagtggatccggaccggtgggagtttgcgaacgagcattttctaaggggacagaagcatttgttgaataacatagcgcgtaggaaacacgcgcgggggatgtacggtcaagatttggaggacggtgagattgtgagggagatcgaacggttaaaagaagagcagagggagctagaggcagagattcagaggatgaaccggaggatcgaagcgacggagaagagaccggagcagatgatggcgtttctttacaaagtcgttgaagatcctgatcttcttccaagaatgatgctcgagaaagaacggacaaagcaacaacaacaagtttccgacaagaagaagcgtcgtgtcacgatgtcgacggtgaagtcagaggaagaagaagtggaagaagatgaagggagggtctttagggttatgtcatcatcaacaccgtcgccgtcatcaacggagaatctttaccggaatcattcaccggatgggtggattgttcctatgacgcaaggacagtttggtagttacgagacgggtttggtggcgaagtcgatgctctcgaattcaacgtcgtcgacgtcatcatctttgacgtcgacgttttctttgccggagagtgttaacggaggaggaggaggaggatgtgggagtattcagggagaaagaaggtataaagaaacggcgacgtttggaggagtggtagagtcaaatccaccaacaacaccgccttatccattttctctgtttcgaggtggcttttagcgtttagcttcacatgatatatgatctttagactttattatggttatattattattattatttattttttgtgtgtttgttcttaattattttatgtataccccaaagaaagaaagaaaataaggcagatccatagttgagtcagtagtcatcgtttgtagaaagttttgacagtatataatttctgattatatttgttaaaa

SEQ ID NO: 144 - protein, 330 aa, Arabidopsis thaliana
MEDDNSNNNNNNNVIAPFIVKTYQMVNDPSTDWLITWGPAHNSFIVVDPLDFSQRILPAYFKHNNFSSFVRQLNTYGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTVKSEEEEVEEDEGRVFRVMSSSTPSPSSTENLYRNHSPDGWIVPMTQGQFGSYETGLVAKSMLSNSTSSTSSSLTSTFSLPESVNGGGGGGCGSIQGERRYKETATFGGVVESNPPTTPPYPFSLFRGGF

SEQ ID NO: 145 - DNA, 2353 bp, Arabidopsis thaliana
tctcaatttggttcttttgccttctctttgatcttatctcttacgattgtgcagatctcaatctctatatccttggttgtgtcagattctcttagggtttattttctctcccaattttgtttgattccttgtccaaagtttcttcctttccttttgacttttttttgtggtacattgaatcagaggtgtaagagtaatagtttcataactcaaatccccaagtgtacaaattttcctcttttggttctgggtttggttgattccttgttagaaatgtaaatttagggcttttgtatctgaaaccgatcttcagacttgtgtaatcttcttgatcttcatgcaagattgataattctacaagaagaagaagaagagaaaatggctactttgactgagccatcatcatctttgagtttcacatcttctcatttctcttatggttctattgggtccaatcacttctcatcaagctcagcttctaatcctgaagttgttagtctaaccaaactcagctccaatcttgagcagcttcttagtaattcagattgtgattacagtgatgcagagatcattgttgatggtgttccagttggtgttcatagatgcattttagctgcaagaagtaagtttttccaagatttgtttaagaaagaaaagaaaatttcgaaaactgagaaaccaaagtatcagttgagagagatgttaccttatggagctgttgctcatgaagctttcttgtatttcttgagttatatatatactgggagattaaagccttttccattggaggtttcgacttgtgttgatccagtttgttctcatgattgttgtcgacctgccattgattttgttgttcaattgatgtatgcttcctctgttctccaagtgcctgagctagtttcatcttttcagcggcggctttgtaactttgtggagaagacccttgttgagaatgttcttcccattcttatggttgctttcaattgtaagttgactcagcttcttgatcagtgtattgagagagtggcgaggtcagatctttacaggttctgtattgaaaaggaagttcctcccgaagtagcagagaagattaaacagcttcgacttatatccccgcaagacgaagaaaccagtcccaagatttcggagaaattgcttgaaagaatcggtaaaattctcaaggccttggattcagatgatgttgagcttgtgaagcttcttttgactgagtcagatatcactctagatcaagccaatggtctgcattattctgttgtgtatagtgatccgaaagttgttgccgagattcttgctctggatatgggtgatgtgaactacaggaattcccggggttacacggttcttcattttgctgcgatgcgtagagagccatcgatcattatatcgcttatcgataaaggcgccaatgcatctgagtttacatctgacggacgtagcgcagttaatatattaagaagactgacaaatccaaaggattatcataccaaaacagctaaagggcgtgaatctagtaaagccaggttatgcatcgatatcttggaaagagaaatcaggaagaaccccatggttctagatacaccaatgtgttccatttctatgcctgaagatctccagatgagactgttgtacctagaaaagagagtggggcttgctcagttgttctttccaacggaagctaaagttgctatggacattggtaacgtagaaggtacaagtgagttcacgggtttgtcacctccttcgagtgggttaaccggaaacttgagtcaggttgatttaaacgaaactcctcatatgcaaacccaaagacttcttactcgtatggtggctctaatgaaaacagttgagactggtcgaaggttttttccatatggttcagaggttctagataagtacatggctgagtatatagacgacgacatcctcgacgatttccattttgagaagggatctacacatgaaagaagattgaaaagaatgagatatagagagcttaaggatgatgtccaaaaggcatatagcaaagacaaagagtctaagattgcgcggtcttgtctttctgcttcatcttctccttcttcttcttccataagagatgacctgcacaacacaacatgaaactgcaccataagtcaaatgtaattagatatctttgttaaaagggttttttctttatggatgttactcagattttatacagatgctttaggttcagtttcaataaagagagatggatagatagatgtacaagattaggagtgctgattaacccaaaacgttctaactatacgcaatcttttgttttcaatacaaaaatctaatatttaggtta

SEQ ID NO: 146 - protein, 586 aa, Arabidopsis thaliana
MATLTEPSSSLSFTSSHFSYGSIGSNHFSSSSASNPEVVSLTKLSSNLEQLLSNSDCDYSDAEIIVDGVPVGVHRCILAARSKFFQDLFKKEKKISKTEKPKYQLREMLPYGAVAHEAFLYFLSYIYTGRLKPFPLEVSTCVDPVCSHDCCRPAIDFVVQLMYASSVLQVPELVSSFQRRLCNFVEKTLVENVLPILMVAFNCKLTQLLDQCIERVARSDLYRFCIEKEVPPEVAEKIKQLRLISPQDEETSPKISEKLLERIGKILKALDSDDVELVKLLLTESDITLDQANGLHYSVVYSDPKVVAEILALDMGDVNYRNSRGYTVLHFAAMRREPSIIISLIDKGANASEFTSDGRSAVNILRRLTNPKDYHTKTAKGRESSKARLCIDILEREIRKNPMVLDTPMCSISMPEDLQMRLLYLEKRVGLAQLFFPTEAKVAMDIGNVEGTSEFTGLSPPSSGLTGNLSQVDLNETPHMQTQRLLTRMVALMKTVETGRRFFPYGSEVLDKYMAEYIDDDILDDFHFEKGSTHERRLKRMRYRELKDDVQKAYSKDKESKIARSCLSASSSPSSSSIRDDLHNTT

SEQ ID NO: 147 - DNA, 3115 bp, Arabidopsis thaliana
acaattggcttcacactctctcttttctcaattttgcttcttacttctttccccggctgattagaaacttgaccgcttgattctcttaaaggaggtcttgcgatggattccgctattgatatcagttctgatagtgatgtcgagatacaagaaactagaaccaggcctcaacatcccccacggatagctgaaggatctcatagaagagatctctctacgctgagaccgcactttcttagtgggagttcttccggtgcaaatggccacactaaaacaggacttacaaatctcgactcacgtaatggttttgaatccaagccactgcctcgggcagaacaccatacacatattccgggaaatgggagtatcgtaacttccagaattcccaatatctctgttggtgattatgagaaattttcatctcaacaagcttttaaaaggacacatccaccaacctttagtcgacctccttttcctcctagacctgatattggtacaagtaacgggaatgcgagtcactttcgtggtggagcacatgatgatctaggcatggggcgtgtgactaacggcactcggatcctacctccatctgtggcgcacggaacatctgcgtctccttcacattttaatggattaagtgatccaatgcataggaatggcataggcgaagaaaggaattcggaaaatgacgagaggctgatctatcaggctgcactacaggaactgaatcaacccaagtccgaggtcgatttacctgctggtcttctttcggttccccttatgaagcatcagaaaattgcattggcatggatgtttcagaaggaaactaatagtttgcactgtatgggagggatattagctgatgatcagggccttggtaagacagtctcgactattgcgcttatcctaaagcaaatgcacgaggcaaaattaaagtccaagaattcaggcaatcaagaggctgaagcattggatctggatgctgatgatgagtcagaaaatgcatttgagaaaccagagtctaaggcttcaaatggtagtggtgtgaatggtgattcaggcataaagaaagccaagggagaagaagcgagtacttcaacacgcaaattcaacagaaagagaccagctgctggtactttaattgtttgtccagcaagtgttgtgcggcagtgggcaagagaacttgatgagaaggttactgatgaagccaaactttctgttttaatataccacggcggtaacaggaccaaagatcctattgaactagcaaaatatgatgtggttatgacaacttacgccattgtttcaaatgaagttccaaagcaacccctggttgatgacgatgagaatgatgaaaaaaattctgaaaaatatggtctcgcttctggcttctccatcaataagaaacggaaaaatgtagtgggtactactaagaagagtaagaagaaaaaaggtaacaataatgctggcgattcatctgaccctgactctggtactctagcaaaagttgggtggttcagagttgtactagatgaagctcaaacaattaagaatcatagaacccaggtggcaagagcatgttgcggtcttcgagccaaaaggaggtggtgtttgtctggaacaccaatacaaaatacaatagatgatttatacagctatttcaggtttctaaaatatgatccatatgctgtgtacaagtcattctgccaccaaattaagggtccaatttccagaaattcccttcaagggtacaagaagcttcaggctgttctaagggctataatgctacgccgtacgaaaggaacattgcttgatggccagcctataattaatctaccaccaaagacaattaatttgagccaggtggacttttcggtagaggagcggtctttctacgtgaagcttgaatccgattcccgttctcagttcaaggcatatgctgctgcaggaactttgaatcaaaactatgcaaacattcttctcatgcttttgcgactacgccaagcttgtgaccacccccaacttgttaaaagatataactcagattctgttggaaaagtatcagaagaagctgttaaaaaactccctaaagaggatctagttagcctgctcagtcgcttagaatcgtctcccatctgttgtgtctgccatgatccaccagaagaccctgttgttactttgtgtggccatatattctgctatcagtgtgtatcagattatatcacaggggatgaggacacgtgccctgcgcctagatgcagagaacagcttgcgcatgatgttgttttctctaaatccacgcttagaagttgcgttgctgatgatttgggttgtagttcctcagaggataatagtcatgataaatcagtttttcagaatggcgagtttagttcatcaaagatcaaagctgtcttagatattctgcagtcgctttctaaccaaggcacttcaaactcaacacagaatggtcaaatggcttcttcctcgcagcagccgaatgatgatgatgatgatgatgatgatgatgtcaccattgtcgagaaaacgagtctgaagtcaactccttctaatggaggaccaataaaaacgattatattttctcagtggactggtatgcttgacttggtggagctatctctaattgaaaatagtatagaattcagaagattagatggtacaatgagtctaattgccagagacagagctgtgaaagaattcagcaacgatccagatgtaaaagtgatgataatgtctttaaaagctggaaatcttgggctgaatatgattgctgcatgtcatgtcattcttcttgatctatggtggaatccaactactgaagatcaggctattgatcgagcacatcgtattggacaaactcgacctgttactgtaactcgtattacgataaaaaatactgtggaggatagaattttggctctccaggaagagaaaagaaaaatggttgcgtctgcctttggtgaagatcatggtggaagctctgcaactcgattaacagttgatgatctcaaatatctattcatggtgtagctgttcttaaatcttgggttggcgaagtttcgcttctttcagaattttgatcatgagctgcattctt

SEQ ID NO: 148 - protein, 981 aa, Arabidopsis thaliana
MDSAIDISSDSDVEIQETRTRPQHPPRIAEGSHRRDLSTLRPHFLSGSSSGANGHTKTGLTNLDSRNGFESKPLPRAEHHTHIPGNGSIVTSRIPNISVGDYEKFSSQQAFKRTHPPTFSRPPFPPRPDIGTSNGNASHFRGGAHDDLGMGRVTNGTRILPPSVAHGTSASPSHFNGLSDPMHRNGIGEERNSENDERLIYQAALQELNQPKSEVDLPAGLLSVPLMKHQKIALAWMFQKETNSLHCMGGILADDQGLGKTVSTIALILKQMHEAKLKSKNSGNQEAEALDLDADDESENAFEKPESKASNGSGVNGDSGIKKAKGEEASTSTRKFNRKRPAAGTLIVCPASVVRQWARELDEKVTDEAKLSVLIYHGGNRTKDPIELAKYDVVMTTYAIVSNEVPKQPLVDDDENDEKNSEKYGLASGFSINKKRKNVVGTTKKSKKKKGNNNAGDSSDPDSGTLAKVGWFRVVLDEAQTIKNHRTQVARACCGLRAKRRWCLSGTPIQNTIDDLYSYFRFLKYDPYAVYKSFCHQIKGPISRNSLQGYKKLQAVLRAIMLRRTKGTLLDGQPIINLPPKTINLSQVDFSVEERSFYVKLESDSRSQFKAYAAAGTLNQNYANILLMLLRLRQACDHPQLVKRYNSDSVGKVSEEAVKKLPKEDLVSLLSRLESSPICCVCHDPPEDPVVTLCGHIFCYQCVSDYITGDEDTCPAPRCREQLAHDVVFSKSTLRSCVADDLGCSSSEDNSHDKSVFQNGEFSSSKIKAVLDILQSLSNQGTSNSTQNGQMASSSQQPNDDDDDDDDDVTIVEKTSLKSTPSNGGPIKTIIFSQWTGMLDLVELSLIENSIEFRRLDGTMSLIARDRAVKEFSNDPDVKVMIMSLKAGNLGLNMIAACHVILLDLWWNPTTEDQAIDRAHRIGQTRPVTVTRITIKNTVEDRILALQEEKRKMVASAFGEDHGGSSATRLTVDDLKYLFMV

SEQ ID NO: 149 - DNA, 1782 bp, Arabidopsis thaliana
atggtggaacaaactgtggttagagaacatatcaaagcgagagtcatgtcattagtgaggtctgcagagccatcctcatataggaacccgaagctttacacgttgaatgagaatggtaataacaatggtgtcagttctgctcaaatctttgatccagataggtcaaagaatccttgtctgactgatgattcttacccaagccaaagttatgagaagtactttcttgattcgccaactgatgagtttgttcaacatcctattggctctggtgcctcggttagctcatttggctctttagactcatttccttatcagtcaagaccagttcttggatgttccatggaatttcagttaccgttggattcaacctctacttcatctacaaggcttttgggagattaccaagcggtttcttacagtccgagcatggatgtagtggaggagtttgatgatgagcaaatgagatcaaagattcaagagcttgaaagagcgcttctcggcgatgaagatgataaaatggttggaatagataacctcatggagattgacagcgaatggtcgtaccaaaacgaaagcgaacagcatcaagactcgcccaaagaatcatcgtctgcagattccaactctcatgtaagtagcaaagaagtggtgtctcaagccactccaaagcaaatcttgatatcttgtgctcgtgcgctatctgaaggaaaattagaagaagctttgtcaatggtaaatgagctgaggcagatagtttctatccaaggagacccttctcagagaatcgcagcttacatggtggaaggtctagctgcaagaatggccgcttcaggaaaattcatctacagagcattgaaatgcaaagagcctccttcggatgagaggcttgcagctatgcaagtcctgtttgaagtctgcccttgtttcaagttcgggtttttagcagctaatggtgcgatacttgaagcaatcaaaggtgaagaagaagttcacataatcgatttcgatataaaccaagggaaccaatacatgacactgatacgaagcattgctgagttgcctggtaaacgacctcgcctgaggttaacaggaattgatgaccctgaatcagtccaacgctccattggagggctaagaatcatcggtctaagactcgagcaactcgcagaggataatggagtatccttcaaattcaaagcaatgccttcaaagacttcgattgtctctccatcaacactcggttgcaaaccaggagaaaccttaatagtgaactttgcattccaacttcaccacatgcctgacgagagtgtcacaacagtaaaccagcgggacgagctacttcacatggtcaaaagcttaaacccaaagcttgtcacggtcgttgaacaagacgtgaacacaaacacttcaccgttctttcccagattcatagaggcttacgaatactactcagcagttttcgagtctctagacatgacacttccaagagaaagccaagagaggatgaatgtagaaagacagtgtctcgctagagacatagtcaacattgttgcttgcgaaggagaagaacggatagagagatacgaggctgcgggaaaatggagagcaaggatgatgatggctggattcaatccaaaaccaatgagtgctaaagtaaccaacaatatacaaaacctgataaagcaacaatattgcaataagtacaagcttaaagaagaaatgggtgagctccatttttgctgggaggagaaaagcttaatcgttgcttcagcttggaggtaa

SEQ ID NO: 150 - protein, 593 aa, Arabidopsis thaliana
MVEQTVVREHIKARVMSLVRSAEPSSYRNPKLYTLNENGNNNGVSSAQIFDPDRSKNPCLTDDSYPSQSYEKYFLDSPTDEFVQHPIGSGASVSSFGSLDSFPYQSRPVLGCSMEFQLPLDSTSTSSTRLLGDYQAVSYSPSMDVVEEFDDEQMRSKIQELERALLGDEDDKMVGIDNLMEIDSEWSYQNESEQHQDSPKESSSADSNSHVSSKEVVSQATPKQILISCARALSEGKLEEALSMVNELRQIVSIQGDPSQRIAAYMVEGLAARMAASGKFIYRALKCKEPPSDERLAAMQVLFEVCPCFKFGFLAANGAILEAIKGEEEVHIIDFDINQGNQYMTLIRSIAELPGKRPRLRLTGIDDPESVQRSIGGLRIIGLRLEQLAEDNGVSFKFKAMPSKTSIVSPSTLGCKPGETLIVNFAFQLHHMPDESVTTVNQRDELLHMVKSLNPKLVTVVEQDVNTNTSPFFPRFIEAYEYYSAVFESLDMTLPRESQERMNVERQCLARDIVNIVACEGEERIERYEAAGKWRARMMMAGFNPKPMSAKVTNNIQNLIKQQYCNKYKLKEEMGELHFCWEEKSLIVASAWR

SEQ ID NO: 151 - DNA, 1197 bp, Arabidopsis thaliana
tacttccaccatcaaatcgtcaaaccatttgcaaccatcgatggtggtcatgtcacgagtaagcttctactcttctttcttgctactactgttagaggtcgttgtcgctagcagcgagtttgatgatgaaggaagaacatcgttcagtccaaccacggctataatcatgatcgtactcgttagtgttttcttcgcacttggatgtatctccgtctacatgaggaggtgtctccagcacgctctggggatggacagcggtggtggtccaggaaactggcttaacgtgaggcaaacgacggagcctgggctagacgcgtctgttatagaaacgtttccaacgtttccttactctacagtgaagacgttgaggatcggtaaagaagctttggagtgtcccgtttgtctcaacgagttcgaggacgacgaaacgctgcgtttgattcctcagtgttgtcacgtgtttcatcctggttgcattgatgcctggctccgttctcagaccacatgtcctctttgccgagccaatctcgttcctgtaccgggtgagtctgtttcttcggagatacccggtttagctagagaaaccggtcagaactctctcagaacgccgattgatgataaccggaaaagggttttaacttcacctgacgagcggttgattgactcagtggcttggacgggtaaccaaagcatgccacgtaaatccatgtctacaggttggaaactagctgaattgtacagcccggctagttcaccgggccaaccggaggagaatctcgaccggtatacgctgaggttaccacaagagatacatgaccagcttgtgaactccagcctgggaaagcaagggtcaaaaggccaactggccttacctcaagaaaggagctcggttagagggttcagaaccggaagcctagggactgaaaagaactatttctactttgaacggtttgatcaagacggtcggttggaccggagaccattttctataactcctccataccatacccggtcgatacagtctccggatgagattatcaacgctagtggtaattatcaggatcgtgctggtgcacctaaaggtttgcttctagcaataaggtcaccgtttgatcggttatttactgggaagaaaaatgccggtgagcgttcgtaccttcaatccggcgatgcgagccctgtctaggcgaattacta

SEQ ID NO: 152 - protein, 381 aa, Arabidopsis thaliana
MVVMSRVSFYSSFLLLLLEVVVASSEFDDEGRTSFSPTTAIIMIVLVSVFFALGCISVYMRRCLQHALGMDSGGGPGNWLNVRQTTEPGLDASVIETFPTFPYSTVKTLRIGKEALECPVCLNEFEDDETLRLIPQCCHVFHPGCIDAWLRSQTTCPLCRANLVPVPGESVSSEIPGLARETGQNSLRTPIDDNRKRVLTSPDERLIDSVAWTGNQSMPRKSMSTGWKLAELYSPASSPGQPEENLDRYTLRLPQEIHDQLVNSSLGKQGSKGQLALPQERSSVRGFRTGSLGTEKNYFYFERFDQDGRLDRRPFSITPPYHTRSIQSPDEIINASGNYQDRAGAPKGLLLAIRSPFDRLFTGKKNAGERSYLQSGDASPV

SEQ ID NO: 153 - DNA, 1797 bp, Arabidopsis thaliana
aaaaaaaaaaacaatctaagatatctatcaagatcttaagatatctacatttatagagatgtttcgttttccggtaagtcttggaggaggtccacgtgagaatctgaagccatcagatgagcagcatcaacgtgcggtggtgaatgaggttgactttttccgatcagcggagaagagagatagggtttcacgtgaagaacaaaacattatcgccgatgagactcatagggttcatgtcaaaagggagaattcacgtgttgatgatcatgacgatcgttctactgatcacatcaatattggacttaatcttctcactgcgaatacgggaagcgacgagtcaatggtggatgatggattgtctgtggatatggaagagaaacgtacaaagtgtgagaatgcacaacttcgcgaagagctaaagaaggcgagtgaagataatcaaagactaaagcaaatgctaagtcaaacaaccaacaacttcaattccttgcagatgcaacttgttgctgtcatgaggcaacaagaagatcatcatcacctagctacgaccgagaacaatgacaatgtaaagaaccgacatgaagtgcctgaaatggttccaagacagttcatcgatttgggaccgcattctgacgaagtgtcgtccgaggagaggacgacggttcggtcgggatctcctccctcgcttctagagaaatctagctcacgtcaaaacggaaagagagtgcttgtaagagaagaaagcccggaaaccgaatccaacggctggagaaaccctaacaaagttcctaaacaccatgcatcatccagcatttgcggtggcaatggcagtgaaaatgcaagtagcaaggtcattgagcaagcggccgccgaagccaccatgcgtaaagcccgtgtctcggttcgtgctcgatccgaagctcccatgttaagcgatggatgtcaatggagaaaatacggacaaaaaatggcgaaaggaaacccgtgccctcgagcttattaccgttgcacaatggctgttggatgtcctgttcgcaagcaagtgcaacgttgcgcggaagatagaaccattctcataacaacctacgaaggaaaccataaccatccattacctcctgcggctatgaacatggcttcaactacaacagcagccgcaagcatgcttctctcaggctccaccatgtcgaaccaagacggtttaatgaacccaacaaatctcttggctcgaaccatattaccgtgttcctcaagcatggctactatctcagcctctgcaccattcccaaccattacattagacctcacagagtcacccaacgggaacaatccaaccaataacccgctgatgcaattctctcaacggtctggtttggtggagttgaaccaatcggttttgcctcatatgatgggtcaggctttgtactacaaccaacagtctaagttttcgggtttacatatgccgtctcagccgctaaacgctggtgagagtgttagcgccgctactgccgcaatcgcctccaatcccaactttgccgcggctctagctgcagccataacttcgattatcaacggttcgaacaatcagcagaatgggaacaacaataacagtaatgttacaacgagcaacgttgacaataggcaataacatttttttataagttttagttagggactttttatcggtcgattttgttttgtttttcttttattacattattttttagttacggcttttttttgttttttcttttctttcccaaacaacaagtattgagagcaattcccccccccccccct

SEQ ID NO: 154 - protein, 528 aa, Arabidopsis thaliana
MFRFPVSLGGGPRENLKPSDEQHQRAVVNEVDFFRSAEKRDRVSREEQNIIADETHRVHVKRENSRVDDHDDRSTDHINIGLNLLTANTGSDESMVDDGLSVDMEEKRTKCENAQLREELKKASEDNQRLKQMLSQTTNNFNSLQMQLVAVMRQQEDHHHLATTENNDNVKNRHEVPEMVPRQFIDLGPHSDEVSSEERTTVRSGSPPSLLEKSSSRQNGKRVLVREESPETESNGWRNPNKVPKHHASSSICGGNGSENASSKVIEQAAAEATMRKARVSVRARSEAPMLSDGCQWRKYGQKMAKGNPCPRAYYRCTMAVGCPVRKQVQRCAEDRTILITTYEGNHNHPLPPAAMNMASTTTAAASMLLSGSTMSNQDGLMNPTNLLARTILPCSSSMATISASAPFPTITLDLTESPNGNNPTNNPLMQFSQRSGLVELNQSVLPHMMGQALYYNQQSKFSGLHMPSQPLNAGESVSAATAAIASNPNFAAALAAAITSIINGSNNQQNGNNNNSNVTTSNVDNRQ

SEQ ID NO: 155 - DNA, 1388 bp, Arabidopsis thaliana
ccaaaatctagggttttcttctcgcccaatttcacttttcttctacgaaattctccattcctgccggctgtcgggttttctgaatcgattctccttcaccaacttcttctctggttctgttcgattctgattttttttcaaggtcaattttttcttctctttaaactctgcaaaatcgtgatcgattaaattcacctcagggttttttgatttctgaaagaagttaatcttcttcgaaggcgattgcaaaagagtgctctgctgtgaatttccactgagatgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcaccataataaaaaaagccaaagctctgagaggagagagagacacacactttggctaatataatccattgcctcaaaccggcaaatcattcttggctttttcgtttttgtgtttgctagttgttcttgtcagagtctcatattgtgtgggtttaacagttatgatgaatgtacaaagagcgagttatgttaggtgttagattttggagacaagagacaaaggaatagcaagtaggtcttgtttttattctttgaccttttttttctcttttgcaaaattgaaaaatacgtttgcttaaaaa

SEQ ID NO: 156 - protein, 271 aa, Arabidopsis thaliana
MQSKPGRENEEEVNNHHAVQQPMMYAEPWWKNNSFGVVPQARPSGIPSNSSSLDCPNGSESNDVHSASEDGALNGENDGTWKDSQAATSSRSDNHGMEGNDPALSIRNMHDQPLVQPPELVGHYIACVPNPYQDPYYGGLMGAYGHQQLGFRPYLGMPRERTALPLDMAQEPVYVNAKQYEGILRRRKARAKAELERKVIRDRKPYLHESRHKHAMRRARASGGRFAKKSEVEAGEDAGGRDRERGSATNSSGSEQVETDSNETLNSSGAP

SEQ ID NO: 157 - DNA, 1077 bp, Arabidopsis thaliana
atggctgataataaggtcaatctttcgattaatggacaatcaaaagtgcctccaggtttcagattccatcccaccgaagaagaacttctccattactatctccgtaagaaagttaactctcaaaagatcgatcttgatgtcattcgtgaagttgatctaaacaagcttgagccttgggatattcaagaggaatgtagaatcggttcaacgccacaaaacgactggtacttcttcagccacaaggacaagaagtatccaaccgggaccaggacgaaccgggcaacagtcgctggattctggaaagctaccggacgtgacaaaatcatctgcagttgtgtccggagaattggactgaggaagacactcgtgttctacaaaggaagagctcctcacggtcagaaatccgactggatcatgcatgagtatcgcctcgacgatactccaatgtctaatggctatgctgatgttgttacagaagatccaatgagctataacgaagaaggttgggtggtatgtcgagtgttcaggaagaagaactatcaaaagattgacgattgtcctaaaatcactctatcttctttacctgatgacacggaggaagagaaggggcccacctttcacaacactcaaaacgttaccggtttagaccatgttcttctctacatggaccgtaccggttctaacatttgcatgcccgagagccaaacaacgactcaacatcaagatgatgtcttattcatgcaactcccaagtcttgagacacctaaatccgagagcccggtcgaccaaagtttcctgactccaagcaaactcgatttctctcccgttcaagagaagataaccgaaagaccggtttgcagcaactgggctagtcttgaccggctcgtagcttggcaattgaacaatggtcatcataatccgtgtcatcgtaagagttttgatgaagaagaagaaaatggtgatactatgatgcagcgatgggatcttcattggaataatgatgataatgttgatctttggagtagtttcactgagtcttcttcgtctttagacccacttcttcatttatctgtatga

SEQ ID NO: 158 - protein, 358 aa, Arabidopsis thaliana
MADNKVNLSINGQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQKIDDCPKITLSSLPDDTEEEKGPTFHNTQNVTGLDHVLLYMDRTGSNICMPESQTTTQHQDDVLFMQLPSLETPKSESPVDQSFLTPSKLDFSPVQEKITERPVCSNWASLDRLVAWQLNNGHHNPCHRKSFDEEEENGDTMMQRWDLHWNNDDNVDLWSSFTESSSSLDPLLHLSV

SEQ ID NO: 159 - DNA, 1095 bp, Arabidopsis thaliana
atgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatggtagtggataa

SEQ ID NO: 160 - protein, 364 aa, Arabidopsis thaliana
MSKSMSISVNGQSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKKNLHKTLNSPVGGASLSGGGDTPKTTSSQIFNEDTLDQFLELMGRSCKEELNLDPFMKLPNLESPNSQAINNCHVSSPDTNHNIHVSNVVDTSFVTSWAALDRLVASQLNGPTSYSITAVNESHVGHDHLALPSVRSPYPSLNRSASYHAGLTQEYTPEMELWNTTTSSLSSSPGPFCHVSNGSG

SEQ ID NO: 161 - DNA, 768 bp, Arabidopsis thaliana
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 162 - protein, 199 aa, Arabidopsis thaliana
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 163 - DNA, 803 bp, Arabidopsis thaliana
cttgtttagggtttcaatctttacagatcttgtggcagaaaaaatcaagtcaaagcaagaaaaatggttagaggaaagatagagatgaagaaaatagaaaacgcaacgagtagacaagtgactttctcaaaaagaagaaatggtttgttgaagaaagcttatgagctctcagtactctgcgatgctcaactctctctcatcatcttctcccagagaggaaggctttatgaattctctagctctgatatgcagaagacgatcgaacgctaccgcaagtacacaaaagatcatgaaaccagcaatcacgactcacaaattcacttgcagcaattgaaacaagaagcaagccacatgataacaaagattgaactccttgagtttcacaagcggaagctattgggacaaggaattgcttcttgttctctagaagagcttcaagaaatcgatagtcaactccaaagaagtctgggaaaggtccgagaaagaaaggctcaattgttcaaggagcagttggagaaactaaaagcaaaggagaaacaattgttagaagagaacgtcaagttacatcaaaagaatgttattaatccatggagaggatcatcgactgatcagcagcaagagaaatacaaagttatagatttgaatttggaagttgaaactgacttattcatcggtttgccaaatagaaactgctagtaacattatataatatgtttatttatttatcatgaaatattcaaaatcattcaataaattgtgaggtaatgatttgggatagtaaaaaaaaaaaaaaaaaaaaaaaa

SEQ ID NO: 164 - protein, 210 aa, Arabidopsis thaliana
MVRGKIEMKKIENATSRQVTFSKRRNGLLKKAYELSVLCDAQLSLIIFSQRGRLYEFSSSDMQKTIERYRKYTKDHETSNHDSQIHLQQLKQEASHMITKIELLEFHKRKLLGQGIASCSLEELQEIDSQLQRSLGKVRERKAQLFKEQLEKLKAKEKQLLEENVKLHQKNVINPWRGSSTDQQQEKYKVIDLNLEVETDLFIGLPNRNC

SEQ ID NO: 165 - DNA, 825 bp, Arabidopsis thaliana
atggaagaagaaggttatcagtgggcaagaaggtgtggaaacaacgccgttgaagatccttttgtttatgagccacctcttttctttctgcctcaagaccaacatcatatgcatgggctcatgccaaatgaagatttcattgccaacaagttcgtcacatcaacactttactccggtccacgaatccaagatattgcaaacgctctggccttggtcgaacccctgacccacccagtccgagaaatctctaaatcaacagttcctcttttggaaagaagtactttgagcaaggtggataggtacactttaaaggtgaagaacaatagtaatggaatgtgtgatgatggatacaaatggagaaaatatggccaaaaatcaatcaaaaatagccctaacccaaggagttattacaagtgcacaaacccaatatgcaatgcaaagaagcaagtggagagatcaattgatgagtctaacacatatatcattacctacgaaggtttccacttccactatacttaccctttcttcctacccgataagacacgtcaatggcccaataaaaaaacgaaaatacataaacataatgctcaagatatgaacaaaaaatctcaaacccaagaagagagcaaagaagcacaattaggtgagctcaccaaccaaaatcatccagtcaataaagcccaagaaaacacaccggcaaatctcgaagagggattgttttttccggttgatcagtgtcggccgcaacaagggcttctagaagatgtggtagctccggcaatgaaaaatattcctaccagggacagtgttttgacagcttcttga

SEQ ID NO: 166 - protein, 274 aa, Arabidopsis thaliana
MEEEGYQWARRCGNNAVEDPFVYEPPLFFLPQDQHHMHGLMPNEDFIANKFVTSTLYSGPRIQDIANALALVEPLTHPVREISKSTVPLLERSTLSKVDRYTLKVKNNSNGMCDDGYKWRKYGQKSIKNSPNPRSYYKCTNPICNAKKQVERSIDESNTYIITYEGFHFHYTYPFFLPDKTRQWPNKKTKIHKHNAQDMNKKSQTQEESKEAQLGELTNQNHPVNKAQENTPANLEEGLFFPVDQCRPQQGLLEDVVAPAMKNIPTRDSVLTAS

SEQ ID NO: 167 - DNA, 2126 bp, Arabidopsis thaliana
gaatttgggggttacacaacttcgtctagatggagcaagagaaaagcttggatccacaactatggcatgcttgtgcaggatcaatggttcaaatcccttcactgaattcaacggttttttacttcgctcaaggccacacagagcacgctcacgcgcctcctgattttcacgcgccgcgcgttccacctcttatcctctgtcgtgtcgtctccgtgaagttcctcgccgacgctgaaacagacgaagtttttgctaaaattacgcttttgccacttccgggaaacgacttggatctagaaaacgacgccgttttgggtctaactcctccttcttctgacggtaacggtaacggtaaagagaaaccggcgtctttcgctaaaacgttaacgcagtctgacgctaataacggcggtggtttctccgttccacgttattgcgccgagacgattttcccgcggcttgattactcggcggagccaccggttcaaaccgtgattgctaaagacatccacggcgagacttggaaattccggcatatttacagaggaacacctcgccgtcatctcctaaccaccggttggagcactttcgttaaccagaagaaactaatcgccggagactcaatcgtcttcctccgttctgaatccggtgacctctgcgtcggaatccgccgcgctaaacgcggcggtctcggatctaacgcaggatccgacaatccttaccctggattctccggtttcctccgtgacgacgagtcaacaacaacaacatcgaagctaatgatgatgaaacgcaacggaaacaacgacggaaacgccgcggctacagggagggttagagtagaagcagtagcggaagcggtggcgcgtgcagcgtgtggacaagcgtttgaggttgtttattatccacgcgctagtacaccggagttttgcgtaaaagcagctgatgttagatcagcaatgaggataagatggtgtagtggtatgcgttttaaaatggcgtttgaaacagaggattcttctagaatcagttggtttatgggtactgtctccgccgttcaagtcgctgatccaattcgttggcctaattcaccatggcgtctccttcaggtagcttgggacgaaccggatttgttacaaaacgttaagcgggttagtccgtggttagtcgaattggtatcgaacatgcctacaatacatttatctccattctctccgaggaagaagattaggattccgcagccatttgagtttccattccacggtactaaattcccgattttctccccgggattcgccaacaatggcggtggcgagtccatgtgttatctgtcaaacgacaacaataatgctcctgcaggaatacagggagccaggcaagctcaacaactcttcggatcaccatctccgtctttgttgtctgatctcaatcttagtagttacaccggtaacaacaagttacattctccggcgatgtttctatcgagtttcaacccgaggcatcatcattatcaggctagggatagtgagaatagtaataacatttcgtgttctttaactatggggaatcctgctatggttcaggataagaagaagtctgttggttcggttaagactcatcagttcgtgttgttcggtcaaccgattttaaccgaacagcaagttatgaaccgaaaacggtttttggaagaagaggcggaagcggaggaggagaaaggtttagtggctcgtgggttaacatggaattatagtttgcaaggacttgagacgggtcattgtaaagttttcatggaatctgaggatgttggacgcacactcgatctctcggttattggctcgtaccaagaattgtaccggaaattggctgagatgtttcatatagaagagaggtcggatttgttgactcatgttgtgtaccgggatgcaaatggtgttatcaaacgtattggagacgaacctttcagtgatttcatgaaagcaactaaacggctaacaatcaagatggatattggtggcgacaacgtgagaaagacgtggataaccggaatcaggactggtgaaaatggtatagacgcttctacgaagactggtccgctcagcatcttcgcttgaacttgaagcatattg

SEQ ID NO: 168 - protein, 693 aa, Arabidopsis thaliana
MEQEKSLDPQLWHACAGSMVQIPSLNSTVFYFAQGHTEHAHAPPDFHAPRVPPLILCRVVSVKFLADAETDEVFAKITLLPLPGNDLDLENDAVLGLTPPSSDGNGNGKEKPASFAKTLTQSDANNGGGFSVPRYCAETIFPRLDYSAEPPVQTVIAKDIHGETWKFRHIYRGTPRRHLLTTGWSTFVNQKKLIAGDSIVFLRSESGDLCVGIRRAKRGGLGSNAGSDNPYPGFSGFLRDDESTTTTSKLMMMKRNGNNDGNAAATGRVRVEAVAEAVARAACGQAFEVVYYPRASTPEFCVKAADVRSAMRIRWCSGMRFKMAFETEDSSRISWFMGTVSAVQVADPIRWPNSPWRLLQVAWDEPDLLQNVKRVSPWLVELVSNMPTIHLSPFSPRKKIRIPQPFEFPFHGTKFPIFSPGFANNGGGESMCYLSNDNNNAPAGIQGARQAQQLFGSPSPSLLSDLNLSSYTGNNKLHSPAMFLSSFNPRHHHYQARDSENSNNISCSLTMGNPAMVQDKKKSVGSVKTHQFVLFGQPILTEQQVMNRKRFLEEEAEAEEEKGLVARGLTWNYSLQGLETGHCKVFMESEDVGRTLDLSVIGSYQELYRKLAEMFHIEERSDLLTHVVYRDANGVIKRIGDEPFSDFMKATKRLTIKMDIGGDNVRKTWITGIRTGENGIDASTKTGPLSIFA

SEQ ID NO: 169 - DNA, 874 bp, Arabidopsis thaliana
tttttcttttgattctgcttttttccgctaggtttctgagatcttccattcgtctcgaattaagttgctacgatgaaaacagcaaaggggaaagataaagttaagaccacaaaggaagccttgaagccagttgatgacagaaaggtgggaaagaggaaggcaccggctgagaagcctactaaacgagagactcgtaaagagaagaaggctaaaaaggacccaaacaaaccaaaaagagctcctagtgccttctttgtctttctagaagattttagggtcacgttcaagaaagaaaatccaaatgtgaaggccgtctctgctgttgggaaagctggagggcagaaatggaagtcaatgtctcaagctgaaaaagctccatatgaagagaaagctgcaaaaaggaaagctgaatatgagaagcaaatggatgcatacaacaaaaacttggaggaagggagtgatgaatctgaaaagtctagatctgagataaatgatgaagatgaagccagtggggaggaagaactattagagaaggaagcggcaggtgatgatgaagaagaagaagaggaagaagatgtcgatgatgatgacgacgaggaagaagactaaatcagggatagaaatcagattttgtatctcaagcttaactgcagatccttaagcagaagtaagtattttgtaatttgtgtgtggacgagaactatagatctaaaatcgtgtgtttttttgtttttcttttcctaagaaagcgaaacagttgttagcatctctcaggatgtctgtttcagctttttgccgcaacaaacaatgtatcaatgtctgcgttagtgatcatccaaaccaaaacataaactaatgaacatataaaaaaaaa

SEQ ID NO: 170 - protein, 178 aa, Arabidopsis thaliana
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKSMSQAEKAPYEEKAAKRKAEYEKQMDAYNKNLEEGSDESEKSRSEINDEDEASGEEELLEKEAAGDDEEEEEEEDVDDDDDEEED

SEQ ID NO: 171 - DNA, 1722 bp, Arabidopsis thaliana
atgactgttgaacaaaatttagaagctttggatcagtttcctgtaggaatgagagttcttgctgttgatgatgaccaaacttgtctcaaaatccttgaatctctccttcgtcactgccaataccatgtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataatgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatccgaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagaaggctatgcctaaaaagattttggatctgatgaatgttgagaagctcactagagaaaatgtggccagtcatcttcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatagctcttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtga

SEQ ID NO: 172 - protein, 573 aa, Arabidopsis thaliana
MTVEQNLEALDQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVRSRFDKNRGSNNNGDKRDGSGNEGVGNSDPNNGKGNRKRKDQYNEDEDEDRDDNDDSCAQKKQRVVWTVELHKKFVAAVNQLGYEKAMPKKILDLMNVEKLTRENVASHLQKFRLYLKRISGVANQQAIMANSELHFMQMNGLDGFHHRPIPVGSGQYHGGAPAMRSFPPNGILGRLNSSSGIGVRSLSSPPAGMFLQNQTDIGKFHHVSSLPLNHSDGGNILQGLPMPLEFDQLQTNNNKSRNMNSNKSIAGTSMAFPSFSTQQNSLISAPNNNVVVLEGHPQATPPGFPGHQINKRLEHWSNAVSSSTHPPPPAHNSNSINHQFDVSPLPHSRPDPLEWNNVSSSYSIPFCDSANTLSSPALDTTNPRAFCRNTDFDSNTNVQPGVFYGPSTDAMALLSSSNPKEGFVVGQQKLQSGGFMVADAGSLDDIVNSTMKQV

SEQ ID NO: 173 - DNA, 2684 bp, Arabidopsis thaliana
gggtttggaatcatattattgagtgttatgggttgtacaagttctaagcttgacgatcttccggcggttgctctttgccgtgaacgctgtgctttcttagaagctgctattcatcaacgttacgctttagctgaatcacacgtggcttacactcattcgcttcgagaaatcggtcactctctccatcttttcatcaatcaccaccaccgtttcgtcgcttccggcggcgctaacgtcggtgattctcctcgacttaatcttcctcctcagagaaaaggtgaccttgacgacgaagcaacaaattccccaaaaaaacaaaagcttgcttcttctcaccacaaccacaaccacgctcactcgggttccggttctgattcgggtcatctcgaattcgattcagattccgacgaagatgaagaagacgacgacgacttggatttggattcgttgcatcaccactctcctccccaccaccatctcggcaatttccctattcccgaatcagcaccaatgggcggatacatggaacaacaaccgggttatataaacccgtacccgaatccagatatgatggggcatccttactctggaggaggaagttatatgcacatgaattacatgaagaacaaatccatgcctccttcagttgtctatgagcaaagaccaactagtcctcaacgagtctacataggcgaatcatcatcttcatatccatatcctcctcaaaattcatattttggatactcaaatccagtacccggacccggaccaggatactacggttcttcttctgcttctacaactgctgcagcaacaaaaccgccaccacctccaccgtcgccgcctaggtctaacggttgggattttttgaatccctttgatacttattatcctccgtatactccgagtcgagattcgagagagttaagagaagaagaaggtataccggatttagaagacgatgattcacattacgaagttgttaaagaagtttacggcaaaccaaaattcgccgccggtggtggtcaccaaccaaatcccgccgccgtacacatgatgagggaagagtccccgtctccgccgcttgataaatccggtgctagtactagcggtggaggtgatgtcggagatgcatctgcgtatcagtctagaccaagtgtgtcggtggagaaagaagggatggagtatgaagttcacgttgttgagaagaaggttgttgaagatgaggaacggcggagtaatgccacggcgacacgtggtggtggtggaggaggagggccacgtgcggtgcctgaagttgcgaaagagattgagaatcaattcgtgaaagctgcagagtcaggaagtgagattgctaagttacttgaagttgggaagcatccttatggtcgtaaacatgctgcttcgaagatgttgcacggtgttactccttcgttaccttctacctctggaggaacttcttcgtctgctgctgctgctgttgtgccacctacttatgcagatattgaagaagagcttgcttcgaggtcgaggaatctttcttcgacgttgcacaagctccatctttgggagaagaagctttatcatgaagtcaaggccgaggagaaactgcgtctagctcacgagaaaaagcttaggaagctaaagcgtttggatcaaagaggtgccgaggctatcaaagtagataaaacgcggaaattagtgagagatatgtccacaaaaatacggattgcgattcaggttgtcgacaaaatatccgtgacgattaataagataagagacgaagacctgtggccgcaactgaatgcattgattcaagggcttacaagaatgtggaaaacaatgcttgaatgtcatcaaagtcaatgtcaagctattagggaagcacaaggtttaggcccgataagagcaagcaagaaactaggcgatgaacatctagaagcgacgagtttgcttggacatgaacttattaattggatattgggattctctagctgggttagtgcgcagaagggttatgtaaaagagttgaataaatggctcatgaaatgtcttctgtatgaacctgaggaaacacctgatgggatagttcccttttcacctggtaggattggggctccacctatctttgtcatctgtaaccaatggtctcaagctctggataggatatctgagaaggaagttattgaggcaatgcgtagtttcactacaagtgtgcttcagctttgggaacaagatcggttagatacgatgatgacggggcatggtgattcagagaagaaagtcaggaacatggacagagaagaacagaggatacagagagagattcaagcattggaaaagaaaatgattcttgtggcaccgggtgatggtaacagtctttcgatatccggcaacgttgtttaccaaagcgatactagcagcgatagtttacaaggtagtttgcaacggatttttgaagctatggagagattcactgctgaatcgatgagagcttatgaggatctcttagagcgcaccaatgaagaaactgcaccacgggaacttgaggaagaagaggaggagtaaaaaagcaaaacaggaagaagaggtttgcttgtcaattcaatttgaatcccatgatcgagctgtttgctgatcttgcaatgccagaatactcggttttgcgcgtctgagactcgggc

SEQ ID NO: 174 - protein, 846 aa, Arabidopsis thaliana
MGCTSSKLDDLPAVALCRERCAFLEAAIHQRYALAESHVAYTHSLREIGHSLHLFINHHHRFVASGGANVGDSPRLNLPPQRKGDLDDEATNSPKKQKLASSHHNHNHAHSGSGSDSGHLEFDSDSDEDEEDDDDLDLDSLHHHSPPHHHLGNFPIPESAPMGGYMEQQPGYINPYPNPDMMGHPYSGGGSYMHMNYMKNKSMPPSVVYEQRPTSPQRVYIGESSSSYPYPPQNSYFGYSNPVPGPGPGYYGSSSASTTAAATKPPPPPPSPPRSNGWDFLNPFDTYYPPYTPSRDSRELREEEGIPDLEDDDSHYEVVKEVYGKPKFAAGGGHQPNPAAVHMMREESPSPPLDKSGASTSGGGDVGDASAYQSRPSVSVEKEGMEYEVHVVEKKVVEDEERRSNATATRGGGGGGGPRAVPEVAKEIENQFVKAAESGSEIAKLLEVGKHPYGRKHAASKMLHGVTPSLPSTSGGTSSSAAAAVVPPTYADIEEELASRSRNLSSTLHKLHLWEKKLYHEVKAEEKLRLAHEKKLRKLKRLDQRGAEAIKVDKTRKLVRDMSTKIRIAIQVVDKISVTINKIRDEDLWPQLNALIQGLTRMWKTMLECHQSQCQAIREAQGLGPIRASKKLGDEHLEATSLLGHELINWILGFSSWVSAQKGYVKELNKWLMKCLLYEPEETPDGIVPFSPGRIGAPPIFVICNQWSQALDRISEKEVIEAMRSFTTSVLQLWEQDRLDTMMTGHGDSEKKVRNMDREEQRIQREIQALEKKMILVAPGDGNSLSISGNVVYQSDTSSDSLQGSLQRIFEAMERFTAESMRAYEDLLERTNEETAPRELEEEEEE

SEQ ID NO: 175 - DNA, 909 bp, Arabidopsis thaliana
atggtgcagcctggaaccgagataaaagcaagcgacctaaccctactagtaatcacgattatactcttcgcaatcttcatcgttggcttggcttcggtttgcttccgctggacctctcgccaattttactcacaagaatccatcaaccctttcactgactccgacgttgaatcccgtacgagtattacggcggtgcgtgggctcgacgaggctatcatcaactcatttccgacgtttctctactcggaggtgaaggagcggagaatcgggataggtggcgtcgagtgtgcagtgtgtatctgtgagttcgaagaccatgaaacgctccgtttgatgcctgaatgctgccacgtgtttcatgctgattgtgtaagtgtctggctctctgatcactccacgtgtccactctgtcgtgtggatctttgcttacaaccgggtgagagaagctacttgaatccggaaccggatcttgtagaatctacaaactcgcatttgtttgatggtgtgacgtggaccaataggaacagaccgtctcggtcatggtcaacgagattgtctcaatgtcgagtctcccagatattaatctcgagatcgcattcgaccggacattctgtggttcaaccgctagataatttagaccggtttacgcttcggttaccagaagaagtccggaggcaactgacgaaaaaaacggtggacaacgtggcattttctcaggctaggagctcacggcgtggttacagaagcagaagtgccggaagcgagaggagtgtcttctcgtaccaacggcggatgcattccttctctgattgtgcatggtccacctcctgtggcggagaagcggtggctccgtcaaaggattcccgccgaatatcagttgaacaatcccagctagatgatcgagtgtag

SEQ ID NO: 176 - protein, 302 aa, Arabidopsis thaliana
MVQPGTEIKASDLTLLVITIILFAIFIVGLASVCFRWTSRQFYSQESINPFTDSDVESRTSITAVRGLDEAIINSFPTFLYSEVKERRIGIGGVECAVCICEFEDHETLRLMPECCHVFHADCVSVWLSDHSTCPLCRVDLCLQPGERSYLNPEPDLVESTNSHLFDGVTWTNRNRPSRSWSTRLSQCRVSQILISRSHSTGHSVVQPLDNLDRFTLRLPEEVRRQLTKKTVDNVAFSQARSSRRGYRSRSAGSERSVFSYQRRMHSFSDCAWSTSCGGEAVAPSKDSRRISVEQSQLDDRV

SEQ ID NO: 177 - DNA, 1511 bp, Arabidopsis thaliana
gtgtggtatgcgcaaagtggacaatacctagatgggtgtttctcttctgaaacaacaacatcgtattacaaatcaagctgatactttttctagattcatggaaagatcaccagagaataatctaagcagaaatgagcacatcatcattgacattccaagaaatgccgccattgcatcatcatcatcttctcatgatagaatctcaaatgttttggaacctttacaacatgaggaagagagaccttctactgtttctcccatggctgctcctcagccagctacagctacagcttcttcttcttcttctatgcgatcaaatcctagaagtgtccgtcgtagaagaagtcctttgaattctggcttatggatttctattgaactattcctcactgttggtcagatcattgcagctattgtcgttttgtctttgtcaaaacatgagcatcctcgtgctcctttgttcacttggattgttggttatgcgtgtggatgcgttgctacactcccgcttttgtactggagatattatcattcgaatcaggcttctgaacaggattctggtcagcaccgtcctaatcttaatgttgcagcaggaccattcgccttctcgatatccaggacatccgaagcagatggtcgacagaccaataccacctcttctcgtggtagtagatatcctgggtttataagtgctgccagacttaaagttatcgtggaatacttcaaaatggctctggattgcttctttgcggtgtggtttgtggtaggtaatgtatggatatttggagggcattcatctgctgccgaggctcctaacttgtacaggttatgtttagtgtttcttacctttagctgtattggctacgcgatgcccttcatcctctgtacaacaatatgttgctgcttgccttgcataatctcaattctcggatatagagaagatttaacgcaacctcgaggtgccacacctgagtcgattaatgcgttgccgactcataaatttaagttgaagaaaagcagaagtaatggcgatgacaatggttcaagtactagcgaaggtggagttgtggcggctggaacagataacgaacgagctatttcaggagaggacgcagtctgttgcatttgcttagcgaaatatgcgaataacgaggagttaagagagcttccatgctcacatttcttccacaaagagtgcgttgacaaatggctgaagatcaatgcctcttgccctctatgcaagagcgaagttggggagaagaactctgatttgactagccaagggatcttaacctcgctctcttctggggaaaacgataaccatcaacaacagcaacaacaacaacggagtgaacttagagttgagaatggtttggccaataatgttatctagatcttcgagatttgctctatgtccgagaaaacggcaaattagccgtttggcgatgttcctacacaaaatggggtttgcttctcattgctaagaaggtgaagaaagacacggcgaagat

SEQ ID NO: 178 - protein, 453 aa, Arabidopsis thaliana
MGVSLLKQQHRITNQADTFSRFMERSPENNLSRNEHIIIDIPRNAAIASSSSSHDRISNVLEPLQHEEERPSTVSPMAAPQPATATASSSSSMRSNPRSVRRRRSPLNSGLWISIELFLTVGQIIAAIVVLSLSKHEHPRAPLFTWIVGYACGCVATLPLLYWRYYHSNQASEQDSGQHRPNLNVAAGPFAFSISRTSEADGRQTNTTSSRGSRYPGFISAARLKVIVEYFKMALDCFFAVWFVVGNVWIFGGHSSAAEAPNLYRLCLVFLTFSCIGYAMPFILCTTICCCLPCIISILGYREDLTQPRGATPESINALPTHKFKLKKSRSNGDDNGSSTSEGGVVAAGTDNERAISGEDAVCCICLAKYANNEELRELPCSHFFHKECVDKWLKINASCPLCKSEVGEKNSDLTSQGILTSLSSGENDNHQQQQQQQRSELRVENGLANNVI

SEQ ID NO: 179 - DNA, 499 bp, Arabidopsis thaliana
ctttctctcacactcatgggtcttccaacagatttcaaagagcttcagattccaggttacgtactaaaaacactttacgtcatcggtttctttagagacatggtcgatgctctttgtccttacatcggtctaccaagttttcttgaccacaacgagacctctcgatccgacccgacccgactcgctctctccacgtcagcaactcttgccaacgagttaatcccggtggttcgtttctccgatcttttaaccgatccggaagattgctgcacggtttgcttatccgattttgtatccgacgataagattagacagctgccgaagtgtggacacgtgtttcatcatcgttgtttagaccgttggatcgttgactgtaataagataacgtgcccgatttgtcggaaccggttcttaccggaggaaaagtccacgccgtttgattggggtacttcagattggtttagagatgaagtggagagtaccaactaataatgatggt

SEQ ID NO: 180 - protein, 157 aa, Arabidopsis thaliana
MGLPTDFKELQIPGYVLKTLYVIGFFRDMVDALCPYIGLPSFLDHNETSRSDPTRLALSTSATLANELIPVVRFSDLLTDPEDCCTVCLSDFVSDDKIRQLPKCGHVFHHRCLDRWIVDCNKITCPICRNRFLPEEKSTPFDWGTSDWFRDEVESTN

SEQ ID NO: 181 - DNA, 1556 bp, Arabidopsis thaliana
atggaggagagagaaggaactaacatcaacaacatcccaaccagttttggtctgaaacaacatgaaactcctcttcctcctcctggttacccaccacggtctgaaaaccctaatctttttccggtgggtcaatccagcacttcctccgccgccgccgcggtgaaaccttctgagaatgttgctcctccttttagcttaacaatgccggtggagaattcttcttctgagttgaagaagaagagagggagaccaagaaagtataaccctgacggctcactcgctgtgactctctctcctatgcctatctcatcctccgttccgttgacgtcggagtttggttctcggaaacgaggaagaggtcgaggaagaggcagaggaagaggacgaggacgtggacaaggacaaggaagcagagagcccaataacaacaacaacgacaacaattggctcaagaatcctcagatgttcgaatttaacaacaacactcctacttctggtggaggaggacctgctgaaattgtcagtccaagttttacacctcatgtgctcacagtaaatgccggtgaggatgtgacaatgaagataatgacattctctcaacaaggctcgcgtgctatttgtattctttcagcgaacggtcccatatccaatgttacacttcgtcaatctatgacatctggtggtactctcacttatgagggtcattttgagattctttctttgacgggttcgtttataccaagcgagagtggaggaacccgaagcagagctggtgggatgagtgtctctcttgcaggacaagatggtcgtgtctttggtggtggacttgctggtctctttattgccgctggtcctgttcaggtaatggtagggagttttatagcgggtcaggaggaatcgcagcagcagcagcagcagataaagaagcaaagaagggaaagactcgggatcccgacaacaacacaagcttctaatatctcattcggtggctcagcggaagatcctaaggctagatacgggctcaacaagcctgttgttattcagccaccaccggtgtctgcaccacctgtgtccttttcgcatgaaccaagtactaacaccgtccatggttactatgcaaataacacagctaaccatatcaaggatctcttctcttccctccctggagaagatagggaagaagatgaggatgatttagaaggtgaagatgatgaagaattcggaggccatagcgaatctgacaccgaggttccaagctgatgatcgatggaaagaatccgacatatatgtgttatgaatcttgagttgttttatttcggtgtcttcagatttttttagagcgtaatggtattttttttctttcagattgttagttgttaaagtcttaaacagagatatttcactaaaagttagggtttactagaggatgtaatctttagggttctttgacttgtgtctttcttttaatcctcagatggttgttgtaggcttgtagccaatcttagtgtgtgttcaaactctctccttcaatcaaactccccaatgacttcattttg

SEQ ID NO: 182 - protein, 419 aa, Arabidopsis thaliana
MEEREGTNINNIPTSFGLKQHETPLPPPGYPPRSENPNLFPVGQSSTSSAAAAVKPSENVAPPFSLTMPVENSSSELKKKRGRPRKYNPDGSLAVTLSPMPISSSVPLTSEFGSRKRGRGRGRGRGRGRGRGQGQGSREPNNNNNDNNWLKNPQMFEFNNNTPTSGGGGPAEIVSPSFTPHVLTVNAGEDVTMKIMTFSQQGSRAICILSANGPISNVTLRQSMTSGGTLTYEGHFEILSLTGSFIPSESGGTRSRAGGMSVSLAGQDGRVFGGGLAGLFIAAGPVQVMVGSFIAGQEESQQQQQQIKKQRRERLGIPTTTQASNISFGGSAEDPKARYGLNKPVVIQPPPVSAPPVSFSHEPSTNTVHGYYANNTANHIKDLFSSLPGEDREEDEDDLEGEDDEEFGGHSESDTEVPS

SEQ ID NO: 183 - DNA, 2215 bp, Arabidopsis thaliana
caatcactaaacgccatttgcttagctttttccctcttttgatttttcctccctacacgtcacctctctcttcttctcaccggaaaaaagtcttcacctttcaccggaaaatatcaccttttcaaccggcgtatgttcacatgaacggcacaacatcatcaatcaacttcttgacctccgacgatgacgcgtcggcggcggctatggaagctttcattggaacaaaccaccactcatctctctttcctccaccaccacaacaaccacctcagcctcagttcaacgaagatactcttcaacaacgtctccaagctttaatagaatccgccggagaaaactggacttacgctatcttctggcagatctcacacgacttcgattcatccaccggagataacacagtgatcctcggctggggagatggttactacaaaggagaggaagataaagagaagaagaagaacaacaccaacacggcggagcaagagcatcggaaaagagtaatacgtgagcttaactcgttaatctccggcggaattggggtttccgatgaatcaaacgatgaagaagtaacagatactgaatggttcttcttagtttcgatgactcaaagcttcgttaacggtgttggtctccccggagaatctttcttaaactctcgtgtgatttggttatccgggtctggtgctttaaccgggtcgggttgtgaaagagcgggtcaaggtcagatttacgggttaaagacgatggtgtgtatcgcgactcaaaacggcgtcgttgagcttggttcgtcggaggttataagtcaaagctcagatctgatgcataaagttaacaacttgtttaatttcaacaacggtggtggaaacaatggtgttgaagcttcttcgtggggttttaatctgaatccagatcaaggagagaatgatccagctttgtggattagtgaaccgacgaacaccggaatcgaatctccggcgagggttaataatggtaataactcgaattctaattctaagtctgattctcatcaaatttctaagcttgagaagaatgatattagctctgtagagaatcagaatcgtcaaagttcgtgtcttgtcgagaaagatttgacctttcaaggtgggttgttgaaatctaatgagactttgagtttctgtggtaatgagagtagtaagaagagaacttcggtatctaaagggagtaataatgatgaagggatgctttcgtttagtactgtggttagatcagctgcgaatgattcggatcattctgatcttgaagcatctgttgttaaggaagcgattgttgttgagccaccggagaagaagccgaggaaacgggggaggaaaccggcgaatgggagagaagagccgttgaatcatgttgaagcagagaggcagagaagagagaagttaaaccagagattctactctttgagagctgttgttcctaacgtttcgaagatggataaagcttcgcttctcggagacgcgatttcgtatatcaatgagcttaagtcgaagctgcagcaagcggagtctgataaagaggagattcagaagaagctagatgggatgagtaaggaagggaataatgggaaaggttgcgggtcaagggcaaaagaacggaaaagttcgaatcaagattctacggcgagttctatagaaatggagattgatgttaagatcataggttgggatgtgatgatacgtgtacaatgcggcaagaaagatcatcccggtgctaggttcatggaagcacttaaggaattggatttggaagtgaatcatgcgagtttatccgttgtgaatgatttgatgattcaacaagctacggtgaagatggggagccaatttttcaatcatgaccagctcaaagttgctttgatgacgaaagtcggagaaaactattgaacaaagttggcatatcaaagaggggaaactagtgttttcatcgatgaaatgggatcgaatttagcgggtaatgtatggtcttttgtaaagtagtaagtactcattttgcatcactcgcttcatgttgttaaatgttgttgttcattaggagaacttgcttagttcttagcttagtgttatcataagccttaagtgagaaggaagttggagactagaagaccagagagagttagcgaaataataaaatctttggttgtacttgtatgtatatatatgtatggagtaagattaagtga

SEQ ID NO: 184 - protein, 592 aa, Arabidopsis thaliana
MNGTTSSINFLTSDDDASAAAMEAFIGTNHHSSLFPPPPQQPPQPQFNEDTLQQRLQALIESAGENWTYAIFWQISHDFDSSTGDNTVILGWGDGYYKGEEDKEKKKNNTNTAEQEHRKRVIRELNSLISGGIGVSDESNDEEVTDTEWFFLVSMTQSFVNGVGLPGESFLNSRVIWLSGSGALTGSGCERAGQGQIYGLKTMVCIATQNGVVELGSSEVISQSSDLMHKVNNLFNFNNGGGNNGVEASSWGFNLNPDQGENDPALWISEPTNTGIESPARVNNGNNSNSNSKSDSHQISKLEKNDISSVENQNRQSSCLVEKDLTFQGGLLKSNETLSFCGNESSKKRTSVSKGSNNDEGMLSFSTVVRSAANDSDHSDLEASVVKEAIVVEPPEKKPRKRGRKPANGREEPLNHVEAERQRREKLNQRFYSLRAVVPNVSKMDKASLLGDAISYINELKSKLQQAESDKEEIQKKLDGMSKEGNNGKGCGSRAKERKSSNQDSTASSIEMEIDVKIIGWDVMIRVQCGKKDHPGARFMEALKELDLEVNHASLSVVNDLMIQQATVKMGSQFFNHDQLKVALMTKVGENY

SEQ ID NO: 185 - DNA, 1037 bp, Arabidopsis thaliana
attaattaacaaaaaaccaaaagaaggcggcgcaaacaaaagataatgcaaccagagacctcagatcagatgttgtactcgtttcttgccggaaacgaagtcggcggtggagggtactgcgtctccggcgactacatgacgactatgcagagcttatgtgggtcttcgtcgtcgacgtcatcgtattacccactggcgatctccggcatcggagaaacgatggctcaagacagagctttagctgctttgaggaaccacaaagaagctgagagaagaaggagagagaggatcaattctcatctcaacaagcttcgtaacgtactctcttgtaattctaagaccgataaagccacactgctcgccaaagtagttcaacgagtcagagaacttaaacagcaaaccctagagacctccgactccgaccaaacattattaccatcagagaccgacgaaattagtgttctacactttggagactattcaaacgacggtcatataatcttcaaagcctctctatgttgtgaagatagatcagatctcttgccggaccttatggagattctcaagtctcttaacatgaagactctccgagctgagatggtaaccattggtggtcggacaagaagtgttcttgtcgtagctgctgacaaagagatgcacggcgtcgagtctgtgcattttttgcaaaatgctctcaagtcgctgcttgagcggtcaagcaagtcgttgatggaacgtagttctggtggtggaggaggagaacggtcaaagcggcgtcgtgcgctggatcacatcataatggtgtgaaatgatgagaattgagcacactaaaaagtctataattgattaatatatatagggtatgatcataattaacttggttataattaccaaaaccttttttattcctctttaataatatatatgttatatggttttagttactaagtcttgggagtgtaagcaaatgttgtaagtaggtttggtgtgttctttttcttttcttttttttttctttttcaaaaaaaaaaaaaaaa

SEQ ID NO: 186 - protein, 253 aa, Arabidopsis thaliana
MQPETSDQMLYSFLAGNEVGGGGYCVSGDYMTTMQSLCGSSSSTSSYYPLAISGIGETMAQDRALAALRNHKEAERRRRERINSHLNKLRNVLSCNSKTDKATLLAKVVQRVRELKQQTLETSDSDQTLLPSETDEISVLHFGDYSNDGHIIFKASLCCEDRSDLLPDLMEILKSLNMKTLRAEMVTIGGRTRSVLVVAADKEMHGVESVHFLQNALKSLLERSSKSLMERSSGGGGGERSKRRRALDHIIMV

SEQ ID NO: 187 - DNA, 2973 bp, Arabidopsis thaliana
atggaagaaaaaactcatcatcatcatcacagtaccaacaaacacatccctagttccaaatcaagaacacctcttctccacaagccttatcatcaccatgttcaaaccaatcctcctccttttcttttgcacccttcttctcaccaaaacctcaatcttgttgcctcaaatcttccttctagctactactactattactactgctacttctactctcaatttcacaactctcttcctcctcctcctcctcctcatcttcttcctctttctcctcctcttcctcctttacttcctcttcctcctcctcactcaatgacccgtttccacaaatctctccctgtttctcaagttgtggagagaaagcagcaacaccaacagaagaagaagatacaagtttctaacaacaaagtgagtggatccatagcaatagaagaagcagcattagtggttgctaaaagaccggactttggtggtcaagatggttctgtcatttatctcctcgccaaccattttcttgtcaagtttgattcgtcacagaggatttaccattacaatgttgagatatctccacagccttcaaaggaaattgctagaatgatcaaacagaagcttgttgagacagatcgtaatagcttctctggtgttgttccggcttttgacggcaggcaaaacatttacagccctgtggagtttcagggagataggcttgagttctttgttaatctccctatcccatcttgcaaggctgtgatgaattacggtgacttgcgtgagaagcaacctcagaagaagattgagaaactgtttagggttaatatgaagcttgtgtccaagtttgatggtaaagaacagagaaaggaaggagaggattgggctcctctgcctccagaatacattcatgctcttgatgttatcttgagagagaatccaatggagaagtgtacatcgatcggaagatcgttttactcgagttctatgggtggatctaaggagattggaggaggagctgttggactcagagggtttttccagagtcttagacatactcagcaaggtttagcacttaacatggatctctcaatcacagctttccatgaaagtattggagtaatagcttacttgcagaagcggctcgagtttcttacggaccttcctaggaacaaaggtagagaattgagtttagaggaaaagagagaagtggagaaagcacttaagaacataagagtctttgtttgccatagagaaacagttcaaaggtatcgagtttatgggttaacagaggaaattacggagaatatatggtttcctgatagagaagggaaatatctaaggcttatgagttacttcaaagatcattatggttatgagattcagttcaagaacttgccgtgtctgcaaatcagtagggcaagaccttgttaccttcctatggagctatgcatgatttgtgaaggtcaaaagtttcttggaaagctatcagatgatcaagctgcaaagatcatgaaaatgggctgccaaaaacctaatgaaaggaaagctattattgataaggttatgacaggatcggtcggtccatcgagcggaaaccaaacaagagaattcaaccttgaggtttcaagagaaatgacattgctgaaaggaagaatacttcagccaccaaagcttaaacttgaccggccaaggaaccttaaagaaagtaaagtttttaaaggaactagaattgagagatgggctttgatgagtattggaggcagctctgatcagaaatctaccattcccaagttcataaacgagcttactcaaaagtgtgagcatttgggagtcttcttaagcaagaacacattaagcagtaccttctttgaaccatcacacatactcaacaacatttcgcttctcgaatcaaaactgaaggagattcaaagagcggcatcgaacaatctccagctgattatttgtgtaatggagaaaaaacataaagggtacggagatctaaagaggatatcagagacaagaattggtgttgtgacacaatgctgcttataccctaacatcactaagctcagttctcagttcgtttcgaacttagctctcaagataaacgccaagatcggtggatccatgaccgagctctacaactcgataccttctcacatccctagactgcttagacccgatgagccggttatcttcatgggagctgatgtaacgcatcctcatccattcgatgattgtagcccttcagtagcggctgtggtagggagcataaactggccagaagctaaccgatacgtctcaagaatgaggtctcagactcataggcaagagatcatacaagatcttgacttgatggtcaaggaacttcttgatgatttttacaaagcggtaaaaaagcttccgaatcgaatcatattcttcagggacggtgttagcgagacacagttcaagaaagttctccaagaagagcttcaatcgataaaaactgcttgttcgaagttccaagattacaatccaagcatcacattcgccgtggttcagaaaagacaccacacaaggctgttccggtgcgatccagaccatgagaacatacctcctggtacagtggttgatacagtgataactcatccgaaagagtttgatttttatctctgtagccatttaggagtgaagggcacgagcaggccaacgcattaccatattctatgggacgagaacgagttcacttcagacgaattgcagagacttgtgtataatttgtgttacactttcgtgaggtgcacgaaacctatatcgattgtgccaccggcttattatgctcaccttgctgcgtacagaggaaggctatacatcgagagatcatctgaatctaatggaggatccatgaatccttcttctgtgtctcgtgttggtcctccaaagacgattcctcttcctaaattaagtgataatgtcaagaatctcatgttttactgctga

SEQ ID NO: 188 - protein, 990 aa, Arabidopsis thaliana
MEEKTHHHHHSTNKHIPSSKSRTPLLHKPYHHHVQTNPPPFLLHPSSHQNLNLVASNLPSSYYYYYYCYFYSQFHNSLPPPPPPHLLPLSPPLPPLLPLPPPHSMTRFHKSLPVSQVVERKQQHQQKKKIQVSNNKVSGSIAIEEAALVVAKRPDFGGQDGSVIYLLANHFLVKFDSSQRIYHYNVEISPQPSKEIARMIKQKLVETDRNSFSGVVPAFDGRQNIYSPVEFQGDRLEFFVNLPIPSCKAVMNYGDLREKQPQKKIEKLFRVNMKLVSKFDGKEQRKEGEDWAPLPPEYIHALDVILRENPMEKCTSIGRSFYSSSMGGSKEIGGGAVGLRGFFQSLRHTQQGLALNMDLSITAFHESIGVIAYLQKRLEFLTDLPRNKGRELSLEEKREVEKALKNIRVFVCHRETVQRYRVYGLTEEITENIWFPDREGKYLRLMSYFKDHYGYEIQFKNLPCLQISRARPCYLPMELCMICEGQKFLGKLSDDQAAKIMKMGCQKPNERKAIIDKVMTGSVGPSSGNQTREFNLEVSREMTLLKGRILQPPKLKLDRPRNLKESKVFKGTRIERWALMSIGGSSDQKSTIPKFINELTQKCEHLGVFLSKNTLSSTFFEPSHILNNISLLESKLKEIQRAASNNLQLIICVMEKKHKGYGDLKRISETRIGVVTQCCLYPNITKLSSQFVSNLALKINAKIGGSMTELYNSIPSHIPRLLRPDEPVIFMGADVTHPHPFDDCSPSVAAVVGSINWPEANRYVSRMRSQTHRQEIIQDLDLMVKELLDDFYKAVKKLPNRIIFFRDGVSETQFKKVLQEELQSIKTACSKFQDYNPSITFAVVQKRHHTRLFRCDPDHENIPPGTVVDTVITHPKEFDFYLCSHLGVKGTSRPTHYHILWDENEFTSDELQRLVYNLCYTFVRCTKPISIVPPAYYAHLAAYRGRLYIERSSESNGGSMNPSSVSRVGPPKTIPLPKLSDNVKNLMFYC

SEQ ID NO: 189 - DNA, 2721 bp, Arabidopsis thaliana
atggattctggagttaaattggagcatatgaattgtttccaattatcttatcaatattcgtggacgactaggaagaagagaactctgaaaccattcatgtcaaaaggttctagccctagtagtagtagtgatagtaggaaacggaagctttcgagagctgaagatagcgatgattcagcggttaaacggaatgcgaaacgaaggagaaagatatgcaaagtagaagaatattatgaagatgatgattgcatattaagtgattgggttcagaggaatactgcgaaaaggattgataagcgcaacgaagaagttgaagttatggttaagatagagtcaggtgatgattgcacaataggtaagtggttttctgatgttagtagtaaaaggaaagataaacgacaagtagaagttgatgaagatgaggaatgggaagaagaagttacactgtgttctaagatcaaggcaacgtcgtcgcgaagcagaacccatagtttaagtgctaacagtccagaaaatgttacagatgttattagtccttgtcgttcacggtctccagcttctaatgtatcagattccattcagaaaaatgactgcaccagtagtagaaaacagagtggcccaatttgtcatcagtgcttgaaaggggaaaggataacacttctcatttgtagtgaatgtgagaagacaatgttttgtcttcaatgtataaggaaatggtatccaaatctatctgaggatgatgttgttgagaaatgtcctttatgccgtcaaaattgtaattgtagcaaatgcttgcatttgaatggtttaattgagacatcgaagagggaactcgcgaaatctgaaagacgtcatcatctccagtatttgattacgttgatgcttccttttctgaataagttatccatattccagaagctagagattgaatttgaggcaactgttcaaggaaaactgccttctgaagttgaaataactgcggctataagctacactgatgaacgtgtatactgtgatcattgtgcaacttcaattgttgacttgcatcgaagctgtccaaagtgctcttatgaactttgtttgaagtgctgtcaagagattcgtgaaggatcgctttctgaacgccctgaaatgaagttccattatgttgatagaggacatcgatatatgcatggtttagatgctgcggaaccgagcttgtcttccacttttgaagacgaagaagctaacccatctgacgctaagtggagccttggtgaaaatggaagcatcacttgtgcaccagaaaagctaggtggttgtggtgaacggatgctagagcttaggcggatcctaccactcacgtggatgtcagatttagagcacaaagcagagactttcttatcatcatacaatataagccctagaatgttgaactgtaggtgttcttctttggagacagagctgacaaggaaatcagcttcgaggacaacatcaagtgacaactaccttttctgtcctgaatctctcggtgtcttgaaggaagaagagcttcttcattttcaagagcattgggcaaaaggcgaaccagtaatcgttaggaacgctcttgacaacacacctggtttaagctgggagccgatggttatgtggcgggctttatgcgaaaatgtgaattcaacatcaagctctgagatgtcccaagtcaaagcaattgattgcttagctaattgtgaggtggagatcaatactcgtcagttctttgaaggttatagcaaaggaagaacatatgaaaatttctggcctgagatgttgaagcttaaggactggcctccttctgataagtttgaagatcttctacctcgtcactgtgatgagttcatatccgcgttacctttccaggaatatagtgatcctagaactggaattcttaacattgcaacaaagcttcctgaaggatttatcaaaccagatttaggtccaaaaacttacatcgcctatgggattccagatgagcttggtagaggcgattccgtgactaagcttcactgcgatatgtcagacgcggtgaatattctaacgcatacggccgaagtgaccctaagtcaagaacaaatatcctcagtcaaagcactgaaacagaaacacaagttacagaataaggtcgataaacagagtactgaagactgtaacgaaaaggaagaagaagaagaagaagaattgaacatgccagagatttcgagcaatgaaaatgaagaaacgggcagtgctctttgggacatatttaggagagaagacgttcccaagttagaagagtatctaagaaagcattgcaaagaatttagacacacttattgtagtccagttacaaaggtaacaacacccacctgcatcaattttatgacgaatttatttccggtactgacggtttcttcttttcaggtttatcatccgatacatgaccaatcatgctatttaaccttagagcacaaaagaaaactcaaggcggaatatgggatcgagccatggacatttgtgcaaaagctaggtgaagcggtgtttattcccgcgggttgtcctcatcaagttcggaatctaaagtcgtgcacaaaagtcgcagttgactttgtgtcaccagagaacatccatgagtgtctgcgtttgaccgaagagtttcgccaacttcccaaaaaccacaaggccagagaggacaaactcgaggcaagtcttttatctctttga

SEQ ID NO: 190 - protein, 906 aa, Arabidopsis thaliana
MDSGVKLEHMNCFQLSYQYSWTTRKKRTLKPFMSKGSSPSSSSDSRKRKLSRAEDSDDSAVKRNAKRRRKICKVEEYYEDDDCILSDWVQRNTAKRIDKRNEEVEVMVKIESGDDCTIGKWFSDVSSKRKDKRQVEVDEDEEWEEEVTLCSKIKATSSRSRTHSLSANSPENVTDVISPCRSRSPASNVSDSIQKNDCTSSRKQSGPICHQCLKGERITLLICSECEKTMFCLQCIRKWYPNLSEDDVVEKCPLCRQNCNCSKCLHLNGLIETSKRELAKSERRHHLQYLITLMLPFLNKLSIFQKLEIEFEATVQGKLPSEVEITAAISYTDERVYCDHCATSIVDLHRSCPKCSYELCLKCCQEIREGSLSERPEMKFHYVDRGHRYMHGLDAAEPSLSSTFEDEEANPSDAKWSLGENGSITCAPEKLGGCGERMLELRRILPLTWMSDLEHKAETFLSSYNISPRMLNCRCSSLETELTRKSASRTTSSDNYLFCPESLGVLKEEELLHFQEHWAKGEPVIVRNALDNTPGLSWEPMVMWRALCENVNSTSSSEMSQVKAIDCLANCEVEINTRQFFEGYSKGRTYENFWPEMLKLKDWPPSDKFEDLLPRHCDEFISALPFQEYSDPRTGILNIATKLPEGFIKPDLGPKTYIAYGIPDELGRGDSVTKLHCDMSDAVNILTHTAEVTLSQEQISSVKALKQKHKLQNKVDKQSTEDCNEKEEEEEEELNMPEISSNENEETGSALWDIFRREDVPKLEEYLRKHCKEFRHTYCSPVTKVTTPTCINFMTNLFPVLTVSSFQVYHPIHDQSCYLTLEHKRKLKAEYGIEPWTFVQKLGEAVFIPAGCPHQVRNLKSCTKVAVDFVSPENIHECLRLTEEFRQLPKNHKAREDKLEASLLSL

SEQ ID NO: 191 - DNA, 1245 bp, Arabidopsis thaliana
atgattcaggatcaagcgaatgatttattagcaatgaagaaaacttttactaagtctaaatggaaaccagaggaagatagaattttgaaagattatgttattcaatatggtgatagaacttggactcatgttccaaaacgcacgggccttcctcataatcctgcaagttgtcgttttcgttggatgaatcatcttaagccaagcttgaaaaaagggccctttaccgatgaggaagagaagcgtgttctccaacttcatgctgttttggggaacaaatggtcacaaatggctagagaagtatgtaactctctttcctttttttttcactctctacattttcatcttcttttactgtttgatttaaacttttgtttctttaagttccctggtcgaacagataacgagataaagaatttttggaacgcaagacgtatgcgattgaaaggaaagggtttaccagtttaccctgatgaagttcgagagcaggcgatacgtacagcagcacaatatggtgtaaaagttgaattattgaatgctcattatagtcaagactcattgatggcaggcaatgtcgagaaacctcaagaactcaataacttggcactcaatcaatgttctccgtattaccagtcaacgcttgccaatgttcagcctagccgcaatcgcgttatggaaccagaaacaacatttcctttcacgggtggatctgccatgaacgagcaaaaccctactctcttgtgtaatccttacgtggagagcactcaagaacagttacctgacagccatttgtttggaaatgttacatattcttctcctcctatgcctctcattcacgaggttgagaacttggagctcccttcattccaaggctttgattttcatgaagagcctagcagttttggagcagaacaatataacccaatgctgaatcttgagccacacaacactttggtccagtctcctctgataggccagacaccaacagatttcccatcatcattctatgatgaattgttggatgaattgttggaatcagttgttaacggttcattaggagaaataccgaaaaccgataccagttcggagtcccaactgtttcagtcctctctacgtagccataccgatgctacaccagacattgcaaacacaactggtaaaccttttttagtctctacgcattacattacaatcacttcattttttgtgtgttcaattcaagaggtttccactaatctttatgcatga

SEQ ID NO: 192 - protein, 414 aa, Arabidopsis thaliana
MIQDQANDLLAMKKTFTKSKWKPEEDRILKDYVIQYGDRTWTHVPKRTGLPHNPASCRFRWMNHLKPSLKKGPFTDEEEKRVLQLHAVLGNKWSQMAREVCNSLSFFFHSLHFHLLLLFDLNFCFFKFPGRTDNEIKNFWNARRMRLKGKGLPVYPDEVREQAIRTAAQYGVKVELLNAHYSQDSLMAGNVEKPQELNNLALNQCSPYYQSTLANVQPSRNRVMEPETTFPFTGGSAMNEQNPTLLCNPYVESTQEQLPDSHLFGNVTYSSPPMPLIHEVENLELPSFQGFDFHEEPSSFGAEQYNPMLNLEPHNTLVQSPLIGQTPTDFPSSFYDELLDELLESVVNGSLGEIPKTDTSSESQLFQSSLRSHTDATPDIANTTGKPFLVSTHYITITSFFVCSIQEVSTNLYA

SEQ ID NO: 193 - DNA, 585 bp, Arabidopsis thaliana
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 194 - protein, 194 aa, Arabidopsis thaliana
MNISQNPSPNFTYFSDENFINPFMDNNDFSNLMFFDIDEGGNNGLIEEEISSPTSIVSSETFTGESGGSGSATTLSKKESTNRGSKESDQTKETGHRVAFRTRSKIDVMDDGFKWRKYGKKSVKNNINKRNYYKCSSEGCSVKKRVERDGDDAAYVITTYEGVHNHESLSNVYYNEMVLSYDHDNWNQHSLLRS

SEQ ID NO: 195 - DNA, 1540 bp, Arabidopsis thaliana
ttttgttgttgttgtgaaagctcagagttttgtttgcttttttgttgacttttttgagattgatgctggatctcaatctcgacgtcgactcgaccgagtctactcagaacgaacgagattcgattactgttaaaggggtttctttgaatcagatggatgaatcggtgacgtcgaactcttctgttgttaatgctgaagcttctagctgtatagatggtgaagatgagttgtgctctacacgaacggtcaagtttcaatttgagatactgaaaggaggaggagaagaagaagaagaagatgatgatgaaagaagtgctgtgatgatgactaaggagttttttcctgttgctaaaggcatgaactttatggattcgagcgctcaaagttcaaggagcaccgttgatatttccttccagagggggaaacaaggtggagactttataggtagcgggagcggtggtggcgatgcttcacgggtgatgcagccaccatcacagccggtgaagaaaagcaggagaggtcctaggtctaagagttctcagtatagaggcgtcactttctatcggaggacaggcagatgggaatcgcatatctgggattgcggtaaacaagtttatttaggtggatttgatactgcccatgctgcagctagggcgtatgatcgagctgctgtcaaattccggggtctggaagctgacatcaatttcgttattggcgattatgaagaggatctcaagcagatggcgaatctttccaaagaggaagttgtgcaagtacttcggcgacagagctctggtttctcaaggaataattctagatatcaaggagttgctttgcaaaagattggcgggtggggagctcaaatggagcagcttcatggaaacatgggttgtgacaaggcagccgtacaatggaagggaagggaagctgcttccttaattgagcctcatgcatcccgaatgattcccgaggcagctaatgttaagctcgacctcaacttgggaatctctctttcactaggagatggtccgaagcaaaaagatagggccctccggcttcaccatgtccctaacaattccgtatgtggaaggaacaccatgatggagaaccacatggctgcagcggcatgtgatacgcctttcaatttcttgaagaggggttcagaccatcttaataaccggcatgcccttccttctgcgttcttttcacccatggaaagaacaccagagaaagggcttatgttacgttctcatcaaagcttcccagccaggacatggcaagggcatgatcagtccagtggtgggaccgccgtagcagctacagcaccgccactgttttcaaatgcagcatcatcaggattctcactctcagctacacgccctccttcatccacagctattcatcatccttctcagcccttcgtcaatctgaatcagcccggtctctatgttatccacccatctgattacatatctcagcaccaacacaatctcatgaaccgcccacaaccaccaccatagcttcctccttcctccgcata

SEQ ID NO: 196 - protein, 485 aa, Arabidopsis thaliana
MLDLNLDVDSTESTQNERDSITVKGVSLNQMDESVTSNSSVVNAEASSCIDGEDELCSTRTVKFQFEILKGGGEEEEEDDDERSAVMMTKEFFPVAKGMNFMDSSAQSSRSTVDISFQRGKQGGDFIGSGSGGGDASRVMQPPSQPVKKSRRGPRSKSSQYRGVTFYRRTGRWESHIWDCGKQVYLGGFDTAHAAARAYDRAAVKFRGLEADINFVIGDYEEDLKQMANLSKEEVVQVLRRQSSGFSRNNSRYQGVALQKIGGWGAQMEQLHGNMGCDKAAVQWKGREAASLIEPHASRMIPEAANVKLDLNLGISLSLGDGPKQKDRALRLHHVPNNSVCGRNTMMENHMAAAACDTPFNFLKRGSDHLNNRHALPSAFFSPMERTPEKGLMLRSHQSFPARTWQGHDQSSGGTAVAATAPPLFSNAASSGFSLSATRPPSSTAIHHPSQPFVNLNQPGLYVIHPSDYISQHQHNLMNRPQPPP

SEQ ID NO: 197 - DNA, 1978 bp, Arabidopsis thaliana
tggagctcagctcagctcacactttcctcttcctcttacctgaaacgcgtctcgtaacactgatctctaatgatcttcgtctccaatggcgatatcagtacaacacgtcgtcgttttactcctctccactctcctcatcgccatcaccttcttcctcttcacctccgataacgccagattccctttcccttctctctccaccaccgattactacacaccaatcccaaaatctccaattcctcaccgaatcgtcgacgtttcttcagatcaaactccacagaagatgaagctaaacacttccctcgaggtgggagagctgaaatgggatctatgtaaaggtgcagaatctgttgattacataccttgtcttgataattacgctgccatcaagcagctcaaatcaaggagacatatggagcatcgagaacgtcattgccctgaaccaagtcctaaatgtctccttcccttgcctgataattataagccgccggttccgtggcctaagagccgggatatgatttggtatgacaatgttcctcatcccaagcttgttgaatacaagaaggaacaaaattgggttaaaaaagagggtgaatttctagtttttcctggaggaggtactcaattcaaattcggggttactcattacgttgagttcatcgaaaaggcgttaccgagtatcaaatgggggaaaaacataagggttgtattagatgttggttgtggtgttgctagctttggcggatctttattagataaagatgtcattacaatgtcgtttgctcctaaagatgaacatgaagctcagattcaatttgcgttagaacgaggaatacctgcaacactttctgttattggaacacaacagctcacgtttccgagcaatgcatttgatcttatacattgtgcacggtgcagagtccattgggatgctgatggtgggaaaccgttgttggagctcaatagggtacttaggccaggaggtttcttcatatggtctgcaacaccagtctatcgagataatgacagagatagcagaatttggaatgaaatggtttctcttactaaatccatttgctggaaggtcgtgacaaagacggttgattcctctggaatcggacttgtgatctatcaaaagccaacatcagaatcctgttataataaacgcagcacacaagatccaccactttgtgataaaaaggaagcaaatggttcatggtatgttcctctcgctaaatgcctttccaagttacctagtggaaatgtccagagttggcctgaactatggcctaaacggcttgtgagtgttaaaccgcaaagcatttcagttaaagcggaaacattgaagaaagatacagagaaatggtcagcaagtgtttctgatgtttacctcaaacatctagctgtaaactggtcgactgtgcggaatgtgatggacatgaatgctggttttggcggttttgctgctgaacttataaatcaaccactctgggtgatgaatgatgtccctgtggataaacctgacactctctccgtcgtttatgatcgaggcttgatcggagtttaccatgattggtgtgagtccgtcaacacttaccctagaacatacgatctgttacattccagtttcctcctaggtgatctcacacaaaggtgtgagattgtacaagtggtagctgagatagatcggatagtgagaccaggtggatatcttgtggtacaagacaacatggaaacaataatgaagcttgaatccatacttggttcgcttcattggtcaaccaaaatatacgaggaccggtttttggttggtcggaagggattttggcgtcccgctaaaccggagctcagatagacagaacgagagacataaacatactagcaaagtaaatttgtacactactatcaatgacgcaaccagattatatcacagcgtactatataacccattaagggggttttgttttgaaaaaaaaaa

SEQ ID NO: 198 - protein, 589 aa, Arabidopsis thaliana
MAISVQHVVVLLLSTLLIAITFFLFTSDNARFPFPSLSTTDYYTPIPKSPIPHRIVDVSSDQTPQKMKLNTSLEVGELKWDLCKGAESVDYIPCLDNYAAIKQLKSRRHMEHRERHCPEPSPKCLLPLPDNYKPPVPWPKSRDMIWYDNVPHPKLVEYKKEQNWVKKEGEFLVFPGGGTQFKFGVTHYVEFIEKALPSIKWGKNIRVVLDVGCGVASFGGSLLDKDVITMSFAPKDEHEAQIQFALERGIPATLSVIGTQQLTFPSNAFDLIHCARCRVHWDADGGKPLLELNRVLRPGGFFIWSATPVYRDNDRDSRIWNEMVSLTKSICWKVVTKTVDSSGIGLVIYQKPTSESCYNKRSTQDPPLCDKKEANGSWYVPLAKCLSKLPSGNVQSWPELWPKRLVSVKPQSISVKAETLKKDTEKWSASVSDVYLKHLAVNWSTVRNVMDMNAGFGGFAAELINQPLWVMNDVPVDKPDTLSVVYDRGLIGVYHDWCESVNTYPRTYDLLHSSFLLGDLTQRCEIVQVVAEIDRIVRPGGYLVVQDNMETIMKLESILGSLHWSTKIYEDRFLVGRKGFWRPAKPELR

SEQ ID NO: 199 - DNA, 1356 bp, Arabidopsis thaliana
atgagttacacgagcactgacagtgaccataatgagtcaccagctgctgatgataatggaagtgactgcagaagtagatgggatggtcatgctctcaagaaaggcccttggagttcagctgaagatgatattcttattgactatgtgaataagcatggtgagggtaactggaatgctgtgcagaaacacaccagcttgtttcgttgtggtaaaagctgtcgtctaagatgggctaatcatctgaggccaaatttgaagaaaggagcttttagtcaagaagaagaacagcttatcgttgaattgcatgccaagatgggtaatagatgggcacgtatggctgcacatttgcctggccgaacggataatgagataaagaattattggaacactcgtatcaagaggcgacaacgagctggtttgccactttatcctcctgagatgcatgttgaggcacttgagtggagtcaagagtatgccaagagtagagttatgggagaagatagaagacatcaagatttcttgcagctggggagttgtgaatctaatgtcttctttgatactcttaattttaccgacatggtacctggtacttttgatctagcagatatgactgcctacaaaaatatgggtaactgtgcaagttctcctcgatatgaaaacttcatgacaccaacaatcccctcctcgaagcgactttgggaatctgagttgttgtatcctgggtgtagcagtaccataaagcaagaattctcgtcgcctgaacaattccggaacacatctccacaaacgatttccaaaacttgcagcttctcagttccttgtgatgttgagcatcctctctatggaaaccgacattcacctgttatgattccagatagccatacccctacggatggcattgttccttattctaagcccttatatggggcagtgaagctggagctcccttcattccaatattcagaaacaacatttgaccagtggaagaaatcgtcatctcctccacactctgatctccttgatccctttgatacttacattcagtctccaccaccaccaacggggggagaagagtcagatttatattcaaattttgatactggtctgctcgatatgttgcttctggaagccaagatcagaaataatagtacaaagaacaatttgtacaggagctgcgcttcaactattccatcagctgatcttggccaggttactgtatcccaaactaaatccgaggagtttgacaattcccttaagagcttcttggttcattccgaaatgtccacacaaaatgcagatgaaactccaccaagtgagttactattcaccttaccatcacttgaaatagtttgttga

SEQ ID NO: 200 - protein, 451 aa, Arabidopsis thaliana
MSYTSTDSDHNESPAADDNGSDCRSRWDGHALKKGPWSSAEDDILIDYVNKHGEGNWNAVQKHTSLFRCGKSCRLRWANHLRPNLKKGAFSQEEEQLIVELHAKMGNRWARMAAHLPGRTDNEIKNYWNTRIKRRQRAGLPLYPPEMHVEALEWSQEYAKSRVMGEDRRHQDFLQLGSCESNVFFDTLNFTDMVPGTFDLADMTAYKNMGNCASSPRYENFMTPTIPSSKRLWESELLYPGCSSTIKQEFSSPEQFRNTSPQTISKTCSFSVPCDVEHPLYGNRHSPVMIPDSHTPTDGIVPYSKPLYGAVKLELPSFQYSETTFDQWKKSSSPPHSDLLDPFDTYIQSPPPPTGGEESDLYSNFDTGLLDMLLLEAKIRNNSTKNNLYRSCASTIPSADLGQVTVSQTKSEEFDNSLKSFLVHSEMSTQNADETPPSELLFTLPSLEIVC

SEQ ID NO: 201 - DNA, 891 bp, Arabidopsis thaliana
atggggaaaggaagagcaccatgctgcgacaagaacaaagtgaagagagggccatggagccctcaagaagatctcactctcatcacttttattcaaaaacatggccatcaaaactggagatctcttcccaagcttgctggattgttgagatgtgggaaaagttgccgactaagatggataaactatctgagaccggacgtgaagcgaggcaactttagcaaaaaggaggaagatgctatcattcactaccatcaaacccttggaaacaagtggtcaaagatcgcgtccttcttgccgggaagaactgacaacgagatcaaaaacgtgtggaacacgcatctcaagaaacgactcactccatcttcttcttcttcatccctctctagcactcatgaccaaagcacaaaagcagatcatgacaagaactgtgacggggctcaagaagaaatacattcagggttaaatgagagccaaaactcagctacttcgtcacatcaccaaggcgagtgtatgcacacaaaaccagagcttcatgaggttaatggactcaacgagatccagttcctgctcgaccatgatgactttgatgatataacctctgagtttcttcaggataacgatatcttatttccgctagactctcttcttcataaccaccaaactcacatttcaacccaagaaatgactcgagaggtaaccaaatcgcaatcatttgatcatcctcaaccggatatcccatgcggatttgaagacacaaacgaagaatccgacttgaggagacagctggttgaatcaaccacacctaacaatgagtacgacgagtggttcaacttcattgacaaccaaacttactttgatgattttaatttcgtcggagaagtatgtctatga

SEQ ID NO: 202 - protein, 296 aa, Arabidopsis thaliana
MGKGRAPCCDKNKVKRGPWSPQEDLTLITFIQKHGHQNWRSLPKLAGLLRCGKSCRLRWINYLRPDVKRGNFSKKEEDAIIHYHQTLGNKWSKIASFLPGRTDNEIKNVWNTHLKKRLTPSSSSSSLSSTHDQSTKADHDKNCDGAQEEIHSGLNESQNSATSSHHQGECMHTKPELHEVNGLNEIQFLLDHDDFDDITSEFLQDNDILFPLDSLLHNHQTHISTQEMTREVTKSQSFDHPQPDIPCGFEDTNEESDLRRQLVESTTPNNEYDEWFNFIDNQTYFDDFNFVGEVCL

SEQ ID NO: 203 - DNA, 1435 bp, Arabidopsis thaliana
caattatttaatttagtaggaaacatagaataaaaaaacttgctttgtttttcatattttctcattattggaatcactgtcttttcgaacttggtgacaatcttagtactagaaaacaaaagactttgaccggtctttggctcatctctttcttctcccctttctccaacacttatttctttctctctctagttcatgaattcaagattcaaagacacacgtatggctacctcttggtaaatccaaagagacacatatatggctgacgctgatccatcgagtggtgaacagatagttatgagagagtgcagaaaagggaattggacagtgagtgagactttggttctcatagaagccaagaagatggacgaccagaggcgtgtacggcgatcggaaaaacaacctgaaggcagaaacaaaccagcagagctccggtggaaatggatagaggagtattgctggagaagaggatgttaccgcaaccagaatcagtgcaacgataagtgggacaatctcatgagggattacaagaagatcagagagtacgagagatcaagggtagaatcgtcttttaacaccgtcacttcttcctcttactggaagatggacaagactgagaggaaagagaagaacttgccgagtaacatgttgcctcagatatacgacgtgttgtctgagcttgttgacagaaaaactcttccttcctcctcctccgccgccgccgccgtaggaaacggtaacggtggccagatcctaagagtttgccaacaaagtttaggatttgtagctccgatgatggctcagccgatgcatcaaatcccgactactatagtgttatctcttccgccaccaccgccacagtctcttagcttatcacttccttcgccgcctcaacctccaccatcgtcttcatttcacgctgagcctataccgcccacagtaggtacatcatcgacaaagcgaatgagaacaacgccgggagaaaccaccgctggaggagagagggaggtagaggaggatgcggttggggtggcgttgtctagatgcacgtctgtgatcacacaagtgataagagagaatgaggagggacaagagaggaggcataaggaagtggtgaggctacaagagaggagactaaagattgaggaatcaaaaactgaaataaatagacaaggtatgaatggtttggtagacgccattaatcaactcgcaagctctattcttgctttggcttcttcttcttgccataataatcgcatcatcaaggaggtccaccatgatacctatattgaatagatgtgttactttaatacttaagttgatgattagttgcttagttaatatgtaggtatgtgtatataaagtgacgttatgttagcatataaaaccatgcaagatgttcttgtcatggagtaattaatgaatcattaatcaa

SEQ ID NO: 204 - protein, 345 aa, Arabidopsis thaliana
MADADPSSGEQIVMRECRKGNWTVSETLVLIEAKKMDDQRRVRRSEKQPEGRNKPAELRWKWIEEYCWRRGCYRNQNQCNDKWDNLMRDYKKIREYERSRVESSFNTVTSSSYWKMDKTERKEKNLPSNMLPQIYDVLSELVDRKTLPSSSSAAAAVGNGNGGQILRVCQQSLGFVAPMMAQPMHQIPTTIVLSLPPPPPQSLSLSLPSPPQPPPSSSFHAEPIPPTVGTSSTKRMRTTPGETTAGGEREVEEDAVGVALSRCTSVITQVIRENEEGQERRHKEVVRLQERRLKIEESKTEINRQGMNGLVDAINQLASSILALASSSCHNNRIIKEVHHDTYIE

SEQ ID NO: 205 - DNA, 2074 bp, Arabidopsis thaliana
ttcagacagagagtgagtacttgaagaaatgggttgttgtcagtcaagaatagatagcaaagagatagtgtctcgttgtaaagcaaggaagagatacttgaaacatcttgttaaagctagacaaactctctctgtttctcacgcgctttatctccgttctctacgcgccgttggctcttcccttgttcacttctcttccaaagagactcctcttcacctccaccacaaccctccgtctccttctcctcctcctccaccgccgccgcgccctcctcctcctcctctaagccctggctctgaaaccaccacatggaccaccaccactacttcctctgttcttcctcctcctccgccgccaccacctcctcctcctccgccttcttctacatgggacttctgggatccgtttataccgccgcctccttcttcctctgaggaagaatgggaggaagagacaaccaccgcgacaagaaccgcaacaggaactggctctgatgctgctgtgacgacggctccgacgacagctactcctcaagcttcgtctgttgtgagtggattctctaaagatacaatgacgacgacgacgactggaagtgagctagcagttgtggtgtcgaggaatggtaaagatctaatggagattattaaagaagtcgatgaatatttccttaaagctgcagattctggtgcacctctctcttctctccttgaaatctcaacctctatcactgacttttctggtcattccaaatcagggaaaatgtacagtagtagtaactacgaatgtaatctgaatccgacgtcgttttggacaaggggatttgctccttctaagttgagtgaatacagaaacgcaggaggagtaattggaggaaattgcattgttggtagccattcatctacagtggacagactctatgcttgggagaagaaactttatcaagaggtcaagtatgcagagagcataaagatggatcatgagaagaaagtggagcaagtgaggaggcttgagatgaagagagctgagtatgtcaagactgagaaggctaagaaagacgtcgagaagttagaatctcagctctcagtatcttcacaagccatccaaagcgcctctaacgagatcatcaagctcagagagaccgagctttaccctcagcttgtcgagcttgttaaagggctaatgtgtatgtggaggagtatgtacgagagccaccaggttcaaacccatattgtgcagcagcttaagtaccttaacaccatcccctccactgaaccaacatctgagcttcaccgacaatcaactcttcagcttgagctcgaggtccaacaatggcatcactctttctgcaacttggtcaaggcccaacgtgactacatacaatctctcacgggctggctcaggttaagtctgttccagttcagcaagaatccacttgttaggagtagctacgagtcaaagatctacagcttctgcgaggaatggcatttagctattgacaggatccctgataaagtagcatctgaagggatcaaaagctttctgacagcagtccatggaattgtggctcaacaagccgacgagcataagcaaaagaagagaacagaatccatgttaaaagatttcgagaagaaatcggcttcgctgagagcgcttgagagcaagtatagtccatactcggtacctgagagtaggaaaaagaacccggtgatagagaagagagtaaaggttgagatgctaaaaggaaaagcagaagaagagaaaagtaagcatgagaagtcagtgagtgtgactagagccatgactctaaataacttgcagatgggtttccctcatgtctttcaggcaatggttgggttttcaagtgtgtgtatgcaagcctttgagtctgtgtacaaccaagctaagagcatcggtgaggatcaagaggaggttaagaggttgcttccttaaagagagaaagacaaattgttttaccatttgctctctgtttttgcttgatccaagctaatcttttggttgaatgttaggttgagtttatgctgttttcgaaatgaaattggttaaatgactttt

SEQ ID NO: 206 - protein, 640 aa, Arabidopsis thaliana
MGCCQSRIDSKEIVSRCKARKRYLKHLVKARQTLSVSHALYLRSLRAVGSSLVHFSSKETPLHLHHNPPSPSPPPPPPPRPPPPPLSPGSETTTWTTTTTSSVLPPPPPPPPPPPPPSSTWDFWDPFIPPPPSSSEEEWEEETTTATRTATGTGSDAAVTTAPTTATPQASSVVSGFSKDTMTTTTTGSELAVVVSRNGKDLMEIIKEVDEYFLKAADSGAPLSSLLEISTSITDFSGHSKSGKMYSSSNYECNLNPTSFWTRGFAPSKLSEYRNAGGVIGGNCIVGSHSSTVDRLYAWEKKLYQEVKYAESIKMDHEKKVEQVRRLEMKRAEYVKTEKAKKDVEKLESQLSVSSQAIQSASNEIIKLRETELYPQLVELVKGLMCMWRSMYESHQVQTHIVQQLKYLNTIPSTEPTSELHRQSTLQLELEVQQWHHSFCNLVKAQRDYIQSLTGWLRLSLFQFSKNPLVRSSYESKIYSFCEEWHLAIDRIPDKVASEGIKSFLTAVHGIVAQQADEHKQKKRTESMLKDFEKKSASLRALESKYSPYSVPESRKKNPVIEKRVKVEMLKGKAEEEKSKHEKSVSVTRAMTLNNLQMGFPHVFQAMVGFSSVCMQAFESVYNQAKSIGEDQEEVKRLLP

SEQ ID NO: 207 - DNA, 1008 bp, Arabidopsis thaliana
atggcagctgcaccaccgatcgagccggcggtgacgacgacgttccctggcttcaaattctccccgaccgacatcgaacttatatcttattacttgaagaggaagatggatggtttggagagatctgttgagattatacctgaggttgagatttacaacttcgagccttgggatttacctgataagtctatcgttaaatcggatagcgaatggttcttcttctgtgctcgcggtaagaagtatccccacggttcacagaacagaagagcaaccaagataggatattggaaagccacaggaaaagagcgtaatgtgaagtcaggttctgaggtcattggaacaaagagaacgcttgtattccacattggccgcgcgccaaaaggaggaagaacggaatggcttatgcatgagtactgcatgattggagtatcactggatgctctggttatttgccgacttaggaggaatactgaatttcaagggagtacaattcaaaagccaccacaaccaagtttaccactggataagcacgtaaacttgcggaatgaagctatttcagaaagtatttatggttgggaaactatggttgatttctacttatcaagtgagtcagggcaagaactacttagtgaaatagcagaatcttcacaatcttcacaaaatccacaggttcctagtgaagaagatttctatgccgatatactgagggatgaaatagtaaagctagatgatccggcggtatccggtaatacactgatcaatgtaccaaggcttcaaacagagtccaataccacaagagtactacctttacctgacatggtagacaaacaaatgcaatcgttgctacagaaactaccattacaaaatgacactggagaagagaacaacatatccatgtcaaattgctttatcggtatctactcgattaagtctataaaccgagcgcgatgggacgttgttgtttggttactcgttatgatagccgtgttggtgttttatttagtgtga

SEQ ID NO: 208 - protein, 335 aa, Arabidopsis thaliana
MAAAPPIEPAVTTTFPGFKFSPTDIELISYYLKRKMDGLERSVEIIPEVEIYNFEPWDLPDKSIVKSDSEWFFFCARGKKYPHGSQNRRATKIGYWKATGKERNVKSGSEVIGTKRTLVFHIGRAPKGGRTEWLMHEYCMIGVSLDALVICRLRRNTEFQGSTIQKPPQPSLPLDKHVNLRNEAISESIYGWETMVDFYLSSESGQELLSEIAESSQSSQNPQVPSEEDFYADILRDEIVKLDDPAVSGNTLINVPRLQTESNTTRVLPLPDMVDKQMQSLLQKLPLQNDTGEENNISMSNCFIGIYSIKSINRARWDVVVWLLVMIAVLVFYLV

SEQ ID NO: 209 - DNA, 918 bp, Arabidopsis thaliana
atgacttggtgcaatgaccgtagcgatgttcagaccgttgaaagaatcattccctccccgggggcggctgagtcccccgtagcctcacttccggtctcttgtcacaaaacttgcccttcttgtggccataacttcaagtttcacgaacaggctgggatccatgacttgccgggacttcctgctggagtaaaatttgatccgacggatcaagaggtcttggagcatcttgaaggcaaggtaagagatgacgcaaaaaagcttcatcctctcattgatgagtttatccgtaccatcgatggtgaaaacggcatttgttatacccatcctgaaaaattgccaggagtgaacaaggacgggacggtgcgtcatttcttccaccgaccgtcgaaggcatacacgacgggaacaagaaagcgacgtaaagtccacactgattctgacgtcggtggagagacacggtggcacaagacaggaaaaacacggccagttcttgctggaggaagagtgagaggctacaagaaaatcctagtgctctacacaaactacggcaaacaaaaaaaacccgagaagactaattgggtaatgcatcaatatcatcttggcactagcgaggaagagaaagaaggtgagctcgtcgtctccaaagtcttttaccagactcaaccacgtcaatgcggtggctccgttgctgctgcagccaccgctaaggaccgaccttacctccacggcctcggtggaggtggtggccgccaccttcattaccatcttcatcataacaacggtaacggtaagagcaacggcagtgggggaaccgccggagccggtgagtattatcacaatattccggctattatctcgttcaatcagaccgggatacagaaccacttggttcatgactctcaaccttttatcccttaa

SEQ ID NO: 210 - protein, 305 aa, Arabidopsis thaliana
MTWCNDRSDVQTVERIIPSPGAAESPVASLPVSCHKTCPSCGHNFKFHEQAGIHDLPGLPAGVKFDPTDQEVLEHLEGKVRDDAKKLHPLIDEFIRTIDGENGICYTHPEKLPGVNKDGTVRHFFHRPSKAYTTGTRKRRKVHTDSDVGGETRWHKTGKTRPVLAGGRVRGYKKILVLYTNYGKQKKPEKTNWVMHQYHLGTSEEEKEGELVVSKVFYQTQPRQCGGSVAAAATAKDRPYLHGLGGGGGRHLHYHLHHNNGNGKSNGSGGTAGAGEYYHNIPAIISFNQTGIQNHLVHDSQPFIP

SEQ ID NO: 211 - DNA, 979 bp, Arabidopsis thaliana
ggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaac

SEQ ID NO: 212 - protein, 301 aa, Arabidopsis thaliana
MEALQPFYKSASTSASNPAFASSNDAFASAPNDLFSSSSYYNPHASLFPSHSTTSYPDIYSGSMTYPSSFGSDLQQPENYQSQFHYQNTITYTHQDNNTCMLNFIEPSQPGFMTQPGPSSGSVSKPAKLYRGVRQRHWGKWVAEIRLPRNRTRLWLGTFDTAEEAALAYDRAAFKLRGDSARLNFPALRYQTGSSPSDTGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 213 - DNA, 1317 bp, Arabidopsis thaliana
atgggacttaaaggatatagcgtcggagaaggaggaggagagatagttgaggttcaaggcggtcacataatccgagccactggacgcaaagaccgtcatagcaaagtgttcacatcaaagggtccacgtgaccggcgcgtgagactctcagctcacacggcgattcaattctacgatgtgcaagaccggttaggttatgaccggcctagcaaagccgttgattggctcatcaagaaagccaaaaccgctattgataagcttgaactcggggagactactactactactactcgtcaagaaccggtgaatactaaaccggaatctcccactttggttttccaaagagagaacaatgaccaaacgcagttcgtggcggccaatcttgatcctgaagacgcaatgaaaacgtttttcccggcgacgacaacaacaaacggtggtggtggtacaaacatcaatttccaaaactaccctcatcaggatgacaacaacatggtctcaagaacaacaacaccaccaccaaaccttagccaagatcttggtctctctcttcacccatttcaagggaacaacaacacagtcgtagttcccgagaccaacaatttcaccacgactcatttcgacacgttcgggagaatctctggatggaatcatcacgacttaactatgacgtcatcatcctcatcagaacatcaacaacaagaacaagaagaaaggagtaatggtggtttcatggtgaatcatcatcctcaccatcatcatcatcaaccgtcgatgatgacattgcttaatagtcagcaacaacaagtgtttcttggtggccaacaacaacaacaacaaaggggtacccttcagtccagtttattccctcattcgtttcgttcttgggatcatcatcaaacgacgtcggatcatcatcatcatcagaatcaagcttcttcgatgtttgcttcatcatcacagtatggttctcatgggatgatgatgatgcaaggccttagtttccccaacactacaagactactccacggagaagaagctactcaaccaaactcttcttcttctcctccaaactcacacctctaaactaagacaaccatggaggttcaaattcatgatgacatgcattgaacaagaaggaggaaattaatgtgatgaatggagctagagtaagcgctatattaattagtattaccatctatccatatatttatgattcaagactattattactcatttagtgtttgttattattattcaattttgcttgtttgtttcttatcatctttgcattgatcatcaagattgtgatatttg

SEQ ID NO: 214 - protein, 361 aa, Arabidopsis thaliana
MGLKGYSVGEGGGEIVEVQGGHIIRATGRKDRHSKVFTSKGPRDRRVRLSAHTAIQFYDVQDRLGYDRPSKAVDWLIKKAKTAIDKLELGETTTTTTRQEPVNTKPESPTLVFQRENNDQTQFVAANLDPEDAMKTFFPATTTTNGGGGTNINFQNYPHQDDNNMVSRTTTPPPNLSQDLGLSLHPFQGNNNTVVVPETNNFTTTHFDTFGRISGWNHHDLTMTSSSSSEHQQQEQEERSNGGFMVNHHPHHHHHQPSMMTLLNSQQQQVFLGGQQQQQQRGTLQSSLFPHSFRSWDHHQTTSDHHHHQNQASSMFASSSQYGSHGMMMMQGLSFPNTTRLLHGEEATQPNSSSSPPNSHL

SEQ ID NO: 215 - DNA, 894 bp, Arabidopsis thaliana
atgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatga

SEQ ID NO: 216 - protein, 297 aa, Arabidopsis thaliana
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 217 - DNA, 1306 bp, Arabidopsis thaliana
aaagtatcatctcatagattccatcttttctctattacatggagaagaaaaaagaagaggatcatcatcatcaacaacaacaacaacaacaaaaggagatcaagaacacagagacaaagatcgagcaagaacaagaacaagaacaaaaacaagaaatctctcaagcatcatcatcatcaaacatggcgaatctagttacgtcatcagatcatcatccgttggagctagctggaaatctctcaagcatcttcgatacttcatctttaccttttccttattcttatttcgaagatcactcttctaataatcctaattctttcctagacttgctccgacaagatcatcagtttgcttcttcctctaattcctcttctttttcattcgatgcctttcctctccccaataacaacaacaacacctctttttttacggatttgcccttacctcaagctgagtcatcagaagtcgtgaacacaacaccgacttctccaaactcaacctcagtctcatcttcctccaacgaagctgcaaatgataacaacagtggtaaagaagttactgttaaagatcaagaagaaggagatcaacaacaagagcaaaagggtactaagccacagttgaaggcaaagaagaagaatcaaaagaaagctagagaagctaggtttgcgtttctgacgaagagcgatattgataatcttgacgacggttataggtggagaaaatacggccaaaaagctgtcaaaaacagtccttatcccagaagctattaccgttgcaccacagtgggttgcggagtgaagaagagagtggagagatcctccgatgatccttcgatcgtcatgacaacctacgaaggtcagcatacccatcctttccccatgacgccacgtggacacatcggaatgctcacgtcaccaatcctagaccacggtgcaaccaccgcgtcatcatcatcattctccatccctcagccacgttacttgctgactcaacatcaccagccctacaacatgtacaacaacaactctctaagtatgatcaatagaagatcatccgatggcactttcgtaaatccaggtccatcatcatcattccccggctttggttatgatatgtctcaagcttctacttcaacttcttcttccattagagatcatggattgcttcaagatattcttccttcgcagatcagatccgatactattaacactcaaaccaatgaagagaataagaaatgaagaagttttttttcccggggcaattgtttttttctttaggccggatccggtaggtaggtttcatgagc

SEQ ID NO: 218 - protein, 399 aa, Arabidopsis thaliana
MEKKKEEDHHHQQQQQQQKEIKNTETKIEQEQEQEQKQEISQASSSSNMANLVTSSDHHPLELAGNLSSIFDTSSLPFPYSYFEDHSSNNPNSFLDLLRQDHQFASSSNSSSFSFDAFPLPNNNNNTSFFTDLPLPQAESSEVVNTTPTSPNSTSVSSSSNEAANDNNSGKEVTVKDQEEGDQQQEQKGTKPQLKAKKKNQKKAREARFAFLTKSDIDNLDDGYRWRKYGQKAVKNSPYPRSYYRCTTVGCGVKKRVERSSDDPSIVMTTYEGQHTHPFPMTPRGHIGMLTSPILDHGATTASSSSFSIPQPRYLLTQHHQPYNMYNNNSLSMINRRSSDGTFVNPGPSSSFPGFGYDMSQASTSTSSSIRDHGLLQDILPSQIRSDTINTQTNEENKK

SEQ ID NO: 219 - DNA, 1005 bp, Arabidopsis thaliana
atggtgaaaaaaggtggcacgaagaggaagattgcgattgagacgatacagaagagagattcccttagggttacctgcaccaaacgccgtgaaggtctctatagcaaagcctctcagctttgtcttctctcagacgcacagatcgctatcttagcgactcctccttcttctgaatccaacgtatccttctactctttcggtcactcctctgttgatgccgttgtctctgcttttctctccggacaacgtcctgttccgaaggataacaaagagacgagggaggacgttggtatctgtttgactcgcaataatctagggttaggtttttggtggaacgacgagagccttgccagatcggagaatcctcaagagattagtgaagcgatcgactctatgcggacgctgttgaggaatctcaaggaattgcgtgcggatgaagctttagcctgtaatcaagctttcgttaatgatcgcgaggacctgaagaacaacgacaagtgcgattttgtttcagaccacgaaactcatgatcaaaccctaattcttcagtccgcttctccaatttgttgcatcccagaaaatctcaacgagattactcaagagccaaatcaaaccctaaatattcagtcgagtacttctgcaatttgttgcgtccctgataattcacctgaaaatttcaatgagatcactgaagaacaagatcagattcgctcgatttgtgaaactttttgtgttatggataacaacgctgctttacctgaaatgaacctggattacgatcaagacattggcttcgacacgccttttgagagcgcgctaaatgattggttttcggacaacactactcatcaggagattagtgcaagtattttgaacgctgttgttgatgatcaagtctcggtggatctaactccgttttcttattttcagagatgtttggatggagataatctacgattctctgattgtttcaaagactttgcaaacactatttcagcactttga

SEQ ID NO: 220 - protein, 334 aa, Arabidopsis thaliana
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKDFANTISAL

SEQ ID NO: 221 - DNA, 1646 bp, Arabidopsis thaliana
cttccaaccagatcttcttctctatctcttcgacaaacccttttttctgggttcttcggagaggtgatttatcaccaaaaaaaagattttaaaagtctaaatccttttttctttctttccttcaacatgcctttaccttggaagaaatctaaatctagtcggatctctagattcgtatcagactttcaacaatctcctaaacatggtggatctctcgttgttgaaactggtttcccaacttctttaatcgatctctttgttaagaatcgcgatcgtctcaaaaaacaatcttcaaaacgtaacaacaagaacaacaaagcccagactgaaacgcgtgttttgtctccacctcctcctcatatgtctttgcagcgtcgtatgtctcttccttccaagcttgatccagctttggttacagaggattctcctttggtgagaaagatcgaggaaacttctgttccggagattatccatgaagacgacggtggtcatcgcggtggaggaggaggagggtgtgttttgatagtggtggtgtttaaggtttttatggtggctgtgcttgccttgagcacgaagaagctcgccgtggggatcacgctctctgcttttgcccttctcttcctcgagcttgcggtggcgcgtgtcttcacgtacttgaatctctgtcccgacgcgcagattcggatagattctttgatcgataagctcatagggaagcgacataaagagaagctagaagaagaagaagaatcaacatcgacgcatgacagaagaaacaatgtctactttgaaatcatcgaagaacctagagaggagattagagtcactcctcaatcggattcgtcgtcattggagaaggcgaaacttgtggtggatgagaagaaagaaatgcagacgataagagatgttatgtttaagactgagaaaagcaaaagcgcgaagctgaaatcaaagattgtgaagaagattgtgccaaagaagctaaggagttataagaagaagaagaagatgaagaacaaagaaaaagaagaagaagaagttgaacttgaaactgaagaagaagggtctatgacagaagtttctagcttgtattcagatgagagaatcgggagtgaaatctctgagagggatgatttgagttcgaatccgccatttttagagagttgtacagaggttgaagaagaagaagagactggaccaaaagaggatctaacgaaagtgattggtttgatagtgattgttcttgttggattgctgtgtgggaaagtctttgctattggtctgacactctcttggtgtctgattctcagagttttctgttgcaaatctcaaaccagtttctgaaacagaggaaaacatgattcagactttgggttcttttttttttgtggaagtccgtggcagtggtgggccttagggatcgccgttagttgttgacggtgacggtgttgacggtagagagacggtgacgggagtgttgttgttgggggtggttggcagttcgaagctagacaattggtttgcttatgaaactgtgtaaatttgttttgttgttaacagagatatatatcgtgttattatgatggtcaaagagtcaaagttgttgttatgaagaaccaaaaaaaactgagtaatatattcttaaa

SEQ ID NO: 222 - protein, 405 aa, Arabidopsis thaliana
MPLPWKKSKSSRISRFVSDFQQSPKHGGSLVVETGFPTSLIDLFVKNRDRLKKQSSKRNNKNNKAQTETRVLSPPPPHMSLQRRMSLPSKLDPALVTEDSPLVRKIEETSVPEIIHEDDGGHRGGGGGGCVLIVVVFKVFMVAVLALSTKKLAVGITLSAFALLFLELAVARVFTYLNLCPDAQIRIDSLIDKLIGKRHKEKLEEEEESTSTHDRRNNVYFEIIEEPREEIRVTPQSDSSSLEKAKLVVDEKKEMQTIRDVMFKTEKSKSAKLKSKIVKKIVPKKLRSYKKKKKMKNKEKEEEEVELETEEEGSMTEVSSLYSDERIGSEISERDDLSSNPPFLESCTEVEEEEETGPKEDLTKVIGLIVIVLVGLLCGKVFAIGLTLSWCLILRVFCCKSQTSF

SEQ ID NO: 223 - DNA, 2816 bp, Arabidopsis thaliana
tttgtacttccggagctaaagagttatagctactgtagtagctggaagtgaagaagattttttaatagattgtacggaaaaattagggttttcaaagtttggtttcttgaagttgaattagacatgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctctagaagctgcttcggtgttagtctcatcatgctacaacgcgggagccctttgtttcccatttgaagtcgtttccactcatctttatatgccattcgttcgcatctctctcgttttgacgtttttagaaagaaacataatcatatttgtgagtatgggtcctgaaactttaggacgtactttagcttgtattagacagacactctcgtcataaacataagaacctttatgtagctgtctcagggtaactaaacttttctag

SEQ ID NO: 224 - protein, 811 aa, Arabidopsis thaliana
MKLSTSGLGQQGHEGEKCLNSELWHACAGPLVSLPSSGSRVVYFPQGHSEQVAATTNKEVDGHIPNYPSLPPQLICQLHNVTMHADVETDEVYAQMTLQPLTPEEQKETFVPIELGIPSKQPSNYFCKTLTASDTSTHGGFSVPRRAAEKVFPPLDYTLQPPAQELIARDLHDVEWKFRHIFRGQPKRHLLTTGWSVFVSAKRLVAGDSVIFIRNEKNQLFLGIRHATRPQTIVPSSVLSSDSMHIGLLAAAAHASATNSCFTVFFHPRASQSEFVIQLSKYIKAVFHTRISVGMRFRMLFETEESSVRRYMGTITGISDLDSVRWPNSHWRSVKVGWDESTAGERQPRVSLWEIEPLTTFPMYPSLFPLRLKRPWHAGTSSLPDGRGDLGSGLTWLRGGGGEQQGLLPLNYPSVGLFPWMQQRLDLSQMGTDNNQQYQAMLAAGLQNIGGGDPLRQQFVQLQEPHHQYLQQSASHNSDLMLQQQQQQQASRHLMHAQTQIMSENLPQQNMRQEVSNQPAGQQQQLQQPDQNAYLNAFKMQNGHLQQWQQQSEMPSPSFMKSDFTDSSNKFATTASPASGDGNLLNFSITGQSVLPEQLTTEGWSPKASNTFSEPLSLPQAYPGKSLALEPGNPQNPSLFGVDPDSGLFLPSTVPRFASSSGDAEASPMSLTDSGFQNSLYSCMQDTTHELLHGAGQINSSNQTKNFVKVYKSGSVGRSLDISRFSSYHELREELGKMFAIEGLLEDPLRSGWQLVFVDKENDILLLGDDPWESFVNNVWYIKILSPEDVHQMGDHGEGSGGLFPQNPTHL

SEQ ID NO: 225 - DNA, 1371 bp, Arabidopsis thaliana
atttattaagcatcaatgagagaacttcagagctgggtttgagttctgtccaataatacataaccacgttatcatttttgtcctttactatctcattacactcttctgttattcgcccaattcttacagtcattactctctatagggctcgagcggccgcccgggcaggtttctatgcagatggttcacacttcccgctccattgcccagattgggttcggtgttaagtcgcaattagtactcactatagggctcgagcggccgcccgggcaggtaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggatgcattagtggtgtgccggttaagaaaaaatgctgattttcgggctagttcgacccaaaaaattgaggatggtgttgtgcaagacgatggctacgttggccaaagaggtggtttggacaaggaggacaaatcctactatgaatctgagcatcagataccaaatggtgacatcgcagaatcatcaaatgttgttgaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaataaatatagtattttgtctatggcaaaaaaaaaaaaaaaa

SEQ ID NO: 226 - protein, 373 aa, Arabidopsis thaliana
MQMVHTSRSIAQIGFGVKSQLVLTIGLERPPGQVKDQTMSKEAEMSIAVSALFPGFRFSPTDVELISYYLRRKIDGDENSVAVIAEVEIYKFEPWDLPEESKLKSENEWFYFCARGRKYPHGSQSRRATQLGYWKATGKERSVKSGNQVVGTKRTLVFHIGRAPRGERTEWIMHEYCIHGAPQDALVVCRLRKNADFRASSTQKIEDGVVQDDGYVGQRGGLDKEDKSYYESEHQIPNGDIAESSNVVEDQADTDDDCYAEILNDDIIKLDEEALKASQAFRPTNPTHQETISSESSSKRSKCGIKKESTETMNCYALFRIKNVAGTDSSWRFPNPFKIKKDDSQRLMKNVLATTVFLAILFSFFWTVLIARN

SEQ ID NO: 227 - DNA, 804 bp, Arabidopsis thaliana
atgcatggagccatgaactcaccatgcattgatttcgtaatgttcagtcgtggacaacacgatgaggacaacatgtcacgtcgtcctccgtggaagagggagagatcgatgtccactcagcatcatcatcttaacttgtctccaaacgaagacgaagagcttgccaactgtcttgtcttgttgtccaattcaggggatgcgcatggtggtgatcagcataaacaacatggacatggtaagggcaaaaccgtcaaaaagcaaaaaaccgcccaggttttccaatgcaaagcttgcaagaaggtgttcacgtcgcatcaggcattgggtggacacagggcaagccacaagaaagtgaagggttgttttgcctctcaagataaagaagaggaagaggaagaggaatacaaagaagacgacgacgacaacgacgaggacgaagatgaggaggaggatgaggaagacaaatcaacggctcatatcgcaagaaagagatccaacgctcacgaatgcaccatctgccatcgcgtcttctcttcgggacaggccttaggaggccacaagcgatgccattggctaacaccttccaattatcttcgtatgacgtcgctccacgatcatcatcattccgtcggcagaccgcagccgttagatcaaccatctctcgatctcaacttagcttgccaagaatattccgtcgatccaacggccatgagcgtagggatgatcgagagagatggtggtggcaataatcacaacgctacttcatcttcgtggttaaaactcgcaagtggtgattggtcttga

SEQ ID NO: 228 - protein, 267 aa, Arabidopsis thaliana
MHGAMNSPCIDFVMFSRGQHDEDNMSRRPPWKRERSMSTQHHHLNLSPNEDEELANCLVLLSNSGDAHGGDQHKQHGHGKGKTVKKQKTAQVFQCKACKKVFTSHQALGGHRASHKKVKGCFASQDKEEEEEEEYKEDDDDNDEDEDEEEDEEDKSTAHIARKRSNAHECTICHRVFSSGQALGGHKRCHWLTPSNYLRMTSLHDHHHSVGRPQPLDQPSLDLNLACQEYSVDPTAMSVGMIERDGGGNNHNATSSSWLKLASGDWS

SEQ ID NO: 229 - DNA, 944 bp, Arabidopsis thaliana
caatattgtcatatacaatggagaaacctggtggcttctggatccccaagaaaagcaacaaagagtcatcttgggaagagctggcctttgcagaagacgatgccgccggatctttgtggccgccaagatcttatacgtgtagcttctgccggagagaatttaaatcggctcaagccctcggtggccatatgaacgttcaccgaagagacagagcacggcttaagcaagccgacgaccaatacttattccccaaatcttcttcgtctccagagtatccatctcataaagatagcgataatattcatgaaacctcttgctatactttggtttttaacaccaaacctaattattttaagactcaacactcttgtgttattgatctttcttcgtcttcttctttaccatatttgactccttctagggtttcttctggtttgcctggaaagcaacatacttcttcttctcctccttctttcgttgtagaaccttccaagaactctaaatatattccctcttcttccccatggtcgtgcccaagtactgttgtggagcaaaagagttgtgatctatatgaaattccggctatggaaggagaaaagaagagaaagactgagagtgatgtgccaaaaatcgggcataaagcaaaacttagtcttggaaacaccactgatctctcggtgagtatgaatctggtcatccaccaaagttttccgattactgctcacggtagcgatgaagagattggtagggtggatatccgtaaaagaagacgaagacatgagagtccgtcgcagcagtcgattttcatttcaagtttatcttgtaagagtgacataattacaagaaacgaggaaagcaaacacaaaggtgatcgctttgaggatttagatcttgagcttaggctagggactgatccaccaaaaggaatttgattgatggaccga

SEQ ID NO: 230 - protein, 304 aa, Arabidopsis thaliana
MEKPGGFWIPKKSNKESSWEELAFAEDDAAGSLWPPRSYTCSFCRREFKSAQALGGHMNVHRRDRARLKQADDQYLFPKSSSSPEYPSHKDSDNIHETSCYTLVFNTKPNYFKTQHSCVIDLSSSSSLPYLTPSRVSSGLPGKQHTSSSPPSFVVEPSKNSKYIPSSSPWSCPSTVVEQKSCDLYEIPAMEGEKKRKTESDVPKIGHKAKLSLGNTTDLSVSMNLVIHQSFPITAHGSDEEIGRVDIRKRRRRHESPSQQSIFISSLSCKSDIITRNEESKHKGDRFEDLDLELRLGTDPPKGI

SEQ ID NO: 231 - DNA, 414 bp, Arabidopsis thaliana
atggagtgtgagagatcatcgtcgtccacgtcatcagaaaccggagcagtcaggcaccgtcgtacgtcgtcgtcgtcagtctccaccgtgacgagacgaatgtacgagtgcactttctgcaaaagaggtttcacaaacgcacaagctttaggtggtcatatgaacatccatcgacgtgaccgtctcaacaaggccaaggtgcaaaacgatgctgacgtggcactctcgcaaactcatagatgtttccacgtggcgtctgaccttggaggctacgagcaagtagactccgtcgtgttgaggacgacgacctcgaactacatccaacacttacgaatcggctcgatggctacaaggagagaaaacgtcgtcgttgaaggaaatgaaatcgatttggagctgcgtcttggcttatga

SEQ ID NO: 232 - protein, 137 aa, Arabidopsis thaliana
MECERSSSSTSSETGAVRHRRTSSSSVSTVTRRMYECTFCKRGFTNAQALGGHMNIHRRDRLNKAKVQNDADVALSQTHRCFHVASDLGGYEQVDSVVLRTTTSNYIQHLRIGSMATRRENVVVEGNEIDLELRLGL

SEQ ID NO: 233 - DNA, 1131 bp, Arabidopsis thaliana
cgtcgacaccaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatcttccctaaatgggggagttttttttttgtttgtttgtttctccttcatttctcccaactttgatctcagaattaggcgcggccgct

SEQ ID NO: 234 - protein, 331 aa, Arabidopsis thaliana
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 235 - DNA, 525 bp, Arabidopsis thaliana
gttgaaggatgaagatacaatgtgaagtgtgtgaaaaggctgaagcagaagtactttgttgttcagatgaagctgtactatgcaagccatgtgacattaaggttcatgaagctaataaacttttccaaagacatcaccgagtcgccttacaaaaagatgcagcctcagccaccacagcttctggagctcctctatgtgatatctgccaggagagaaaagggtacttcttctgcttagaggatagagcaatgctgtgcaatgattgtgatgaagccattcacacttgcaattctcaccaaagattcttactttctggagtacaagtttctgatcagtctttgactgaaaactccgaatgcagcactagttttagctctgaaacttaccagattcagtcaaaagtgtctctgaatagtcagtactctagtgaggaaactgaagctggaaactcaggtgagatagtacacaagaatccttctgtaatcttaagtccttagagatatacacacaacatcatggttccgg

SEQ ID NO: 236 - protein, 162 aa, Arabidopsis thaliana
MKIQCEVCEKAEAEVLCCSDEAVLCKPCDIKVHEANKLFQRHHRVALQKDAASATTASGAPLCDICQERKGYFFCLEDRAMLCNDCDEAIHTCNSHQRFLLSGVQVSDQSLTENSECSTSFSSETYQIQSKVSLNSQYSSEETEAGNSGEIVHKNPSVILSP

SEQ ID NO: 237 - DNA, 2090 bp, Arabidopsis thaliana
cttgggttcgagctacatagagagaggtatgatgaatccgagtcacggaagaggactcggatcggctggtgggtccagctccggtagaaatcaaggaggtggtggtgagaccgtcgtcgagatgtttccttctggtcttcgagttcttgtcgttgacgatgacccaacttgtctcatgatcttagagaggatgcttaggacttgtctttacgaagtaacgaaatgcaacagagcagagatggcattgtctctgctccggaagaacaaacatggattcgatatagtaatcagtgatgttcatatgcctgacatggacggtttcaagcttcttgagcatgttggtctagagatggacttacctgttatcatgatgtctgcggatgattcaaagagtgtggttctaaagggagtaacgcacggtgcggttgattaccttatcaagcctgtacgtatggaggcacttaagaacatatggcagcatgtagttaggaagaggagaagtgaatggagtgtaccggaacattctgggagcattgaggagactggcgagagacagcagcagcaacatagaggaggtggtggtggtgcagctgtttctggtggagaggatgcggtggatgataactcatcctcggttaacgaaggtaacaattggaggagcagttcacggaagaggaaagacgaggaaggagaagagcaaggagatgataaggacgaagatgcgtcgaatttgaagaaaccgcgtgtcgtctggtctgttgaattgcatcagcagtttgttgctgctgttaatcagctcggcgttgagaaggcggttcctaaaaagatcttagagctgatgaatgttcctggtctaacccgagaaaacgtagcaagtcacctccagaaataccggatatatctaagacggcttggaggggtatcgcagcaccaaggcaatcttaacaactcgtttatgacgggtcaggatgcgagcttcggacctctttcgacattgaatgggtttgatcttcaagcactagccgtcacaggtcagttacctgcacagagtcttgcacagcttcaagccgctggtttaggccggcctgcgatggtctctaagtcaggtttgccggtttcctccattgtggatgagagaagcatcttcagctttgacaacacgaaaacaagatttggagaagggcttgggcatcacgggcaacaaccccaacagcaaccacagatgaacttacttcacggtgtccccacgggtttacaacagcagcttcctatgggtaatcgaatgagtattcaacaacagattgctgctgttcgagctggaaatagtgttcaaaacaacggaatgctgatgcctctagcgggtcagcagtctttgcctcggggaccaccgcctatgctaacctcttcgcaatcatccatcaggcagccgatgttatcaaaccgcatttccgagagaagtggtttctctggaaggaacaatatccccgagagcagcagagtgttaccgacaagttacactaatctcacaacacaacactcatcaagctcgatgccttataacaacttccaaccagaacttcccgtgaacagtttcccgctggcaagtgcaccagggatatcagtaccggttcggaaagccacttcttaccaggaagaggttaacagctccgaagcgggtttcactacgccgagctacgacatgttcaccaccagacagaatgattgggatctgaggaatattggaatagcctttgactcacatcaggactcagaatccgctgcgttttccgcttcagaagcctactcttcttcgtccatgtcaagacacaacacgacagttgcagccaccgagcatggccgaaaccaccagcagccaccatcgggaatggtacagcaccatcaggtttatgcagacggaaacggtggttcagtgagggtgaaatcagagagagtggctacggatacagcaacaatggcgtttcacgagcagtatagtaatcaagaagatcttatgagcgcacttcttaagcaggtttgatttgatttttttttttttttgtcaaacttatatagaagcataatctgatccg

SEQ ID NO: 238 - protein, 669 aa, Arabidopsis thaliana
MMNPSHGRGLGSAGGSSSGRNQGGGGETVVEMFPSGLRVLVVDDDPTCLMILERMLRTCLYEVTKCNRAEMALSLLRKNKHGFDIVISDVHMPDMDGFKLLEHVGLEMDLPVIMMSADDSKSVVLKGVTHGAVDYLIKPVRMEALKNIWQHVVRKRRSEWSVPEHSGSIEETGERQQQQHRGGGGGAAVSGGEDAVDDNSSSVNEGNNWRSSSRKRKDEEGEEQGDDKDEDASNLKKPRVVWSVELHQQFVAAVNQLGVEKAVPKKILELMNVPGLTRENVASHLQKYRIYLRRLGGVSQHQGNLNNSFMTGQDASFGPLSTLNGFDLQALAVTGQLPAQSLAQLQAAGLGRPAMVSKSGLPVSSIVDERSIFSFDNTKTRFGEGLGHHGQQPQQQPQMNLLHGVPTGLQQQLPMGNRMSIQQQIAAVRAGNSVQNNGMLMPLAGQQSLPRGPPPMLTSSQSSIRQPMLSNRISERSGFSGRNNIPESSRVLPTSYTNLTTQHSSSSMPYNNFQPELPVNSFPLASAPGISVPVRKATSYQEEVNSSEAGFTTPSYDMFTTRQNDWDLRNIGIAFDSHQDSESAAFSASEAYSSSSMSRHNTTVAATEHGRNHQQPPSGMVQHHQVYADGNGGSVRVKSERVATDTATMAFHEQYSNQEDLMSALLKQV

SEQ ID NO: 239 - DNA, 1023 bp, Arabidopsis thaliana
aattagctctgcaaaggctcttcattcttctcgcttggattcctctgcacaaaagaaaaaagaccatggatgatcttcatggaagaaatggtcgaatgcacattggtgtagcgcaaaatccaatgcatgtgcagtatgaagatcacggtttgcaccatatcgacaatgaaaacagtatgatggatgaccatgctgatggtgggatggatgaaggagtggagacagacattccttctcaccctggaaactcagctgataatcgtggtgaagttgtagaccgtggaattgaaaatggagatcaattgacattgtccttccagggacaagtttatgtttttgaccgtgtctcgcctgagaaggttcaagctgtgcttttgttacttggtggaagggaagtaccacatacactcccaacaaccctaggatcacctcatcagaacaatagggtactgggtctatctggtactcctcaacggcttagcgttccgcagcggttagcttctttgctcaggtttagggagaaacgaaaagggaggaactttgataagactattcgctatacagtcaggaaagaagtagccttgagaatgcagcgtaagaaaggtcagttcacgtcggctaaatcaagcaatgatgattctggatccactggatcggattgggggtcaaaccagagctgggccgtagaagggactgagactcagaagccagaggttttatgtcgacactgtggaacaagtgagaagtcaactccaatgatgcgacgtggacctgatgggccaagaacactttgtaatgcgtgtggactgatgtgggcaaacaaggggactcttagagacctatccaaagtccctcctccgcaaacacctcagcatctatctctgaataagaatgaggacgcaaatcttgaggctgatcaaatgatggaagtaactggtgacattagcaacacacagtgagaactgagaaaccattggaagcaagaaaggatctcaaacaaaaacagttgttatcatttcattt

SEQ ID NO: 240 - protein, 297 aa, Arabidopsis thaliana
MDDLHGRNGRMHIGVAQNPMHVQYEDHGLHHIDNENSMMDDHADGGMDEGVETDIPSHPGNSADNRGEVVDRGIENGDQLTLSFQGQVYVFDRVSPEKVQAVLLLLGGREVPHTLPTTLGSPHQNNRVLGLSGTPQRLSVPQRLASLLRFREKRKGRNFDKTIRYTVRKEVALRMQRKKGQFTSAKSSNDDSGSTGSDWGSNQSWAVEGTETQKPEVLCRHCGTSEKSTPMMRRGPDGPRTLCNACGLMWANKGTLRDLSKVPPPQTPQHLSLNKNEDANLEADQMMEVTGDISNTQ

SEQ ID NO: 241 - DNA, 1197 bp, Arabidopsis thaliana
atggattcaaattttcattactcgatagatcttaacgaagatcaaaaccatcacgaacaaccctttttctatcctcttggatcctcttcctcgcttcatcatcatcatcatcatcatcatcatcaagtcccttctaattcttcatcttcttcttcgtccatttcatcgctctcctcttacctccctttcttgatcaactctcaagaagatcaacatgttgcctacaacaacacttatcacgctgatcatctccatctttctcaacccctcaaggccaagatgtttgtggctaacggtggatcatcagcatgcgatcacatggtgccaaagaaggagacaagactgaaactaacgataaggaaaaaagatcacgaagaccaaccccatcctcttcatcaaaacccgacaaaacccgattcagactccgacaagtggttgatgtccccaaagatgcggttgatcaagaaaacaatcaccaacaataaacagctcattgatcagactaataataataatcataaagaaagtgatcactaccctttgaatcataagactaatttcgacgaggatcaccatgaagatcttaatttcaagaacgtcttgaccaggaagaccacggccgcgaccaccgagaatcgctacaatacaatcaacgagaacggttatagtaataacaatggcgtgattagggtttgttcggattgtaacaccaccaagactcctctttggcgaagtggacctcgaggtcccaagtctctttgtaacgcatgtggtatacggcaaagaaaggcaaggcgagccgctatggccgcggccgctgcagccggcgaccaagaggtggcggtagcgccccgagtgcaacaattaccgctgaaaaagaagttgcaaaataaaaaaaagagatcaaacggaggggaaaaatacaatcactctcctccaatggtggccaaggccaaaaagtgcaagatcaaagaggaagaggagaaggaaatggaagcggaaacggttgccggagattcagagatcagcaaatctacaacttcttctaattcttcgatttcgtcaaacaaattttgcttcgatgatttgacaataatgttgagcaaaagctcagcttatcaacaagtgttcccacaagatgagaaggaggctgctgttttgctcatggctctgtcgtatggaatggttcacggttga

SEQ ID NO: 242 - protein, 398 aa, Arabidopsis thaliana
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSACDHMVPKKETRLKLTIRKKDHEDQPHPLHQNPTKPDSDSDKWLMSPKMRLIKKTITNNKQLIDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKRSNGGEKYNHSPPMVAKAKKCKIKEEEEKEMEAETVAGDSEISKSTTSSNSSISSNKFCFDDLTIMLSKSSAYQQVFPQDEKEAAVLLMALSYGMVHG

SEQ ID NO: 243 - DNA, 2385 bp, Arabidopsis thaliana
atgttgacaatgggagaaggtaatgtgatgacttcaaacaacagatttgcttcgccgccgcagcagccgtcttcttcttctccgggaacaatccaaaaccctaatttcaatttcatacctttcaactcatattcatccattatcccgaaggaagagcatgggatgatgagtatgatgatgatgatgggagatggaacagtagaggaaatgatggaaaacgggtcggcgggtgggtcattcgggtcaggtagtgaacaagcagaagatccaaagtttggaaacgaatctgatgtcaatgagcttcatgacgatgaacaacctcctccggctaagaagaaacgttatcacagacacactaatcgtcagatccaagaaatggaagcgttgtttaaagaaaaccctcatccagacgacaaacaaagaaagagattaagtgctgaacttggtcttaagcctcgacaagtcaagttttggttccaaaataggcgtacccaaatgaaggcacaacaagacagaaatgagaatgtgatgttaagggcagagaacgataatcttaagtcggagaattgtcatcttcaggcggagctacggtgcctctcttgtccttcttgcggcggccccaccgtccttggcgacattcctttcaacgagatccacattgagaactgtcgcctccgtgaagagcttgatcgtctgtgctgcattgcctcgagatacactggccgtccgatgcaatctatgccaccatctcagccattgatcaatccttctccgatgcttccacatcatcaaccttcattggagctagacatgagtgtatacgctgggaactttccagaacaatcttgtacagacatgatgatgcttcctccacaagatacagcttgtttcttcccagatcaaactgccaacaataacaacaacaacaacatgttacttgcggatgaagaaaaggttatcgctatggaattcgctgtctcttgtgttcaagaacttactaaaatgtgtgacacagaagagcctttgtggattaagaagaaatcagacaagattggcggcgaaattttgtgtcttaacgaggaagagtacatgaggttgttcccatggccgatggagaatcaaaacaacaaaggagattttcttagagaagcttcaaaggcgaatgcagtcgttatcatgaacagcataacactagttgacgcctttctaaacgctgataaatggtcagagatgttctgttcaatcgtggctagggcgaaaactgttcagataatttcatcaggagtttctggagctagtggttctctccttctgatgtttgcagagttacaggtactatctcctctggttccaactagagaagcttattttcttcggtatgtggaacaaaacgcagaaaccggaaattgggcaatcgtggatttcccgatcgatagcttccatgaccaaatgcagccaatgaatactattactcatgagtataagagaaaaccttcaggctgcatcattcaggacatgcctaatggatactcacaagtcaagtgggtggagcatgttgaagtagacgagaaacatgtgcacgagacttttgctgagtatgtgaaaagcggaatggcttttggagctaaccgttggctcgacgtgttgcagagacaatgcgagaggatcgctagtctaatggctagaaacataactgatcttggagtaatttcatctgcagaagcaaggaggaacataatgaggttatcacagagacttgtgaaaacattctgtgtgaatataagcactgcatatggacagtcttggaccgctttgtctgagacaactaaggacaccgtgaggatcacgacaaggaaaatgtgtgaacctggtcagccaacaggagttgttctttgtgctgtctcaaccacttggcttccattttctcaccatcaagtctttgatcttatccgtgatcaacatcaccaatctctggtcgcaagcaactcatggcataatgttgagctgatgcttcaagaaagctgcattgataactccggtagcttaatcgtctactccaccgtcgacgttgactcaattcagcaggcgatgaacggtgaagattcttccaatattccgattttacccctcggattctccattgtccccgtgaatcctcccgagggtatttccgtcaattcgcattctccgccgtcgtgtcttctcaccgtcgggattcaggtcttggcgagtaacgtcccaacagcgaaaccaaatctctccaccgtcaccaccatcaataaccatctctgcgccaccgttaatcagatcacttctgccctcagcaacaccattacgccggtgattgcatcttccgctgacgtgtccaatcaagaagtcagctag

SEQ ID NO: 244 - protein, 794 aa, Arabidopsis thaliana
MLTMGEGNVMTSNNRFASPPQQPSSSSPGTIQNPNFNFIPFNSYSSIIPKEEHGMMSMMMMMGDGTVEEMMENGSAGGSFGSGSEQAEDPKFGNESDVNELHDDEQPPPAKKKRYHRHTNRQIQEMEALFKENPHPDDKQRKRLSAELGLKPRQVKFWFQNRRTQMKAQQDRNENVMLRAENDNLKSENCHLQAELRCLSCPSCGGPTVLGDIPFNEIHIENCRLREELDRLCCIASRYTGRPMQSMPPSQPLINPSPMLPHHQPSLELDMSVYAGNFPEQSCTDMMMLPPQDTACFFPDQTANNNNNNNMLLADEEKVIAMEFAVSCVQELTKMCDTEEPLWIKKKSDKIGGEILCLNEEEYMRLFPWPMENQNNKGDFLREASKANAVVIMNSITLVDAFLNADKWSEMFCSIVARAKTVQIISSGVSGASGSLLLMFAELQVLSPLVPTREAYFLRYVEQNAETGNWAIVDFPIDSFHDQMQPMNTITHEYKRKPSGCIIQDMPNGYSQVKWVEHVEVDEKHVHETFAEYVKSGMAFGANRWLDVLQRQCERIASLMARNITDLGVISSAEARRNIMRLSQRLVKTFCVNISTAYGQSWTALSETTKDTVRITTRKMCEPGQPTGVVLCAVSTTWLPFSHHQVFDLIRDQHHQSLVASNSWHNVELMLQESCIDNSGSLIVYSTVDVDSIQQAMNGEDSSNIPILPLGFSIVPVNPPEGISVNSHSPPSCLLTVGIQVLASNVPTAKPNLSTVTTINNHLCATVNQITSALSNTITPVIASSADVSNQEVS

SEQ ID NO: 245 - DNA, 462 bp, Arabidopsis thaliana
atggatcatggtaggttaatggatgatcaaatgatgctaggctctcaagtgtacccctacacgacccaaccccaaaattcacactgcatcatcgttaaccagatcgatggaggcgaagaatcaaaaccggtgaagcggaggaggaagaggaggagtaaaggttcatcagccaccaacgaagaagacgtggcggagatcggagggatgttgaggaagaggaagttgaccgatgaacaagtgaacatgctcgaatatagcttcgggaacgagcataagctggagtcagggaggaaggagaagatcgccggagagttaggtcttgacccgagacaggtggctgtttggttccagaaccgccgtgcacgttggaagaacaagaaactagaggaagagtacgccaaactcaaaaaccaccacgacaacgtcgtactcggccaatgccaactcgagtctcaggtataa

SEQ ID NO: 246 - protein, 153 aa, Arabidopsis thaliana
MDHGRLMDDQMMLGSQVYPYTTQPQNSHCIIVNQIDGGEESKPVKRRRKRRSKGSSATNEEDVAEIGGMLRKRKLTDEQVNMLEYSFGNEHKLESGRKEKIAGELGLDPRQVAVWFQNRRARWKNKKLEEEYAKLKNHHDNVVLGQCQLESQV

SEQ ID NO: 247 - DNA, 1291 bp, Arabidopsis thaliana
tttttctccaaacccataagccaaaatagccaaaactactttctaccatttgtctattactccttcaaccatatcattcacatctcctcagtttcgataaaacaaacaaagccctaatatttttacttgctatatcgctgtctctctcccttctcctctataaacatacatataaattaagtacacaccaaaatgtggacgatgggttacaacgaaggaggcgcagattccttcaacggaggaagaaagcttcgtcctctcatcccacgtctcacttcttgccccaccgccgccgtaaacaccaactccgaccaccgctttaatatggcagtggtgacgatgacggcggagcagaacaagagggagctgatgatgctaaactcagaacctcaacatccaccggtaatggtgagctcacggtggaatccgacaccagatcagttaagggttcttgaagagctttaccgacaaggaactagaactccttctgccgaccacatccaacaaatcaccgcacagctacgacggtacgggaagatagaaggcaaaaacgttttctattggttccaaaaccacaaagcccgagaacgccagaaacgacggcgacaaatggaaactggccacgaagaaacggtcctttcaacagcaagtcttgtctcaaaccacggattcgacaagaaagatcctccaggttacaaggttgaacaggtcaagaactggatatgttcggtcggatgcgacacgcaaccagagaaaccttcccgtgattatcatctggaggagccagcgaatatacgggtggagcacaatgctcgttgtggaggagacgagagacgaagctttttagggataaacaccacgtggcagatgatgcagttgccacctagtttctactcttcttcacatcatcatcatcaacgtaacctcattctcaattcacctactgtttcctccaacatgtccaacagcaacaatgctgtctctgcttctaaagatacggtcacggtttcacctgtatttctacgtacgagagaagcaacgaacacagagacttgtcatcgaaatggtgatgataataaagatcaagaacaacatgaagattgctccaacggtgaattggatcatcaagaacagacacttgagctgtttccactgagaaaagaagggttttgtagcgatggtgagaaagacaagaacattagtggcattcactgtttctatgagtttctgccattgaagaactaaacctaattgaagtctttcaagaaaaaaaaaaaaaaaaaaaaaaaaa

SEQ ID NO: 248 - protein, 350 aa, Arabidopsis thaliana
MWTMGYNEGGADSFNGGRKLRPLIPRLTSCPTAAVNTNSDHRFNMAVVTMTAEQNKRELMMLNSEPQHPPVMVSSRWNPTPDQLRVLEELYRQGTRTPSADHIQQITAQLRRYGKIEGKNVFYWFQNHKARERQKRRRQMETGHEETVLSTASLVSNHGFDKKDPPGYKVEQVKNWICSVGCDTQPEKPSRDYHLEEPANIRVEHNARCGGDERRSFLGINTTWQMMQLPPSFYSSSHHHHQRNLILNSPTVSSNMSNSNNAVSASKDTVTVSPVFLRTREATNTETCHRNGDDNKDQEQHEDCSNGELDHQEQTLELFPLRKEGFCSDGEKDKNISGIHCFYEFLPLKN

SEQ ID NO: 249 - DNA, 774 bp, Arabidopsis thaliana
caaaagaggtaaaaaaaaagaagaagagaagatggaatattggagcagctccttcatcgatggcgcgtcttcttccagcttcatctctcctttctataactttgaccatttttcaggaaaccaagacaacagatgtttaggtacaatgatgggtgcacaacaagatatacttcatgttcctctagcaatggtagagagtggctatggagaagaaagcaacagttttaatggacaggagaagaaaaaaaagaagatgacgagcgagcagctaaagttcctcgagagaagtttccaagaagagataaagctgaatccggacaggaagatgaagctgaatccggacaggaagatgaagctgtccaaagaactggggctgcagccgagacagattgcggtttggttccagaacaggaaagccaggtggaagaacaaacaacttgagcatctctatgaatcactaagacaagagtttgatattgtctctagagaaaaggaattgctacaagaagagctaatacaactgaaatcaatgataagagaggatagttcatgcaagaagaaacaaacctgggaaaaagcctgcagctgaggcaatagtatataagttccacttcagttatatctccaaaatggctcaaatttgtagctttagtcccaaacaagcaacaatttctatggctgattctgttttcctttgtattaagtattgtttaagtgattttcgtgtaaagggttctttactaagttgaagttaatgaagaaacatcgtgattc

SEQ ID NO: 250 - protein, 185 aa, Arabidopsis thaliana
MEYWSSSFIDGASSSSFISPFYNFDHFSGNQDNRCLGTMMGAQQDILHVPLAMVESGYGEESNSFNGQEKKKKKMTSEQLKFLERSFQEEIKLNPDRKMKLNPDRKMKLSKELGLQPRQIAVWFQNRKARWKNKQLEHLYESLRQEFDIVSREKELLQEELIQLKSMIREDSSCKKKQTWEKACS

SEQ ID NO: 251 - DNA, 1473 bp, Arabidopsis thaliana
ggcaccacaaattcttcttgattccttgatcatctatattatatttatataatcaataaatattcttcctatacagcgagagagagagagtatataagctataaatatggcgtcctcatcagaactaagcttggattgcaagccacaaagctactctatgcttttgaaatcctttggagataactttcagagcgatccaaccacacataagcttgaagatcttctctctcgcctagaacaagaacgtctcaagatcgatgccttcaaacgcgagcttcccctttgcatgcaactccttaacaatgctgtggaagtttacaaacaacaactagaagcatatagagcaaatagtaataacaataaccaaagtgttggtacaagaccagttctcgaagagttcatacccttaaggaaccaacccgaaaagacaaacaacaaaggaagtaattggatgacgactgctcagctatggagccaatccgaaaccaaaccaaaaaacattgattcaactactgatcaatctcttcccaaagacgagattaatagtagtccgaaactcggacattttgatgcaaaacaaagaaatggcagcggtgcttttcttcccttctctaaggaacaatctttgcctgaattagctctatccacggaggtcaagagggtctctccgaccaacgaacatactaatggccaagacggtaatgatgagagcatgatcaacaatgataataactataataataataataataacaattcgaacagcaatggagtttcttctacaacgagtcaaagtaatagaaaggcacgacgttgctggtcgccggacttgcaccggagatttgtccaagctcttcaaatgcttggtggctcgcaagtggctacacctaaacaaataagggaactcatgaaagttgatggtttgaccaatgatgaagtcaaaagccatctccagaagtatcggcttcacactagaagaccaagcccaagcccacaaacgtcaggtgggccaggtccacatttggtggtcctaggtggcatatgggttccaccggagtacacctccgcacatggtggcactccgactctctaccaccaccaagtccaccaccaccataccaacacggcagggccgcctccaccacacttttgctcctctcaagaattctacacaactccaccgcctcctcagccgctccaccaccaccactttcaaacgtttaacggttcatccggtggcaccgcctctaccgattctactcatcatcaggtgacggacagtcccacagttgaagggaagtcaccggagagtggtggtggagagagaaaagggttggctgctcttagggaagaatgtgaagatcacagcaatattaatggaagtgaaataactctcaaattctaaaaaaaataaagattcttgattaattaattagagtaatgagattttagggttagggtttgtgggtgcct

SEQ ID NO: 252 - protein, 432 aa, Arabidopsis thaliana
MASSSELSLDCKPQSYSMLLKSFGDNFQSDPTTHKLEDLLSRLEQERLKIDAFKRELPLCMQLLNNAVEVYKQQLEAYRANSNNNNQSVGTRPVLEEFIPLRNQPEKTNNKGSNWMTTAQLWSQSETKPKNIDSTTDQSLPKDEINSSPKLGHFDAKQRNGSGAFLPFSKEQSLPELALSTEVKRVSPTNEHTNGQDGNDESMINNDNNYNNNNNNNSNSNGVSSTTSQSNRKARRCWSPDLHRRFVQALQMLGGSQVATPKQIRELMKVDGLTNDEVKSHLQKYRLHTRRPSPSPQTSGGPGPHLVVLGGIWVPPEYTSAHGGTPTLYHHQVHHHHTNTAGPPPPHFCSSQEFYTTPPPPQPLHHHHFQTFNGSSGGTASTDSTHHQVTDSPTVEGKSPESGGGERKGLAALREECEDHSNINGSEITLKF

SEQ ID NO: 253 - DNA, 703 bp, Arabidopsis thaliana
aacctaaaaattttacgagagataaaaaaaatgcaagatccgatggttagatcttacattaggtcagacaatccgcgaatgcactggaccgacgatcttgatatccgttttattcaagttattgaaaaactcggtggcgaagagagtgcaactcctaagagaattttgagtcttatgggtgtgagagacctcacaatatcacatgtcaaaagtcatctccagatgtataggaacaaaaagaaagaagaatctagtaaagaaataaaaatgatgcgggagatgacacagaggcaatctcagcaatatcttcaaatctatgaacgtgctacccaatttatccaaaatcaacaaaggctacaactggataatactgagaagataaccccagttttgggatcaagtaacaagtctctagatcaatcttcaaaggttggactaaatgaaaacagaggcaatgatgttgttgttgttggtggtgcaactggtgaagaagaattgtcccttgaactcactcttggtcgcaagtactaagaggagtttggtttctatctttttttttatgcttgctctctattttatgtaatgcttatctcatatatataatgggataagaaaaataaaaactgaacaatattttatggtattctatttataatgctattatgtgattttgcatccatgctatttgggggaaatattattt

SEQ ID NO: 254 - protein, 166 aa, Arabidopsis thaliana
MQDPMVRSYIRSDNPRMHWTDDLDIRFIQVIEKLGGEESATPKRILSLMGVRDLTISHVKSHLQMYRNKKKEESSKEIKMMREMTQRQSQQYLQIYERATQFIQNQQRLQLDNTEKITPVLGSSNKSLDQSSKVGLNENRGNDVVVVGGATGEEELSLELTLGRKY

SEQ ID NO: 255 - DNA, 844 bp, Arabidopsis thaliana
ccctttgagtttttttttggggtgaaactcatctctttgagttccttcaaccattttgaaaacagcttgccggaaacattggtgaattttcatcgaatcgcgagtttcagtaagatataaaacagatgaagaacccaatcgttagatcttatgttagatcaaaagtgccgcggttgcggtggaactctgatcttcataactcttttgttcaagctgttgaacaactaggtggagaaaatagagcaactcctaaaatggttttacagttaatggatgtgagaggactcacaatatcacatgtgaagagtcatctccagatgtataggggcatgaagcttgaagaatccatgcaagaagagatattagcaaagagaagtgttagagtgacaggacaagtaacttggtggcaatttcaacattaccttcataactaccaacgtcttcagggcaatgccaactttttccaaaatcaacaaaggcaagaagcgggaatatatgaaaaaattataacatttggacaatcaagtaatgaaactaaggaagtaccaagtgactactttacctgcaagtctctctatgaaacatccagagctccacaaaataaaacgagagatgatgatgaaaatggtgaagctgttgttgctattgaagatgatggtaatgttgttgatgaacatgatgatgaggatgctaatgatgatgaggttactttgtcactaaactcaataaaagtttcaaaaagtgaagaagaattgtcccttgagctcactcttggtctcaaagcataacatgttttgattttgatttttttttttttgtagaaaccgttggaagtatgttgtag

SEQ ID NO: 256 - protein, 220 aa, Arabidopsis thaliana
MKNPIVRSYVRSKVPRLRWNSDLHNSFVQAVEQLGGENRATPKMVLQLMDVRGLTISHVKSHLQMYRGMKLEESMQEEILAKRSVRVTGQVTWWQFQHYLHNYQRLQGNANFFQNQQRQEAGIYEKIITFGQSSNETKEVPSDYFTCKSLYETSRAPQNKTRDDDENGEAVVAIEDDGNVVDEHDDEDANDDEVTLSLNSIKVSKSEEELSLELTLGLKA

SEQ ID NO: 257 - DNA, 1238 bp, Arabidopsis thaliana
ttagatttgctattctctcattaccctatcaaccctaagtaatctctttagctctcgattatcatcattacaccatcatcatgtcctcctcaaacaaaaattggccaagcatgttcaaatccaaaccttgcaacaataatcatcatcatcaacatgaaatcgatactccatcttacatgcactactctaattgcaacctatcatcttccttttcctcagatcggataccagatcctaaaccgagatggaatcctaaaccggagcagattaggatactcgaatcaatcttcaattccggtactattaacccacctagagaggagattcaaagaatccggatccggcttcaagaatatggtcaaatcggtgacgcaaacgtgttttactggtttcaaaaccggaaatctcgagcaaaacacaagcttcgtgttcatcacaaaagccctaaaatgtcaaagaaggacaagacggttattcctagtactgacgctgatcattgttttggttttgttaaccaagaaaccggattatatccggttcaaaacaatgagttggtggtaaccgaaccggccggttttctatttccggttcataatgatccgagcgctgctcaatcagcgtttggttttggcgattttgttgtaccggtggtaacggaagaagggatggcattctctaccgttaataacggcgttaatttggagactaacgaaaattttgataaaattccggcgatcaatttatacggcggagatggaaatggcggtggaaattgttttcctcctttgactgttccattaaccatcaatcaatctcaagaaaaacgagatgtaggattatccggtggtgaagacgtcggagataatgtttatccggtgagaatgacggtgtttattaacgagatgcctatcgaagtagtgtctggattattcaacgttaaggcagctttcggaaacgatgccgttttgatcaactcgtttggccagcctattcttacagatgaatttggtgttacttatcaacctctccaaaatggcgcaatctattatcttatttagaagatattgaaaagcaaatgttatggtgctatggataaatattaatataataataaaagatttctgcgatttatttagttattaattatataagaatttcatttcttatcttttaaatttatgaaccaatttccgggcaatttcctttttcgagaactttggaaaaattaaggaatggaa

SEQ ID NO: 258 - protein, 325 aa, Arabidopsis thaliana
MSSSNKNWPSMFKSKPCNNNHHHQHEIDTPSYMHYSNCNLSSSFSSDRIPDPKPRWNPKPEQIRILESIFNSGTINPPREEIQRIRIRLQEYGQIGDANVFYWFQNRKSRAKHKLRVHHKSPKMSKKDKTVIPSTDADHCFGFVNQETGLYPVQNNELVVTEPAGFLFPVHNDPSAAQSAFGFGDFVVPVVTEEGMAFSTVNNGVNLETNENFDKIPAINLYGGDGNGGGNCFPPLTVPLTINQSQEKRDVGLSGGEDVGDNVYPVRMTVFINEMPIEVVSGLFNVKAAFGNDAVLINSFGQPILTDEFGVTYQPLQNGAIYYLI

SEQ ID NO: 259 - DNA, 904 bp, Arabidopsis thaliana
atccacacacacacacatctctctctatataaccctaagtgtttggagatagcatcactagagaacacacacacaaagcatcaatatttgtctgaacggagaatgagtcctgtggcttcaacgaggtggtgtccgacgccggagcaactgatgatcttggaagagatgtaccggagtggtatacggactccgaatgcggtgcagatacaacagatcacagctcacttggcgttctatggaagaatcgagggcaaaaacgtcttttactggttccagaaccataaggctagagatagacagaagctgaggaagaaactagccaagcaacttcaccagcaacaacatcaacttcaactccaacttcagcagatcaaaccaaaaccaatatcatcgatgatttctcaaccagttaataagaatatcatcgatcatcacaatccttatcatcatcaccatcataatcatcatcataatcatcatcgtccatatgatcatatgtcctttgattgctgctctcatccttctcccatgtgtcttcctcatcagggaactggagtaggagaagctccaagcaaagtgatgaatgaatattactgcaccaaaagtggagctgaagagatattgatgcaaaaatcaatcacgggtccaaactcatcgtacggtcgagattggatgatgatgatggatatgggcccacgaccatcatatccctcatcatcatcatcacccatttcatgttgtaacatgatgatgagcagtccaaagataccattgaaaaccctggaacttttcccaatctcatctatcaactccaaacaagacagtaccaaactttaaagaaaagacaacaaatacaaaagagattctgcaggtgtttcattcatgtatcactgtatgatgtgtc

SEQ ID NO: 260 - protein, 244 aa, Arabidopsis thaliana
MSPVASTRWCPTPEQLMILEEMYRSGIRTPNAVQIQQITAHLAFYGRIEGKNVFYWFQNHKARDRQKLRKKLAKQLHQQQHQLQLQLQQIKPKPISSMISQPVNKNIIDHHNPYHHHHHNHHHNHHRPYDHMSFDCCSHPSPMCLPHQGTGVGEAPSKVMNEYYCTKSGAEEILMQKSITGPNSSYGRDWMMMMDMGPRPSYPSSSSSPISCCNMMMSSPKIPLKTLELFPISSINSKQDSTKL

SEQ ID NO: 261 - DNA, 1296 bp, Arabidopsis thaliana
atggctgctttctttcttggagaatctgaaatgagagaacactcttctgatctttttatgatgactctgaatccgtttcgcgagcagacaacgaccactaatgctcatgacgatcacttctacaacttgtgctttggttcccaacaatatagacctcgagatgaagtaggtcatatagaacaaggaaattcttccatctccactttttcaaacggaggagtcttcagggctttggctccgatctacttgaaagcggctcaagaattactcaatgagattgtcaatgttggaaacggtagccacggcgcaaaacaagagcgaccggtgagtaaagagtccacgatttatggagttgaggacatcaatggtggctataagcctggcgtagctgctttgcaaatgaagaaagcaaaactcatctccatgggtgaaatggtggaacagagatacaagcaataccatgaccaaatgcagactataatctcatcgtttgagcaagctgcgggtttaggctcagcaaactcatacacacatatggcgttacaaacaatatcaaagcagtttcgtgctgtaaaagacatgataagtttgcaaatcaagcaaataaacaagctcttgggacaaaaggaatttgacgagcagcttaagaagttgggaaagatggcacatcaccattcaaatgcttggagaccgcagagaggtttgcccgaaaaagctgtttccgttctacgctcttggctctttgagcattttcttcatccatatccgagggatttggataaggtaatgcttgccaaacagactggccttactaagagtcaggtgtcaaattggttcattaatgctcgagttcgaatgtggaagccactggtggaggaactttattcggaagaaatggatattgaagaaagcagaaaaggaagtgaccggtatagtaccaaaggttcatcttcaaagcaaccgtacaataatacaacttcaaatgaatcttcgaacacgatcctacccgcctttcgtcaaggattcactgaaactgaaacccctaggcaaaattcatcctcaagttgcagcgtagtcatgaggttcacgaagcaacacatgaatcaagcgaacttcatcaatttcaacggagggttcgaaaactatcacacaatggatggaaacagcgtctccctttccctcggcctgcctcattcttgtgaccaaacctttaataacattcattttgagtcaacaagtcatggaactgagaactcggccatatattcatcttcaacttatcaaatcatggattag

SEQ ID NO: 262 - protein, 431 aa, Arabidopsis thaliana
MAAFFLGESEMREHSSDLFMMTLNPFREQTTTTNAHDDHFYNLCFGSQQYRPRDEVGHIEQGNSSISTFSNGGVFRALAPIYLKAAQELLNEIVNVGNGSHGAKQERPVSKESTIYGVEDINGGYKPGVAALQMKKAKLISMGEMVEQRYKQYHDQMQTIISSFEQAAGLGSANSYTHMALQTISKQFRAVKDMISLQIKQINKLLGQKEFDEQLKKLGKMAHHHSNAWRPQRGLPEKAVSVLRSWLFEHFLHPYPRDLDKVMLAKQTGLTKSQVSNWFINARVRMWKPLVEELYSEEMDIEESRKGSDRYSTKGSSSKQPYNNTTSNESSNTILPAFRQGFTETETPRQNSSSSCSVVMRFTKQHMNQANFINFNGGFENYHTMDGNSVSLSLGLPHSCDQTFNNIHFESTSHGTENSAIYSSSTYQIMD

SEQ ID NO: 263 - DNA, 1721 bp, Arabidopsis thaliana
aaagaaaagagagaagctttgagaaagaaagaaagaaagacacagtgtgtatcaatctctgtactttcacaagcttccaagctctcttatcattcactgatttttggttctcgagaaaaaagtgaagatttttgagattctctttcgatggattacgaacgaatcggaaagacccaggttactagtagcggcggcggattttctccggggaagttaaggagtatgcttcttctaggtgttgatagaaagaagaatgaagaagaagaatcaactcctacaatgagatctgggtctaatcaaattgatgaccctagggtttatgttgctagtggattagatgattgcaaagatgttgatgttgtgagtgagattactgattgttctacttcagggatagctagatcgattagtttgggtcttcaagagtattctgattatgataatgtgaatgagatcaagagtgtttctgcatcatctgtctttgagtttcaaaagactgagaaggaaaaagttaatcaaagaatgcctattagatcattctctaaaccagctccatctaaatgggatgatgctcagaaatggattgctagtcctacggctaaccgaccgaagactggacaggttcaggttccgggttcgaagaaagggcctagctttggtcgtcagtcttctatgaagattgttgaagttgctgaacatagagtggttgaagagcctgatacaaagagaatagatgtaagccaagtgaaaaaggatatgggaaacaagtttggtagctgggaagttgattcgtacactaccgtggattcatatgtcaaaccggttcttatggttgagaactctattgtagaatcagcaactgaagttaatctcagccgtcatgactcgtcagtcgcaactgcgtttgctcaaccgccttcaacggcaaggtctgtgtcaatgagagacatgggaactgaaatgactcctatagcgagccaagaaccttctagaaacgggacaccgattagggcaacaacgccaatacgaagtcctatatcttctgaaccttcaagtccaggcagacaagcatcagcttctcctatgagtaacaaggaactgtcagagaaagagcttcaaatgaaaactaggagagagataatggtgttgggtactcaacttggtaaatttaacattgctgcttgggctagcaaggaggatgaagataaagacgcatccacatcattaaagaccaaagcttctctacaaacttctaaaagtgtttctgaagctcgtgctacagcgtgggaggaagcggaaaaagctaagcacatggctaggttcagacgcgaagagatgaagattcaagcatgggagaatcatcagaaggcgaaatctgaagccgagatgaagaaaaccgaggttaaagttgagaggattaagggacgagcacaagaccggttgatgaagaaactcgctacaatcgagcgcaaagcagaggaaaagcgagcagcggctgaagcaaagaaggatcatcaggcagctaaaacagagaaacaagctgaacaaatccgaagaacaggcaaagtaccttcattgttgttctcttgctttagcttttgttcttaaatccaatcctattgtgaatgtgatgttgttaattctcaagaacacatctttctatcatcatttgtataataaaagctttgaaaaacttatttcttgtgatcttttagaaaaaa

SEQ ID NO: 264 - protein, 486 aa, Arabidopsis thaliana
MDYERIGKTQVTSSGGGFSPGKLRSMLLLGVDRKKNEEEESTPTMRSGSNQIDDPRVYVASGLDDCKDVDVVSEITDCSTSGIARSISLGLQEYSDYDNVNEIKSVSASSVFEFQKTEKEKVNQRMPIRSFSKPAPSKWDDAQKWIASPTANRPKTGQVQVPGSKKGPSFGRQSSMKIVEVAEHRVVEEPDTKRIDVSQVKKDMGNKFGSWEVDSYTTVDSYVKPVLMVENSIVESATEVNLSRHDSSVATAFAQPPSTARSVSMRDMGTEMTPIASQEPSRNGTPIRATTPIRSPISSEPSSPGRQASASPMSNKELSEKELQMKTRREIMVLGTQLGKFNIAAWASKEDEDKDASTSLKTKASLQTSKSVSEARATAWEEAEKAKHMARFRREEMKIQAWENHQKAKSEAEMKKTEVKVERIKGRAQDRLMKKLATIERKAEEKRAAAEAKKDHQAAKTEKQAEQIRRTGKVPSLLFSCFSFCS

SEQ ID NO: 265 - DNA, 642 bp, Arabidopsis thaliana
gtttgtttgcgatggcgacagaacaagaagctgaagttggaacagagacatcctctgtttccggaaggtttttgaggaacagagatttatatctcttcttgccttttctcttaggcttctctgatcaagaatcatcaaacggagatgatgatgatgttgcttcatcgcgtgagagaatcattttagtcaacccttttacacaaggaatgattgtgctcgaaggctcatcaggaatgaatcctctgcttcgtagcttactggagtcacgtgaggaaggtcgtcctcctgcgtccaaggcttccatcgatgcgatgccgatcgttgagattgatggctgtgaaggagagtgtgtgatctgtttggaggagtggaagtccgaggagacggtgaaggagatgccgtgtaagcataggtttcacggtggatgtatagagaaatggttagggtttcatgggtcgtgtcctgtttgtaggtacgagatgcctgttgatggagatgagattgggaagaaaagaaacgatgggaatgagatttgggttaggttcagtttcaacgatggtcggagaattagagatttttctgcgcaggacggtggaaacagtgatggtgttgagtccgagaattaggatttacataagaagc

SEQ ID NO: 266 - protein, 204 aa, Arabidopsis thaliana
MATEQEAEVGTETSSVSGRFLRNRDLYLFLPFLLGFSDQESSNGDDDDVASSRERIILVNPFTQGMIVLEGSSGMNPLLRSLLESREEGRPPASKASIDAMPIVEIDGCEGECVICLEEWKSEETVKEMPCKHRFHGGCIEKWLGFHGSCPVCRYEMPVDGDEIGKKRNDGNEIWVRFSFNDGRRIRDFSAQDGGNSDGVESEN

SEQ ID NO: 267 - DNA, 869 bp, Arabidopsis thaliana
gcaatctacgaaactggtagcaatctgggggtttctctaatcatcaaccttcaaatgtcgtcaacaacatcaatagattcaataccagctactgctgttttccctagtgtttccatgcctgtcaccgtagttttgaccggtgttcttctctttgtaattttcgccggattcttctctcttttcttatggcagtttcttctgaatcgattatttactacttggaaccttcaacgaacaccttacggtgacctaatccatgtggccactccgcctgaaaatactggcctcgacccgtttatcatccggtcctttcctgtattccactattcatctgcaactaagaaaaatcatgggacggaatgcgctatttgcttgtcagagttttcagatgaagatacagttaggctcataacggtttgtcgtcatccctttcattcaaattgcattgatctttggtttgagttacacaagacttgtcctgtttgccggtgtgagttagatcctggcatgattggatctggaaggcttgaatcattccacaacacagtcacaattactattcaggacataaaccatgatgaggaaaatcctccaaccgctggttcaagcaaaaggctaatagaagcctcggcttggcgattctcgaggtcacattctactggacatttcatggttaagactacggatgctaatgtgaagtccaaaagaaggcattaccaaacaggaagctgtgtctcgttcgacgaacttactcggtatgaaggagcaggatggcaatggcttggtgattcatcacacattagcaggattgaagtatagtttactgaatttctgttacatcttcattattgtgttctttgtagcagtag

SEQ ID NO: 268 - protein, 254 aa, Arabidopsis thaliana
MSSTTSIDSIPATAVFPSVSMPVTVVLTGVLLFVIFAGFFSLFLWQFLLNRLFTTWNLQRTPYGDLIHVATPPENTGLDPFIIRSFPVFHYSSATKKNHGTECAICLSEFSDEDTVRLITVCRHPFHSNCIDLWFELHKTCPVCRCELDPGMIGSGRLESFHNTVTITIQDINHDEENPPTAGSSKRLIEASAWRFSRSHSTGHFMVKTTDANVKSKRRHYQTGSCVSFDELTRYEGAGWQWLGDSSHISRIEV

SEQ ID NO: 269 - DNA, 529 bp, Arabidopsis thaliana
tttctccatgggctttcccgtaggttacacagaggttttcttaccgaagcttttcgtacaaacgctttcgattctcggattcatcagaaccatcgtcttctctatcttccgcttcttgggtctctcagattttctcgaaatggatcaaacctggcccgattacacatcgtacccgacccgaatacccgaaacccgctcacctttctccgcactcctaattagagagatcctaccggttatcaaattcgaagagttaacgaattccggcgaagatctaccggaaaactgcgccgtttgtctatacgaattcgaaggagaacaagagatccggtggctgagaaattgcagacatatatttcaccggagctgtcttgaccgttggatggatcatgatcagaagacgtgtccactttgtagaacaccgtttgttccagatgagatgcaagaagagtttaatcaacggctatgggctgcttctggtgttcatgattttcactgtcccgtgaccgaattattatagaagaagcca

SEQ ID NO: 270 - protein, 170 aa, Arabidopsis thaliana
MGFPVGYTEVFLPKLFVQTLSILGFIRTIVFSIFRFLGLSDFLEMDQTWPDYTSYPTRIPETRSPFSALLIREILPVIKFEELTNSGEDLPENCAVCLYEFEGEQEIRWLRNCRHIFHRSCLDRWMDHDQKTCPLCRTPFVPDEMQEEFNQRLWAASGVHDFHCPVTELL

SEQ ID NO: 271 - DNA, 1089 bp, Arabidopsis thaliana
acccaaaaaaacgcgatatccaacaagaggagcaattaaaaagctgtctttacagctttagcttcatcatctctaagctgtgatcaattcctcccaaaccattttctaactggtttgcactttcttcactctcttctcttcactcttcactacgtacttcactctccaactaacttaactgcaccataaaatggcttcgatctcttcctctccttcctcaaactcatcactcttctctactcaaaaccctaatactcattatcaatatgcaaggaacctccaaagacaatggcggccgccaccctttgtacaggggagtaaggcagcgaaagaactcaaacaaatgggtttctgagatccgtgagccgagaaaacctaaccgtatctggttaggaacattctctacccccgagatggcggcaatagcctatgacgtggcagctctagccctcaaaggcagtcaagctgagctcaacttcccaaactcagtttcctctttgcctgccccaacctccatgtctccagcagacatccaagcagcagccgcttcggccgctgctgcttttggtgctgctagggatgcgattgttatggcaaataataacagccaaacaagtggtgtggcttgcatgaatagtagttatgataatacaaatatgaatggattcatggacgaggatttggtattcgacatgcctaatgtgctcatgaatatggctgaaggaatgcttcttagcccccctcgtcctactgtctttgatgctgcttacgacgctgatggttttcctggaggagacgattacttgtggaattttccatgatagttaaacaaaccaaccatataaatatgtgattttgtgtgtttctatatatgtatgtatgaaataaataaatatggtgtctagtgatgcattgtatgcatggttaggcccgttaagaccgtaatataaggtcgtactgtattaagtttttgtctttaaattattctcaatttacaatcttatctagtctgatgtaatgccaaatgtaatgaatagtcaatgccttgactgatactcatttgtttattttacagatggatacaatttt

SEQ ID NO: 272 - protein, 184 aa, Arabidopsis thaliana
MQGTSKDNGGRHPLYRGVRQRKNSNKWVSEIREPRKPNRIWLGTFSTPEMAAIAYDVAALALKGSQAELNFPNSVSSLPAPTSMSPADIQAAAASAAAAFGAARDAIVMANNNSQTSGVACMNSSYDNTNMNGFMDEDLVFDMPNVLMNMAEGMLLSPPRPTVFDAAYDADGFPGGDDYLWNFP

SEQ ID NO: 273 - DNA, 2026 bp, Arabidopsis thaliana
caccggaactgtgatctcaccggaatatccctcctttatttatcctctactcatccgttttactctctccctccgtcgatcttctctttctcttgatcgcctccgtccattctttatcatttcttaattcagaattgtgatcgatggatgattattttagcgcggaggaagaggcttgctattactcctccgatcaagattctttggatggaattgataatgaagagtctgaattgcagcctctgtcctctaaaagatcaaacactcaggtcatcactcaggaatcgcttctagcagcacagagagaagatttgctaagggtgatggaattgttatcaataaaggagcaccatgcacggactcttcttattcattaccagtgggatgtggagaagttgtttgctgtgtttgttgagaaaggaaaagatagcttgttttctggagctggtgtcactgtcttcgattatcaatatggcaactcttcctttcctcagtcttcacagatgagttgtgatgtttgcatggaggatttaccaggtgatcacatgacaagaatggactgtggccattgcttttgcaataattgttggacggagcattttactgtgcagataaatgaaggtcagagcaaaaggattagatgcatggctcatcaatgtaatgctatttgtgatgaagatattgtcaggagtctagtcagtaaaaagcgtccagatctagctgcgaagtttgatcgttaccttcttgagtcgtacatcgaagataacagaatggtcaagtggtgtcctagcactccgcattgtgggaatgctatacgagctgaggatgacaagttgtgcgaagttgaatgttcttgtggtcttcagttctgtttcagttgtctgtgtcaagcccactccccttgctcttgtttgatgtgggagttatggagaaagaagtgtcgagatgagtctgagacaatcaactggataaccgttcacacaaagctgtgtcccaaatgttacaaacctgtggaaaagaatggtggatgcaatctcgtgaggtgtatttgtgggcagtgtttttgttggctatgtggtggagctactggaagtgatcacacttataggagtatcgctggtcacagttgtggtcggtaccaagatgacaaagagaagcagatggaaagagcgaagagagatttaaacaggtatacgcattatcatcaccgatacaaagctcatacagattcatcaaagctagaagataaacttagggatactatccatgagaaagtgtcgaaatcagaaaagagggagttgaagcttaaagacttcagctgggtcaccaatggactcgaccggttattcagatcaaggcgagttctttcatattcgtatgcttttgcatattatatgtttggtgaagagatgtttaaagatgagatgacccctgaggagagagagataaagaagaatttgtttgaggatcagcagcaacaacttgaaagtaatgtggagaaactttcgcagttccttgaggagccctttgatgaatttagtaatgataaagttatggcgataaggattcaaatcatcaatttgtctgtcgccgtcgatacactctgcaagaaaatgtacgagtgcattgagaatgacttactcggatctctccaacttggcatccacaacatctcaccttacagatcgaagggaatcgaacaagcagctcagttttatgcttcctggaattccaaagatgctgacaaattccaacctttggatagtggtacaagcggagtgacatcgaggcctgagcaagcttcaggatcaaggagctcggaagacaccatttgctcatcttcacagaaacgtcccaaaaaagaaggaagtttcttaaacaacaaagtcactttattggatttgaacttgccagctgatttcgtcgaccagaactgaactcaaatcctctcttgcttagtccaaatgagatatgatgacatagcaaaaggtgtttgactatatatctatcaccttcaagactcgtg

SEQ ID NO: 274 - protein, 597 aa, Arabidopsis thaliana
MDDYFSAEEEACYYSSDQDSLDGIDNEESELQPLSSKRSNTQVITQESLLAAQREDLLRVMELLSIKEHHARTLLIHYQWDVEKLFAVFVEKGKDSLFSGAGVTVFDYQYGNSSFPQSSQMSCDVCMEDLPGDHMTRMDCGHCFCNNCWTEHFTVQINEGQSKRIRCMAHQCNAICDEDIVRSLVSKKRPDLAAKFDRYLLESYIEDNRMVKWCPSTPHCGNAIRAEDDKLCEVECSCGLQFCFSCLCQAHSPCSCLMWELWRKKCRDESETINWITVHTKLCPKCYKPVEKNGGCNLVRCICGQCFCWLCGGATGSDHTYRSIAGHSCGRYQDDKEKQMERAKRDLNRYTHYHHRYKAHTDSSKLEDKLRDTIHEKVSKSEKRELKLKDFSWVTNGLDRLFRSRRVLSYSYAFAYYMFGEEMFKDEMTPEEREIKKNLFEDQQQQLESNVEKLSQFLEEPFDEFSNDKVMAIRIQIINLSVAVDTLCKKMYECIENDLLGSLQLGIHNISPYRSKGIEQAAQFYASWNSKDADKFQPLDSGTSGVTSRPEQASGSRSSEDTICSSSQKRPKKEGSFLNNKVTLLDLNLPADFVDQN

SEQ ID NO: 275 - DNA, 1059 bp, Arabidopsis thaliana
atgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtga

SEQ ID NO: 276 - protein, 352 aa, Arabidopsis thaliana
MGSNFHYTIDLNEDQNHQPFFASLGSSLHHHLQQQQQQQQHFHHQASSNPSSLMSPSLSYFPFLINSRQDQVYVGYNNNTFHDVLDTHISQPLETKNFVSDGGSSSSDQMVPKKETRLKLTIKKKDNHQDQTDLPQSPIKDMTGTNSLKWISSKVRLMKKKKAIITTSDSSKQHTNNDQSSNLSNSERQNGYNNDCVIRICSDCNTTKTPLWRSGPRGPKSLCNACGIRQRKARRAAMATATATAVSGVSPPVMKKKMQNKNKISNGVYKILSPLPLKVNTCKRMITLEETALAEDLETQSNSTMLSSSDNIYFDDLALLLSKSSAYQQVFPQDEKEAAILLMALSHGMVHG

SEQ ID NO: 277 - DNA, 696 bp, Arabidopsis thaliana
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtacaaaaaaaaaaaaaaaaaaaaaaa

SEQ ID NO: 278 - protein, 139 aa, Arabidopsis thaliana
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 279 - DNA, 1265 bp, Arabidopsis thaliana
ggaaactatcaaccaccaaaatctttcacattacaccttccttttgtcctcaaaccaaaaccctagaaaccaaaaatggaaaaagccttgagaaacttcaccgaatctacccactcaccagaccctaatcctctcacaaaattcttcactgaacctacagcctcacctgttagccgcaaccgcaaactgtcttcaaaagataccactgtaaccatcgccggagctggcagcagcacgacgaggtaccgcggcgtacgccggaggccgtggggacgatacgcggcggagatacgtgacccaatgtcgaaggagagacgttggctcggaacatttgacacggcggaacaagccgcttgtgcttacgactctgcggctcgtgcctttcgtggagcaaaggctcgtactaattttacttatccgacagctgtcattatgcctgaaccaaggttttctttttccaacaagaaatcttcgccgtctgctcgttgtcctcttccttctctaccgttagattcctctacccaaaacttttacggtgcaccggcagcgcagaggatctataatacacagtctatcttcttacgcgacgcctcgtgttcctctcgtaaaacgactccctataataactctttcaacggctcatcatcttcttactcagcatcgaaaacggcatgcgtttcttattccgaaaacgaaaacaacgagtcgtttttcccggaagaatcttctgatactggtctattacaagaggtcgttcaagagttcttgaagaaaaatcgcggcgttcctccttctccaccaacaccaccgccggtgactagccatcatgacaactctggttatttctctgctctcactatatactctgaaaatatggttcaagagactaaggagactttgtcgtcgaaactagatcgctacgggaattttcaagctaatgacgacggcgtaagagccgtcgcagacggtggtttatctttgggatcaaacgagtgggggtatcaagaaatgttgatgtacggaactcagttaggctgtacttgccgaagatcgtggggatagctagatattcatcatgattatgttttgagttttggtactatcgacttagtttaaagttgctacctttcccaatgttggatattaactaaattatgttttaagttgaatttgctaataggatttcataattataatcaagtttataatatattttagtagctaattaaagtttatatccacgtattctgaaaaaaaaaaaaaaa

SEQ ID NO: 280 - protein, 328 aa, Arabidopsis thaliana
MEKALRNFTESTHSPDPNPLTKFFTEPTASPVSRNRKLSSKDTTVTIAGAGSSTTRYRGVRRRPWGRYAAEIRDPMSKERRWLGTFDTAEQAACAYDSAARAFRGAKARTNFTYPTAVIMPEPRFSFSNKKSSPSARCPLPSLPLDSSTQNFYGAPAAQRIYNTQSIFLRDASCSSRKTTPYNNSFNGSSSSYSASKTACVSYSENENNESFFPEESSDTGLLQEVVQEFLKKNRGVPPSPPTPPPVTSHHDNSGYFSALTIYSENMVQETKETLSSKLDRYGNFQANDDGVRAVADGGLSLGSNEWGYQEMLMYGTQLGCTCRRSWG

SEQ ID NO: 281 - DNA, 615 bp, Arabidopsis thaliana
actgaaatggtgagaggaaagatcgaaatcaagaagattgagaacgtgacaagtagacaagtcacgttttcgaagcgaaggagtggtctctttaagaaggctcatgagctttctgttctatgtgatgctcaagtggcagctatgatcttctctcagaaaggaagattatatgaattcgctagctccgatatcaggaacacgataaagcgatacgctgagtacaagagagagtattttgttgcagaaactcatcctatagagcaatacgtgcaggggctaaagaaggaaatggtgacaatggtgaaaaagattgaagtgcttgaagtccataaccggaagatgatgggacaaagtttggattcttgttcggtaaaagaactttcagagatagccacacagatagagaaaagccttcatatggttagattaagaaaggctaagttatatgaagatgagctacagaaactaaaagccaaggagagggaactcaaggacgagagagtcaggctttctctaaaggttggagaaagaccaatggggatgccgtcgggaagcaaagagaaagaggatgttgaaactgatctatttattggatttctgaagaaccgaccataa

SEQ ID NO: 282 - protein, 202 aa, Arabidopsis thaliana
MVRGKIEIKKIENVTSRQVTFSKRRSGLFKKAHELSVLCDAQVAAMIFSQKGRLYEFASSDIRNTIKRYAEYKREYFVAETHPIEQYVQGLKKEMVTMVKKIEVLEVHNRKMMGQSLDSCSVKELSEIATQIEKSLHMVRLRKAKLYEDELQKLKAKERELKDERVRLSLKVGERPMGMPSGSKEKEDVETDLFIGFLKNRP

SEQ ID NO: 283 - DNA, 833 bp, Arabidopsis thaliana
atggtgagagggaagatcgagatcaagaagattgagaacgtgacgagcagacaagtcacgttctcgaagcgaagaagcggtctatttaagaaggctcatgagctttcggttctatgcgatgctcaagtagccgccattgtcttttctcagagcggaagattacacgaatactctagctcccagatggagaagattatagatagatatggcaagtttagtaatgccttctatgtggcagagaggcctcaagtagaacgatacttgcaggagctgaagatggaaattgatagaatggtgaaaaagattgatctccttgaagttcatcaccgtaagctgttggggcaaggtttggattcgtgttcagtgacagaacttcaagagattgacactcaaattgagaaaagccttcgtattgtcaggtcaagaaaggctgagttatatgcagatcaactgaaaaagctaaaagaaaaggagagggagctcttgaacgagagaaaaaggctgcttgaagagcaaaatagagaaaggttgatgcgaccggtggtgccagcaactttacaaatatgtgataagggtaatactgaaggtggtcacagaaccaaacattcatcagaggttgaaaccgacctatttatcggattgcccgtgactcggctataacatattactttggttccatgtttgtacactataatgcttccatacagtttatagttttctgagtgctcatgcatgaccatctcttcatatatatatgtgtataaactgaaaataatttgacatgtattatttgtcactttagtttttcttttgaatgaatgtgacattttgtt

SEQ ID NO: 284 - protein, 219 aa, Arabidopsis thaliana
MVRGKIEIKKIENVTSRQVTFSKRRSGLFKKAHELSVLCDAQVAAIVFSQSGRLHEYSSSQMEKIIDRYGKFSNAFYVAERPQVERYLQELKMEIDRMVKKIDLLEVHHRKLLGQGLDSCSVTELQEIDTQIEKSLRIVRSRKAELYADQLKKLKEKERELLNERKRLLEEQNRERLMRPVVPATLQICDKGNTEGGHRTKHSSEVETDLFIGLPVTRL

SEQ ID NO: 285 - DNA, 977 bp, Arabidopsis thaliana
aattcttcccttttccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaagaaaaaatatcgaaaaacttagaacaataaccaaaaaaaaaaagcaaagcaaaaaagaaactctcgctatgtctctctatctctctatgtaaatgaaatgaaggttaggaagagaaaatgatagttttctaattttcctttccacttt

SEQ ID NO: 286 - protein, 248 aa, Arabidopsis thaliana
MLSTAPAFSFSEPGLVNQFSGFQTGFTPWEWDCSDLFFVDQMSLEPAIPSPCYGESDTGSVKINSGSHDMKTGSDESCAGFVKINPRCDDADISNDLPCSQADEPDSDDTKQLTAITNFGSGENNHNRKKMIQPEMTDERKRKRMESNRESAKRSRMRKQSHIDNLREQVNRLDLENRELGNRLRLVLHQLQRVNSDNNRLVTEQEILRLRLSEMRRILIIRQLQQQQQWELHNRRMIMTEQNHPHLQ

SEQ ID NO: 287 - DNA, 318 bp, Arabidopsis thaliana
atggataacactgaccgtcgtcgccgtcgtaagcaacacaaaatcgccctccatgactctgaagtgagcagtatcgaatgggagtttatcaacatgactgaacaagaagaagatctcatctttcgaatgtacagacttgtcggtgataggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctag

SEQ ID NO: 288 - protein, 105 aa, Arabidopsis thaliana
MDNTDRRRRRKQHKIALHDSEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 289 - DNA, 1211 bp, Arabidopsis thaliana
ttttcaatactcacaccaaagcttaatgccgatcaacgatcagtttcctagtgggttaagaatactcgttgtagacgatgatacttcatgcttgttcattctcgagaaaatgcttctccgtctcatgtaccaagttacaatttgctcacaagctgatgttgcgttaaccattctaagagaaagaaaagacagttttgatttggtgctaagtgatgttcatatgcctggtatgaatggttacaatcttcttcaacaagttggtcttcttgaaatggatcttcctgtcattatgatgtctgttgatggaagaacaactacagtcatgactggaatcaaccatggagcttgtgattatctaatcaaacctattcgtcctgaagagcttaagaacatttggcaacatgttgttagaaggaaatgtgtgatgaagaaagagcttcgaagttctcaagctttagaggataacaagaacagtggtagcctcgagactgttgttgtttcggttagtgaatgctcagaggaaagtttgatgaaatgtaggaataagaagaagaagaagaagagaagtgttgatagagatgataatgaagatgatcttcttcttgatcctggaaactcgaagaagtcacgcgttgtttggtctattgaattgcatcaacaattcgttaatgccgtaaacaaacttggaattgacaaagctgtaccaaagcggattctcgagttgatgaatgttcctggtttaagcagagaaaacgtggctagtcatttacagaagttccgattgtatttgaagagattaagcggtgaagcttcgcagagtaatgactctgagtctaccaaaagatatgaaaacattcaagctctggtttcctcaggacaattacatccacagacattagctgcattgtttggtcaaccaatagacaatcatcactctgctagttttggagtttggattcctaatgacaatcttggtagatctcaaaatgaacacttctcggttgatgtatcatccgcttctaaccgtcctgtttctgtggcggttcatggtctatcttcctcagcaaatttcagacagagaggtgacgttaacaacaacagaatcagacaagggtatggatcaaatgtcaatgaagaatcttggatcttggaaagatcttcaagacaaagatagtgaccaatatggatacgcttaagaagagaaggctctg

SEQ ID NO: 290 - protein, 382 aa, Arabidopsis thaliana
MPINDQFPSGLRILVVDDDTSCLFILEKMLLRLMYQVTICSQADVALTILRERKDSFDLVLSDVHMPGMNGYNLLQQVGLLEMDLPVIMMSVDGRTTTVMTGINHGACDYLIKPIRPEELKNIWQHVVRRKCVMKKELRSSQALEDNKNSGSLETVVVSVSECSEESLMKCRNKKKKKKRSVDRDDNEDDLLLDPGNSKKSRVVWSIELHQQFVNAVNKLGIDKAVPKRILELMNVPGLSRENVASHLQKFRLYLKRLSGEASQSNDSESTKRYENIQALVSSGQLHPQTLAALFGQPIDNHHSASFGVWIPNDNLGRSQNEHFSVDVSSASNRPVSVAVHGLSSSANFRQRGDVNNNRIRQGYGSNVNEESWILERSSRQR

SEQ ID NO: 291 - DNA, 924 bp, Arabidopsis thaliana
agtaattgatctcgagagctagctaaagacactctcgccggagagacatggccgggagatcttcgccgggaaaatgctccacgtggcttgacctgaacagagaagaaacagtggagaagaacaatgaagaagagtcatcagtggaagacgaagaccaaatcacgaataacgttagacagtatattcggtccaacatgcctcggcttcgttggacgcctgatcttcatctctccttcgttcgtgctgtccaacgactaggcggtccagacagagcgacgccgaaattggttcttgagatgatgaatctaaaaggattgagtattgcacatgtcaagagtcatttacagatgtatcgaagtaagaagctcgagccgtcttctcgccctggatttggagctttcatgagtggacaaagaagctatttgatggacatgatcgactctcgatgtatccctcatagcgatttaagacatgcctataactctaaaaccgttccttcgagggtactcaatcaagacgcggtcgttacaaatcttggaggtaactttcttatgcgaccttcgagctggtttagcgggttatgcagaaatgaccgagacagcacagagaacaagactctgcctctactcgagattaggaagaagaacaatgagaaaagagtccgagatgaagaagtatcatcagtcaaacgattgaaatcaatgtccggaggtgggatacagttgcctgagtttggaaattgcaggcaaaaaccaacagatgatatcaacacaatgctctcgctctctctgttgtcgacatcatcagaaccgtaaccaacatactagagagatgaagtttaactttaaaagagattcaagagtagagacttttgttttccttagccgtttcatgggatgagtacttagccaggatctggatcag

SEQ ID NO: 292 - protein, 255 aa, Arabidopsis thaliana
MAGRSSPGKCSTWLDLNREETVEKNNEEESSVEDEDQITNNVRQYIRSNMPRLRWTPDLHLSFVRAVQRLGGPDRATPKLVLEMMNLKGLSIAHVKSHLQMYRSKKLEPSSRPGFGAFMSGQRSYLMDMIDSRCIPHSDLRHAYNSKTVPSRVLNQDAVVTNLGGNFLMRPSSWFSGLCRNDRDSTENKTLPLLEIRKKNNEKRVRDEEVSSVKRLKSMSGGGIQLPEFGNCRQKPTDDINTMLSLSLLSTSSEP

SEQ ID NO: 293 - DNA, 837 bp, Arabidopsis thaliana
agtaagagactcaataataatgtcgaacacttcaaactccgatcccaattccgatatcccatttgcttcctccaatgtaactcttcctagttacaatcaaaacccaagaagaaaacgtactaaactcaccaacaacgaagtcggttcttcttcgtcttctccaaggcctaaaccggtcacgcaaccggaccctgatgcttcacaaatcgcacgaccatgtactgaatgtggtaaacaattcgggtcactgaaggcactctttggacacatgagatgtcaccctgaacgtcagtggcgtggcatcaaccctccttctaacttcaaacgtaggatcaactcaaacgctgcgtcatcatcctcgagttgggatccatctgaggaagagcataacatagcctcctgtttactaatgatggctaatggtgatgtcccaacccgttcaagtgaagttgaggaacggtttgagtgtgatggttgtaagaaagtgtttgggtcacatcaagcgttaggcggacatagagcaacacataaagacgtcaaaggatgtttcgccaataaaaacataaccgaagatcctcctcctccacctcctcaagagatcgttgatcaagataagggcaagagtgtgaagttggtctcggggatgaatcatcgatgtaacatctgttctagagtgttctccagtggtcaagcgttaggaggtcacatgagatgtcattgggagaaagatcaggaagagaaccaagtcaggggcattgatcttaatgttcctgcggcgacatcttcagacacaacgttaggttgttccttggatcttaggttaggactttgatatat

SEQ ID NO: 294 - protein, 270 aa, Arabidopsis thaliana
MSNTSNSDPNSDIPFASSNVTLPSYNQNPRRKRTKLTNNEVGSSSSSPRPKPVTQPDPDASQIARPCTECGKQFGSLKALFGHMRCHPERQWRGINPPSNFKRRINSNAASSSSSWDPSEEEHNIASCLLMMANGDVPTRSSEVEERFECDGCKKVFGSHQALGGHRATHKDVKGCFANKNITEDPPPPPPQEIVDQDKGKSVKLVSGMNHRCNICSRVFSSGQALGGHMRCHWEKDQEENQVRGIDLNVPAATSSDTTLGCSLDLRLGL

SEQ ID NO: 295 - DNA, 2414 bp, Arabidopsis thaliana
aatttgtttctaattagggttcatcatcaagtcgtacttctgccaaacaaggtttttactttttagtgatgtcgtcaaaaggtacaacaactcaatcaatccacgaaatatcaattgttaaagcgaggaaatcaaattagggtttaaccgatttcgagagatcattcaagagggtttaatgggtatcgttgcttccaagggagatagtaatactccattgttgaatctatgtaaggagaggaaggaattgatcaaagcagctagagatgctcgttatcacttagcgagatctcatcttctttactttaaatctcttttagatttcagcaaagctcttaaacagtttcttcataaggatttggttgtgattccgtattccgatgatgattcgtctagtagtgatataatttgttctggatcagattcagactcggatacggattctgattcagattctgattctgattgtatagtctgtgatcaacctcaaacagctccgttgagcaataatgacgatcagagtcagcgaaaacccgtggttggtgatggaacttgcggtgcaagtaacaatggtcaagagggtatggagaagtcaagagaaggtttagggtttgaggggacacagttcgttagtgatccaagtgaagacgagatgaaaagttcgcaacacccttatgatatactcggtttctacaaatccgtgtataacatgcagcagtgcgaaattatcgaactggatcatagagatgatgaggttgagagtgatggatttagagaaattagggagagagaagggattcctgatttggaacctgaaagtgattataatagtctgataaggaagaataaaaagaagaataaaaagaagaagaagaagaagaatgttagagaaagctcttctgttgcaagtgaaattgataagcgagatgttgaagcgaatacttgtaatggtcaagttgcagatgagactgataattctaatgaagcttgtgcgcaagagacagaaaacactccagagattgttacggaagaagtgacgagatcagatgaggaagttgaagtagtggcaagatcagatgaggaagtttctgatgaagcgtatgagtcttcttcttcttgtttttcggaatcttctggttcgggtttgacggatctaaggaaggtagtggaaaggatcaatagtatatgcgggaaagctgcgggtaatagtgaagtctctgagttgcttgaagtaagcagagttgtttatcatcaacctttaggatctcaattcaagggatttgcttcaagagtaattggtagttccgggactacgactcgtgatttggttttaaagcgccgttttcgcttagatgatctcgctgtttcactctctatgacattagagaagctttatatgtgggaaaagaagcttcacgcagaagttacagctgaagaaaagcttagggttgcttatgaaaaagcgtacaagattctgaacaatcttgatcaaaacggagcagaatctagtgagctttacgaggcggaaactttggttaaactccatttatctaaggttaatgtttcggttcgagcggttgaatcgatttcgatgagaattcataagataagagacgaagagctttcgtttcaagtgattgagatcattaacggattcaaaacaatgtggagattcttggcgaaatgtcaccataagcagtttcgagtgattgcgagaagcaagtcttgtgttcacattgttgaaaacggatcgagctccaggaaagccacgcagcaagtcgaaaaacagattagaagatacagagaatctttgaaaggttacattgatgcacacagaggtttcgttaagcttttaaacgaatggcttaaccgaatcatcatggaggacgatgaaaccgagactgaagctcctgagatatttagggtttgcagcgagtggttaagagagattgagaatgtggatacgattaaagtgttgagtgttgttgaagaaatgagattaagatttcaagggttagggtttaagcaagtagaggaagagaaacagaggatgagaacagagagattgtctaaggagttagagaagaagacgaaggagttggaggagattcggggaacgagaggttctagtccgacgtcgaatatggttgaaccggagttgttgtttttgagagagagtgtgacgcaagaaacagaaaaacatgagagattgataagagagttaaacgacgccgtatcgatgagtttgcaagagtgtatggttcctgtctttgaggctttgggagatttttgttttgctaattttaaagcatatcagaacattgtaatcgttaccacataaactctatgattgcgtcaatcataaaaataaatatgtataggaaattaaataaagaatttcatcagatttcgta

SEQ ID NO: 296 - protein, 720 aa, Arabidopsis thaliana
MGIVASKGDSNTPLLNLCKERKELIKAARDARYHLARSHLLYFKSLLDFSKALKQFLHKDLVVIPYSDDDSSSSDIICSGSDSDSDTDSDSDSDSDCIVCDQPQTAPLSNNDDQSQRKPVVGDGTCGASNNGQEGMEKSREGLGFEGTQFVSDPSEDEMKSSQHPYDILGFYKSVYNMQQCEIIELDHRDDEVESDGFREIREREGIPDLEPESDYNSLIRKNKKKNKKKKKKKNVRESSSVASEIDKRDVEANTCNGQVADETDNSNEACAQETENTPEIVTEEVTRSDEEVEVVARSDEEVSDEAYESSSSCFSESSGSGLTDLRKVVERINSICGKAAGNSEVSELLEVSRVVYHQPLGSQFKGFASRVIGSSGTTTRDLVLKRRFRLDDLAVSLSMTLEKLYMWEKKLHAEVTAEEKLRVAYEKAYKILNNLDQNGAESSELYEAETLVKLHLSKVNVSVRAVESISMRIHKIRDEELSFQVIEIINGFKTMWRFLAKCHHKQFRVIARSKSCVHIVENGSSSRKATQQVEKQIRRYRESLKGYIDAHRGFVKLLNEWLNRIIMEDDETETEAPEIFRVCSEWLREIENVDTIKVLSVVEEMRLRFQGLGFKQVEEEKQRMRTERLSKELEKKTKELEEIRGTRGSSPTSNMVEPELLFLRESVTQETEKHERLIRELNDAVSMSLQECMVPVFEALGDFCFANFKAYQNIVIVTT

SEQ ID NO: 297 - DNA, 683 bp, Arabidopsis thaliana
acttttgatccttcgcattcactaaataagtacatattatcagtttgacaccaaaaaaatggattattcagaaaatgttcaaaacaaaaatttcacccctatttcacaacctcctaacttgacaagagaccaagaacatgctatcatggtttctactttgcgacaagtgatatccaacactggaggtgatacgtcatcatctcactacattgctgcaagtgaggctcttccaccttcggacgctggcccttgtcctctttgcggcgtcaccagttgctacgggtgcgcattcccacagcatgaagagattaagcaggagaagaagcataaaggagtgaggaagaagccatcaggaaaatggtcggcggaaatatgggatccgagtacaagaacaaggaggtggcttggaacgtttccgacggcagagatggcagcggatgcttacgatgaggcagcggctgcgcttgtcgaaaaaagatcagcgagacgtggctcaaagaagggagaaggaagcattcaccaagaagtcggcggcggagatgactgagaaattaagctatataactatatatcgttttatagggggaaaaatagatgttttgggagaaattaatacattacctagatgggttatatgttttacgagaaaccacttgcgtgtgttttttttttaataagaggtt

SEQ ID NO: 298 - protein, 162 aa, Arabidopsis thaliana
MDYSENVQNKNFTPISQPPNLTRDQEHAIMVSTLRQVISNTGGDTSSSHYIAASEALPPSDAGPCPLCGVTSCYGCAFPQHEEIKQEKKHKGVRKKPSGKWSAEIWDPSTRTRRWLGTFPTAEMAADAYDEAAAALVEKRSARRGSKKGEGSIHQEVGGGDD

SEQ ID NO: 299 - DNA, 1160 bp, Arabidopsis thaliana
aatttcataaatcatagagagagagagagagagagagagagagtttggaaacattccaaaaccagaactcgatattatttcaccaaagaatgatagaaacaagaactatctttttataaaactctttacaccccaaaagaaaatgtctcactcgttttgccttataatatttctttcaacaacaacccaaatctacaaaaaatcccaataaaaaaaaacttcagtctgtttgacattttgtcgaacacttggacggcatcacaaaaagctctaaactttctgactaccaatggcggattcgtcttccgacaaggagaagaaggaaaataataagcagcccgtgtatcgtggagtccgtatgaggagctggggaaaatgggtatcggagattcgcgaaccgaggaagaaatcgagaatctggctcgggacttttccgacggcggagatggctatgcgtgctcacgacgtggcggctatgagtatcaaaggaacttcagccattctcaatttccctgagctctctaaacttcttccccgacccgtttcgctcagccctcgtgacgtcagagctgcggcgaccaaagctgctctcatggacttcgatacgacggcgtttcgttcggatactgagactagcgaaacgacgacgtcgaataaaatgtcagagagtagtgagagtaacgaaacggtgtcgttctcatcgtcgtcttggtcctctgttacgagcattgaggaaagtacagtctccgacgatcttgacgagatcgtaaagttaccgagtctaggaacgagcctaaacgagtcgaacgagttcgtgatatttgactcgttggaggatttggtgtacatgcctcggtggttaagcggtacggaagaagaagtttttacgtataataacaatgattcttcgttgaattactcatcagttttcgaatcttggaaacattttccctgagaaaagaaagaagccatattttctctctctttttcgccatttttggttttaagttttttgatgggattctctctgtttttgctatgcgtgagatatctctctttgtggaatagataacttttctgttgaaaatctcctaagtctgtgaaatgaacgacgatggaaatgtaagtgtgtatattagcccgaaataatgactgtatac

SEQ ID NO: 300 - protein, 221 aa, Arabidopsis thaliana
MADSSSDKEKKENNKQPVYRGVRMRSWGKWVSEIREPRKKSRIWLGTFPTAEMAMRAHDVAAMSIKGTSAILNFPELSKLLPRPVSLSPRDVRAAATKAALMDFDTTAFRSDTETSETTTSNKMSESSESNETVSFSSSSWSSVTSIEESTVSDDLDEIVKLPSLGTSLNESNEFVIFDSLEDLVYMPRWLSGTEEEVFTYNNNDSSLNYSSVFESWKHFP

SEQ ID NO: 301 - DNA, 1134 bp, Arabidopsis thaliana
atgccgggggaacaaaccggagaaactccgacggtggccggagttggcggcggtggagctggttgtagcgccgggaatagtggtggaagtagtggatgtggtgctggtggtggcggtggtggtagtggtggaggtggtggcggaggaggagattcacagaggtcaattccgacgccgtttttgacgaaaacgtatcagcttgtggaagatccggtttacgacgaattgatctcgtggaacgaagatggaaccacttttattgtgtggcgaccagctgaattcgctagagatcttcttcccaaatacttcaaacataataacttctcgagttttgttcgtcagctcaatacttacggatttcgaaaagtagttccagatcgttgggagttttctaatgattgttttaagagaggtgagaagattctgcttcgggatattcaacggcggaaaatctctcagcctgctatggccgcggctgctgcagcggcggcggcagccgtagcggcttcggctgttacagtagcagctgttcctgttgtagctcatattgtttctccatcgaactctggagaagaacaggttatatcgtctaattcttcgcctgcggctgctgctgctgctataggaggagtggttggtggtggttctttgcagaggacaacgagctgcaccactgcaccagagctggttgaggagaatgagcgattgaggaaagataatgagcgattgaggaaagagatgacaaagcttaaaggattgtatgcgaatatctacacattaatggcgaatttcacaccgggtcaagaagattgtgcgcatttgttacctgaagggaaacctttagatcttttaccggagagacaagagatgagtgaagccattatggcttctgaaatagagacagggattggtctgaaacttggtgaggatttgactccaaggttgtttggggtttctattggggtcaagcgagctagaagagaagaagaattgggtgctgcagaggaagaagatgatgatagacgagaagctgctgcccaagagggagaacaaagttctgatgttaaggcagagccaatggaggagaataactccggtaaccataatgggtcgtggcttgaactcggaaaatga

SEQ ID NO: 302 - protein, 377 aa, Arabidopsis thaliana
MPGEQTGETPTVAGVGGGGAGCSAGNSGGSSGCGAGGGGGGSGGGGGGGGDSQRSIPTPFLTKTYQLVEDPVYDELISWNEDGTTFIVWRPAEFARDLLPKYFKHNNFSSFVRQLNTYGFRKVVPDRWEFSNDCFKRGEKILLRDIQRRKISQPAMAAAAAAAAAAVAASAVTVAAVPVVAHIVSPSNSGEEQVISSNSSPAAAAAAIGGVVGGGSLQRTTSCTTAPELVEENERLRKDNERLRKEMTKLKGLYANIYTLMANFTPGQEDCAHLLPEGKPLDLLPERQEMSEAIMASEIETGIGLKLGEDLTPRLFGVSIGVKRARREEELGAAEEEDDDRREAAAQEGEQSSDVKAEPMEENNSGNHNGSWLELGK

SEQ ID NO: 303 - DNA, 1316 bp, Arabidopsis thaliana
ccattatccttaaagtaaccaacacttctctctctctttcttcaatggatttgcaactgaaacaatggagaagccagcagcagcaacaacatcagacagagtcagaagaacaaccttctgcagctaagataccaaaacatgtctttgaccagattcattctcacactgcaacttctactgctcttcctctctttacccctgagcctacttcttctaaactctcctctttgtctcctgattcttcctccaggttccccaagatggggagcttctttagctgggcacagtggcaagaacttgaactacaagctctgatctacaggtacatgttggctggtgctgctgttcctcaggagctccttttaccaatcaagaaaagccttctccatctatctccttcctactttcttcaccatcctcttcaacacctacctcattaccaacctgcttggtatttgggaagggcagcgatggatcctgagccaggcagatgcaggagaacggatggtaagaagtggagatgttcaagagacgtcttcgctggccacaagtattgcgagcgccacatgcaccgtggccgcaaccgttcaagaaagcctgtggaaactccaaccaccgtcaatgcaactgccacgtccatggcttcatcagtagcagccgcagccaccactacaacagcaacaacaacatctacgtttgcttttggtggtggtggtggtagtgaggaagtggttggtcaaggaggatctttcttcttctctggctcttctaactcttcatctgaacttctccaccttagtcaaagttgttcggagatgaagcaagaaagcaacaacatgaacaacaagaggccatacgagtcccacatcggattcagtaacaacagatcagatggaggacacatcctgaggcccttctttgacgattggcctcgttcttcgctccaagaagctgacaatagttcaagccccatgagctcagccacttgtctctccatctccatgcccgggaactcttcctcagacgtctctctgaagctgtccacaggcaacgaagagggagcccggagcaacaacaatgggagagatcagcaaaacatgagctggtggagcggtggaggttccaaccaccatcatcacaacatgggcggaccattggccgaagccctgagatcttcttcctcatcttccccaaccagtgttctccatcagcttggtgtctcgacacaagcctttcattgaccagtgtaaaaccaacacaacaatgcggtttttactgtgtttttggtttttatccaaatttcctgtataaagagg

SEQ ID NO: 304 - protein, 398 aa, Arabidopsis thaliana
MDLQLKQWRSQQQQQHQTESEEQPSAAKIPKHVFDQIHSHTATSTALPLFTPEPTSSKLSSLSPDSSSRFPKMGSFFSWAQWQELELQALIYRYMLAGAAVPQELLLPIKKSLLHLSPSYFLHHPLQHLPHYQPAWYLGRAAMDPEPGRCRRTDGKKWRCSRDVFAGHKYCERHMHRGRNRSRKPVETPTTVNATATSMASSVAAAATTTTATTTSTFAFGGGGGSEEVVGQGGSFFFSGSSNSSSELLHLSQSCSEMKQESNNMNNKRPYESHIGFSNNRSDGGHILRPFFDDWPRSSLQEADNSSSPMSSATCLSISMPGNSSSDVSLKLSTGNEEGARSNNNGRDQQNMSWWSGGGSNHHHHNMGGPLAEALRSSSSSSPTSVLHQLGVSTQAFH

SEQ ID NO: 305 - DNA, 1047 bp, Arabidopsis thaliana
atggctgatccagattgtatcttcagaaatggatatgtagactactataactatagcttcaactatgccacttccctctcacgcatctacaactctcatgacagcttttattatcctcaccagacgacaaacccaaacatcaacgaaaaccctaatttgacttcacctgactctcctccacttagagaagccctccctctccttagcttaagccccattcataagcatcaagaacctactgctaaccaccatgagtactatttcatggagacgacagaaacttcctctaattcaaactttcttgatcaatgccaagacagttatcgtcatgatgtaaccgtggatcttcatctagggttaccaaacctcggtgatggtggaagcagcagcagcgatgtggtccttgattccaccgaccaccaagagggtcaccatgatcatcatcaagatcaaggacttgaagttactatggcttctgaccatgatgatgaacatggtggcttacaaaggggtaatcatcttcatcacttttggatcccgactccttctcagattctgatgggtccaacacagttctcttgtcctctatgcttcaagactttcaacagatacaacaacatgcaaatgcacatgtggggacatggttcacaatacagaaaaggaccggagtcgctgagagggacacaaccaacggcgatgctgaagctgccttgctactgctgtgcaccgggctgcaagaacaacatagaccacccaagggctaggccgctcaaggacttccgtacgcttcagacacattacaagcggaagcacggtgtgaggccctttgcttgtcgtaggtgtgggaaggcatttgcggtcaaaggagattggaggactcacgagaagaactgtgggaagctatggtattgctcatgtgggtcggattttaagcacaagaggtcacttaaagaccacgttaaggcctttgggaatggtcatgtcccttgttgtggaattgatcatgaggaagaggaggctgcttctgatgtcgagcagcaagaatga

SEQ ID NO: 306 - protein, 348 aa, Arabidopsis thaliana
MADPDCIFRNGYVDYYNYSFNYATSLSRIYNSHDSFYYPHQTTNPNINENPNLTSPDSPPLREALPLLSLSPIHKHQEPTANHHEYYFMETTETSSNSNFLDQCQDSYRHDVTVDLHLGLPNLGDGGSSSSDVVLDSTDHQEGHHDHHQDQGLEVTMASDHDDEHGGLQRGNHLHHFWIPTPSQILMGPTQFSCPLCFKTFNRYNNMQMHMWGHGSQYRKGPESLRGTQPTAMLKLPCYCCAPGCKNNIDHPRARPLKDFRTLQTHYKRKHGVRPFACRRCGKAFAVKGDWRTHEKNCGKLWYCSCGSDFKHKRSLKDHVKAFGNGHVPCCGIDHEEEEAASDVEQQE

SEQ ID NO: 307 - DNA, 885 bp, Arabidopsis thaliana
atgcagactccgtacactacttcaacgcaggggcaatattgtcattcttgtggaatgttccaccaccatagccaaagctgctgctacaacaacaacaacaactccaacgccggttcttactcgatggtcttctccatgcaaaacggtggcgttttcgagcagaacggtgaggactatcatcactcttcctccctcgttgactgcactctctctcttggaactccttctacgaggctttgtgaggaagatgagaaacgtagacgctctacttcatctggtgcttcttcttgcatctccaacttttgggacttgattcacaccaaaaacaacaactccaaaacggcaccgtacaataacgttccttctttctccgctaacaagccaagtcgcggttgttccggtggtggtggtggcggaggaggcggtggcggaggtgactctcttctcgctagacgctgtgccaactgtgacactacttctactccactatggaggaatggtcctagaggccctaagtccctatgcaacgcatgcggcattcgtttcaagaaggaagagagaagaactactgcggctacaggaaacaccgtcgtcggagctgcaccggttcaaaccgaccagtacgggcatcacaactctggctacaataattaccatgctgccactaataacaacaataataatggtactccgtgggctcatcaccactcgacgcagagggttccgtgtaattatccggcaaatgagatcaggttcatggatgattacggcagtggagtagcaaacaacgttgaatccgacggtgctcacggcggtgttccgttcctttcttggaggcttaatgtagcggatagggcaagtcttgtccatgactttaccagatga

SEQ ID NO: 308 - protein, 294 aa, Arabidopsis thaliana
MQTPYTTSTQGQYCHSCGMFHHHSQSCCYNNNNNSNAGSYSMVFSMQNGGVFEQNGEDYHHSSSLVDCTLSLGTPSTRLCEEDEKRRRSTSSGASSCISNFWDLIHTKNNNSKTAPYNNVPSFSANKPSRGCSGGGGGGGGGGGGDSLLARRCANCDTTSTPLWRNGPRGPKSLCNACGIRFKKEERRTTAATGNTVVGAAPVQTDQYGHHNSGYNNYHAATNNNNNNGTPWAHHHSTQRVPCNYPANEIRFMDDYGSGVANNVESDGAHGGVPFLSWRLNVADRASLVHDFTR

SEQ ID NO: 309 - DNA, 1029 bp, Arabidopsis thaliana
atggagaagatgatagaaccacgggacaacacaagagaatcagaagatgaggatgcgttaaagcttccagggtttaggtttcatccgacggatgaggagcttgtagggtattatctctctaaaaaagtgcttctcaaaaaaacgagcaagattgatgagatcgtcagccaaattgatatctataaatttgatccgtgggatcttccaaggtcgaggaatacagagaaggagagctacttcttttgtaagagaggaaggaaatacagaaacagcataagaccgaaccgagtgactggttccggtttctggaaagccacagggatagacaagcctgtctattccgatggatccaacaaagccgtgatcggtctaaagaagacactcgtttattacctaggaagcgccgggaaaggaaacaagacggattggatgatgcacgagtttcgtctccctacagccaatgacacaatccccggtggccctacacactctaaccctactccaacttccttgctacacgcggaagtatggacgttatgccggatatttaagagaactgtgtctagtcgaaaatacactccggactggagagaattagcaaatggcaaacgtgtgaagcagcaacaatctaattaccaagaagcttatataaattttggggacaatgaaagtagtagtagtaccaacgtgatgaacgttagggaaggcaaagggaactacgagagaagcgttttccagcttcagcaaacgccttatcaacatcaaaaccagccaattctcatggacaccacacacgttgattcgtttcaacatttctccaacgataacattcaccatgaaacctacgagacttggccggacgagcttcgatcggttgtggaatttgctttcccaccttcttttcttagttagatctctagaataattaacaactaatatgtatacatattacatattactagcttggacgtgttgtatcatcagatctctactgtatacatggatcgtgtgtatatgaatatgcacctg

SEQ ID NO: 310 - protein, 303 aa, Arabidopsis thaliana
MEKMIEPRDNTRESEDEDALKLPGFRFHPTDEELVGYYLSKKVLLKKTSKIDEIVSQIDIYKFDPWDLPRSRNTEKESYFFCKRGRKYRNSIRPNRVTGSGFWKATGIDKPVYSDGSNKAVIGLKKTLVYYLGSAGKGNKTDWMMHEFRLPTANDTIPGGPTHSNPTPTSLLHAEVWTLCRIFKRTVSSRKYTPDWRELANGKRVKQQQSNYQEAYINFGDNESSSSTNVMNVREGKGNYERSVFQLQQTPYQHQNQPILMDTTHVDSFQHFSNDNIHHETYETWPDELRSVVEFAFPPSFLS

SEQ ID NO: 311 - DNA, 1743 bp, Arabidopsis thaliana
tcgttcgtacccacgcgtccggcgtatatgatgaacaaagacatgttacttcaccagcatcagcaaccacaacaagacgagaatatgtcgaatctaacatcagcttccggggatcaagcaagtgtctcttcaggaaatataactgaagcaagtggttctaattacttccctcatcatcagcaacagcaagaacaacaacaacaacagttagttgttccagattcgcagactcaaaagaagaggagaaaccaaccagggaatccagacccagaatcagaagtgatagctctatcaccaaaaacactaatggcaacaaacagattcgtgtgtgaaatctgcaacaaaggttttcaaagagaccagaatctacagcttcatagaagaggtcacaatctgccatggaagctgaaacaaagatccaacaaagaagtgataaggaagaaagtgtatgtatgtccagaagcaagctgtgtccaccatgatccatctagagctctcggtgacttaaccggaatcaagaagcatttctgtagaaaacatggtgagaagaagtggaaatgtgataagtgttcaaagaaatatgctgttcaatcagattgcaaggctcattctaagacttgtggcaccaaagaatacagatgtgactgtggcactctcttttctaggagggatagtttcataactcatagagcattttgtgaagcattggctgaagagactgcaagagaagtagtaataccacaaaaccagaataataatcaaccaaaccctcttttgattcatcaatctgcttctcatcctcatcaccatcatcaaacacaaccaaccataaacgtctcttcttcttcatcttcctcccacaaccacaacatcatcaatagccttcacttcgacaccaacaatggtaatactaataatagtaacaacagcaacaaccatctccatacatttcccatgaagaaagagcaacaaagcaatgaccatatcatgaattaccaccatagtatcatccctccttggcttgctcctcagcctcacgcactcacatcttcaaaccctaaccctagtaatggtggaggaggaggaggaagtttgttctctcttgcttctccggctatgtcagccaccgcattgctccagaaagcagcccaaatgggctctacaaagacacctcctttaccaccaaccacggcctacgagaggtcaactcataataacaacctcacaacgacaatggcggcgatgatgacgtcaccatctggattcatcagctccaacaacaacaatcatgttttgtttcaagactacaacgcatccgggtttgataatcacggcagagaagaagcattcgacgatacatttggcgggttcttgagaacaaacgaagttacagccgccgcaggatcagagaagagtactaaaagcggtggaggagaaggtttgacgagagatttcttggggctaagaccgttaatgtctcataacgagattctaagttttgctggtcttggaagttgcataaatagctctgcttctgatcagcttcatccaaagccttggcagggttagttaggttttttgctcataatatataatatgtgtatatatatttatatatctagttttgcatctttctcttgttttgttcttcgttttataaatttatatgttgaatgctcatcaaaggaaaaaccccgaaaaaaaaaaaaaaaagggcggccgctctagagtatccctcggggg

SEQ ID NO: 312 - protein, 513 aa, Arabidopsis thaliana
MMNKDMLLHQHQQPQQDENMSNLTSASGDQASVSSGNITEASGSNYFPHHQQQQEQQQQQLVVPDSQTQKKRRNQPGNPDPESEVIALSPKTLMATNRFVCEICNKGFQRDQNLQLHRRGHNLPWKLKQRSNKEVIRKKVYVCPEASCVHHDPSRALGDLTGIKKHFCRKHGEKKWKCDKCSKKYAVQSDCKAHSKTCGTKEYRCDCGTLFSRRDSFITHRAFCEALAEETAREVVIPQNQNNNQPNPLLIHQSASHPHHHHQTQPTINVSSSSSSSHNHNIINSLHFDTNNGNTNNSNNSNNHLHTFPMKKEQQSNDHIMNYHHSIIPPWLAPQPHALTSSNPNPSNGGGGGGSLFSLASPAMSATALLQKAAQMGSTKTPPLPPTTAYERSTHNNNLTTTMAAMMTSPSGFISSNNNNHVLFQDYNASGFDNHGREEAFDDTFGGFLRTNEVTAAAGSEKSTKSGGGEGLTRDFLGLRPLMSHNEILSFAGLGSCINSSASDQLHPKPWQG

SEQ ID NO: 313 - DNA, 894 bp, Arabidopsis thaliana
aacgagccaacaaagcaaaacctctttcttctcttctccactttctctctagattctctcatatttcccctcttgagagtctaacaatggcgtcaacgacgtgtgcaagagaggtgcattacagaggagtcagaaagagaccttggggtcgctacgctgctgagatacgagatccttggaagaaaactagggtttggttaggcactttcgacactcccgaagaagctgctcttgcttacgacggcgctgctcgtttcctccgtggtatcaaagccaaaactaacttcccttctcctctctctctcgacctcaaccacctcccttccgctccctcagccgcaaccgccgccgcaaataaccaaccccaccaacaccaacagctctggttcgctgcgcctcctcctgttcctccaagctccgaccatcatcaccaacaccaccgcatttttctccgaaccggtgtgctaaacgacaaaacttcagattactcttctacagaagcgccgctttacttcacctcctcgcctaacacagccacgtcatcgcctggttatcaagtggttgggtttccgatgatgaattcttctccttcccctgttacggtgagacgtggcttagccattgacctcaacgagcctccgccgctttggctttgaaaacaaacgataaagatggatatagcggcgccgttttgcctacttttctatacggcgccgtttgagaccactttcggtggaactactttagtttcttttttttagcaaatagtatctttttgttagagttagtagacttgtttttataatttaatccttcttttgttcgttatgtaagagtcggagatcgattgttgttgtgagatccatatgttgcggaaaaaacaagaaacttcgt

SEQ ID NO: 314 - protein, 189 aa, Arabidopsis thaliana
MASTTCAREVHYRGVRKRPWGRYAAEIRDPWKKTRVWLGTFDTPEEAALAYDGAARFLRGIKAKTNFPSPLSLDLNHLPSAPSAATAAANNQPHQHQQLWFAAPPPVPPSSDHHHQHHRIFLRTGVLNDKTSDYSSTEAPLYFTSSPNTATSSPGYQVVGFPMMNSSPSPVTVRRGLAIDLNEPPPLWL

SEQ ID NO: 315 - DNA, 1243 bp, Arabidopsis thaliana
tcgagtcaaattctacatcgggatcttactgggttttttttttaaacattaaattcgtaaattcccaaagaaaaaaaaaaaaactcgataccttttgttttacaaagtcgtcacaattctgaaacccttaattgaatccaagagaatttttgattaaattaagtctctggaccctgaagtccccacacaagcaagcttcgatggatcccaagaacctaaatcgtcaccaagtaccaaatttcttgaacccaccaccaccaccgcgaaatcagggtttggtagatgatgatgctgcttctgctgttgtttccgacgagaatcgcaaaccaacaactgagattaaagatttccagatcgtggtctctgcttccgacaaagaaccaaacaagaagagtcagaatcagaaccagcttggtcctaagagaagctctaacaaagacagacacactaaagtcgaaggtagaggtcgacgaattcggatgcctgctctttgtgctgctaggatttttcaattgactagagaattgggtcataaatctgatggtgaaactatccagtggctgcttcaacaagctgagccatcgattattgcagctactggttcaggaactataccggcctctgctttagcttcttcagctgcaacctctaaccatcatcaaggtgggtctcttactgctggtttaatgatcagtcatgacttagatggtgggtctagtagtagtggtagaccattaaattgggggattggtggcggtgaaggagtttctaggtcaagtttaccaactgggttatggccaaatgtagctgggtttggttctggtgtgccaaccactggtttaatgagtgaaggagctggttatagaattgggtttcctggttttgattttcctggtgttggtcatatgagttttgcatctattttgggtgggaatcataatcagatgcctggacttgagttaggcttgtctcaagaagggaatgttggtgttttgaatcctcagtcttttactcagatttatcaacagatgggtcaggctcaggctcaagctcaaggtagggttcttcaccatatgcatcataaccatgaagaacatcagcaagagagtggtgagaaagatgattctcaaggctcaggtcgttaaaaggattgggtttttttttgtatcttctggatttgaaaaagcttttggcttttgttttgtgataatattgttgtaatttgtaccaccatggagaagaa

SEQ ID NO: 316 - protein, 314 aa, Arabidopsis thaliana
MDPKNLNRHQVPNFLNPPPPPRNQGLVDDDAASAVVSDENRKPTTEIKDFQIVVSASDKEPNKKSQNQNQLGPKRSSNKDRHTKVEGRGRRIRMPALCAARIFQLTRELGHKSDGETIQWLLQQAEPSIIAATGSGTIPASALASSAATSNHHQGGSLTAGLMISHDLDGGSSSSGRPLNWGIGGGEGVSRSSLPTGLWPNVAGFGSGVPTTGLMSEGAGYRIGFPGFDFPGVGHMSFASILGGNHNQMPGLELGLSQEGNVGVLNPQSFTQIYQQMGQAQAQAQGRVLHHMHHNHEEHQQESGEKDDSQGSGR

SEQ ID NO: 317 - DNA, 1130 bp, Arabidopsis thaliana
atttcccaaagggatttacgaaaagtccctctcctctatcatctctttattcaccccataccaacaacctctacatcttcttcttcttcttcctcctcttttattttctttttaaatcatttacacaaaaatccaaagacaaatctgaaatctctaataaacaaatccataaaataagaaaaacaaagatgaaaggtgaatacagagagcaaaagagtaacgaaatgttttccaagcttcctcatcatcaacaacaacagcaacaacaacaacaacaacactctcttacctctcacttccacctctcctccaccgtaacccccaccgtcgatgactcctccatcgaagtggtccgacgtccacgtggcagaccaccaggttccaaaaacaaacctaaaccacccgtcttcgtcacacgtgacaccgaccctcctatgagtccttacatcctcgaagttccttcaggaaacgacgtcgtcgaagccatcaaccgtttctgccgccgtaaatccatcggagtctgcgtccttagtggctctggctctgtagctaacgtcactttacgtcagccatcaccggcagctcttggctctaccataactttccatggaaagtttgatctcctctccgtctccgcaacgtttctccctcctccgcctcgtacttccttgtctcctcccgtttctaacttcttcaccgtctctctcgctggacctcaaggacaaatcatcggagggttcgtcgctggtccacttatttcggcaggaacagtttacgtcatcgccgcaagtttcaacaacccttcttatcaccggttaccggcggaagaagagcaaaaacactcggcggggacaggggaaagagagggacaatctccgccggtctctggtggcggtgaagagtcaggacagatggcgggaagtggaggagagtcgtgtggggtatcaatgtacagttgccacatgggtggctctgatgttatttgggcccctacagccagagctccaccgccatactaaccaatccttctttcacaaatctctttctttctttttttgtttttttttgttttgggttaggatgaatcaagaaactagggttttttttttttttttttaaaaaaaaaaaaa

SEQ ID NO: 318 - protein, 276 aa, Arabidopsis thaliana
MKGEYREQKSNEMFSKLPHHQQQQQQQQQQHSLTSHFHLSSTVTPTVDDSSIEVVRRPRGRPPGSKNKPKPPVFVTRDTDPPMSPYILEVPSGNDVVEAINRFCRRKSIGVCVLSGSGSVANVTLRQPSPAALGSTITFHGKFDLLSVSATFLPPPPRTSLSPPVSNFFTVSLAGPQGQIIGGFVAGPLISAGTVYVIAASFNNPSYHRLPAEEEQKHSAGTGEREGQSPPVSGGGEESGQMAGSGGESCGVSMYSCHMGGSDVIWAPTARAPPPY

SEQ ID NO: 319 - DNA, 1216 bp, Arabidopsis thaliana
caagaaccatctcgtaaatcaagatttctccaaggaaaatcagataagtcataatggatctatccctggctccgacaacaacaacaagttccgaccaagaacaagacagagaccaagaattaacctccaacatcggagcaagcagcagctccggtcccagcggaaacaacaacaaccttccgatgatgatgattccacctccggagaaagaacacatgttcgacaaagtggtaacaccaagcgacgtcggaaaactcaacagactcgtgatccctaaacaacacgctgagaggtatttccctctagactcctcaaacaaccaaaacggcacgcttttgaacttccaagacagaaacggcaagatgtggagattccgttactcgtattggaactctagccagagctacgttatgaccaaaggatggagccgtttcgtcaaagagaaaaagctcgatgcaggagacattgtctctttccaacgaggcatcggagatgagtcagaaagatccaaactttacatagattggaggcatagacccgacatgagcctcgttcaagcacatcagtttggtaattttggtttcaatttcaatttcccgaccacttctcaatattccaacagatttcatccattgccagaatataactccgtcccgattcaccggggcttaaacatcggaaatcaccaacgttcctattataacacccagcgtcaagagttcgtagggtatggttatgggaatttagctggaaggtgttactacacgggatcaccgttggatcataggaacattgttggatcagagccgttggttatagactcagtccctgtggttcccgggagattaactccggtgatgttaccgccgcttcctccgcctccttctacggcgggaaagagactaaggctctttggggtgaatatggaatgtggcaatgactataatcaacaagaagagtcatggttggtgccacgtggcgaaattggtgcatcttcttcttcttcttcagctctacgactaaatttatcgactgatcatgatgatgataatgatgatggtgatgatggcgatgatgatcaatttgctaagaaagggaagtcttcactttctctcaatttcaatccatgagaagtttcatcatcttcttgttttgaatctctctttatattgtttccattagtaatttttactaagggtattagattctagctagt

SEQ ID NO: 320 - protein, 358 aa, Arabidopsis thaliana
MDLSLAPTTTTSSDQEQDRDQELTSNIGASSSSGPSGNNNNLPMMMIPPPEKEHMFDKVVTPSDVGKLNRLVIPKQHAERYFPLDSSNNQNGTLLNFQDRNGKMWRFRYSYWNSSQSYVMTKGWSRFVKEKKLDAGDIVSFQRGIGDESERSKLYIDWRHRPDMSLVQAHQFGNFGFNFNFPTTSQYSNRFHPLPEYNSVPIHRGLNIGNHQRSYYNTQRQEFVGYGYGNLAGRCYYTGSPLDHRNIVGSEPLVIDSVPVVPGRLTPVMLPPLPPPPSTAGKRLRLFGVNMECGNDYNQQEESWLVPRGEIGASSSSSSALRLNLSTDHDDDNDDGDDGDDDQFAKKGKSSLSLNFNP

SEQ ID NO: 321 - DNA, 1368 bp, Arabidopsis thaliana
atggagcagttcaaagagaggaagtttgtttgtaagttctgtagcaagaggtttccttgtgggaaatcacttggaggtcacatcagaactcacatgaatgagaattcagctgattcagatgaagatgaggctgataagctcaagatgattgatgaaaatggtggtcaatctagttatggtctgagagagaatcctaaaaagaacaagaggtttgtggatcacagacagattatggctctgaaacagcagcagcagcagcaacaacttcaagagctgcgtcgttgcagagaatgtggtaaaggttttgtttcttctaaagctctttgtggtcacatggcttgtcactctgagagagagaagattgttatggatagtcaatctgatactgaggcttcttcctctcctatcagaagaagatccaagagagttgttgtgaaacctcaccacaaagctgcttttgtagttggtggtaatggtattatgaatcaatctatttcagcttcttctgatgcttctgagattgagcctgaacaggaggaaatggcaaggtctttgatgatgctttcgagggattctagttttaagaaaggacataactctttggctgagtcatctgacaacaactctgtgattcttgagactaagtcatcttcaggtgagcaggttaagatgttcaatgtgaagaatgttgaagagttatgtaagaagaacaaacttgtagttgataaccagatgaggtctggtgaagaaaatggtgatgttcattatgattcagataattctgactctggctacttcaggaatggaccaaagaagttggactcagatgtttctgttgatgggttctttaggaacaaaacaataatgggatctggatccggattcaacagctccccaacaaaacaagatagggacatgaacagattcaggaaggaatggtataaggaaggagggtcagggtcaggatcaggatcaggtcgttcttctacaaagtatgatctgaggaaaagcaaaagaggttttccttctcatggtcgtaagaaaatcaagtatgagttcactgaatctgtctatgacagtggtgagcatagcttggaaactgactcttgtgcggacacaaacagaactatcaagattcatagtaagtctccaatggttaagaaagcaaacggtgcaaagaagaaaagcaaaggtcacgagtgtccgatttgcttcagggtgttcaaatcaggacaagctttaggaggtcacaagagatcacatttcattgggaatcaagaacacaggactttggtgattcaacatcaagtagctcatgagatgcatacactcatcgatctcaatcttcctgctcctattgatgaatga

SEQ ID NO: 322 - protein, 455 aa, Arabidopsis thaliana
MEQFKERKFVCKFCSKRFPCGKSLGGHIRTHMNENSADSDEDEADKLKMIDENGGQSSYGLRENPKKNKRFVDHRQIMALKQQQQQQQLQELRRCRECGKGFVSSKALCGHMACHSEREKIVMDSQSDTEASSSPIRRRSKRVVVKPHHKAAFVVGGNGIMNQSISASSDASEIEPEQEEMARSLMMLSRDSSFKKGHNSLAESSDNNSVILETKSSSGEQVKMFNVKNVEELCKKNKLVVDNQMRSGEENGDVHYDSDNSDSGYFRNGPKKLDSDVSVDGFFRNKTIMGSGSGFNSSPTKQDRDMNRFRKEWYKEGGSGSGSGSGRSSTKYDLRKSKRGFPSHGRKKIKYEFTESVYDSGEHSLETDSCADTNRTIKIHSKSPMVKKANGAKKKSKGHECPICFRVFKSGQALGGHKRSHFIGNQEHRTLVIQHQVAHEMHTLIDLNLPAPIDE

SEQ ID NO: 323 - DNA, 1182 bp, Arabidopsis thaliana
atggatgtcgtttgtacggaacatcaaatgaggaagccaacggtggagattcctccgagaaagcttcttttatcttccaagagttttccttctgattcttcttcccctcgctcgccgcgtaaacataactggaacaaaagcaacaagattacatctgaacatgaagaagacaacgaagacaacaacagagagaataaagagtactgttatgattctgactctgatgatccttacgcaagtgatcatttccggatgttcgaattcaagatccgtcgttgcactcgtagccgaagccacgattggactgattgtccttttgctcatcccggtgagaaagctcgccgtcgtgaccctcgtcgctttcaatactccggtgaggtttgtcccgagtttcgtcgtggtggtgattgtagccgtggagatgattgtgagtttgctcatggagtcttcgagtgttggctccatcctattcgttaccgtactgaagcttgtaaagacggtaaacactgtaaaaggaaagtctgtttctttgctcattcgccacgtcagcttagggttcttcctccggagaacgtttccggtgtctcagcgtcgccttctcctgcggcgaagaatccatgttgcttgttttgtagcagctctcccacgagcactcttttgggtaatttgtctcatctttctcgatctccgtctctgtctccacctatgtctccggctaataaagccgctgctttttcacggttgaggaaccgcgccgcttctgccgtttccgccgctgcagccgctggttcaatgaactataaagacgttttgagcgagcttgtgaattctttggattccatgagcttagcggaagcgctgcaggcgagttcctcgtcgcccgttacaactccggtttccgctgcggctgccgcgtttgcgtcgtcctgcggtctgagcaatcagcgtctccatctccagcaacaacaaccaagtagccctttgcaatttgctctttcgccttccactccaagttacctaactaactcacctcaggcgaacttcttcagtgatgatttcactcctcgccggagacagatgaacgatttcacggcgatgacggccgttagggagaatactaacattgaggatggttcttgtggtgaccctgatctaggatgggtcaatgatctcttgacttga

SEQ ID NO: 324 - protein, 393 aa, Arabidopsis thaliana
MDVVCTEHQMRKPTVEIPPRKLLLSSKSFPSDSSSPRSPRKHNWNKSNKITSEHEEDNEDNNRENKEYCYDSDSDDPYASDHFRMFEFKIRRCTRSRSHDWTDCPFAHPGEKARRRDPRRFQYSGEVCPEFRRGGDCSRGDDCEFAHGVFECWLHPIRYRTEACKDGKHCKRKVCFFAHSPRQLRVLPPENVSGVSASPSPAAKNPCCLFCSSSPTSTLLGNLSHLSRSPSLSPPMSPANKAAAFSRLRNRAASAVSAAAAAGSMNYKDVLSELVNSLDSMSLAEALQASSSSPVTTPVSAAAAAFASSCGLSNQRLHLQQQQPSSPLQFALSPSTPSYLTNSPQANFFSDDFTPRRRQMNDFTAMTAVRENTNIEDGSCGDPDLGWVNDLLT

SEQ ID NO: 325 - DNA, 609 bp, Arabidopsis thaliana
ctcctttattctacggaagaaatctatatattctatatatggaaaacatcaaaaaccctaaaaacgcagatgattgttccgatagcatatcaaaaaacagtcatcaaggcgttgatgattccctgaaccagtcaagatcttacgtatgcagtttctgcataaggggcttctcgaatgctcaagcactaggagggcatatgaacatccacagaagagacagggctaaactcagacaaaagcttatggaagataataaggatgatgtcgtcgccgagagtgatgcatccgaagttgtgtctctagaccttaatgaacaacaacaacaacaaggagaagctttgacatgtgatgatcacgatcaatatgttgataacgatataagtcctaaacagaaattagagttttgggttcaagaaagcaagcttgatactaatgatcatggaaaggtcacggaggctagcatagatggttcgagttcgagtcatcatcgtgatattgaagtattggatctcgagcttcggttaggccaaagcgtcgtaaagaagaagacaacatagtctctgaacgatgaatcatatattgattgcattgtatcaatgggaaaatccc

SEQ ID NO: 326 - protein, 172 aa, Arabidopsis thaliana
MENIKNPKNADDCSDSISKNSHQGVDDSLNQSRSYVCSFCIRGFSNAQALGGHMNIHRRDRAKLRQKLMEDNKDDVVAESDASEVVSLDLNEQQQQQGEALTCDDHDQYVDNDISPKQKLEFWVQESKLDTNDHGKVTEASIDGSSSSHHRDIEVLDLELRLGQSVVKKKTT

SEQ ID NO: 327 - DNA, 678 bp, Arabidopsis thaliana
atggtgagcttttgcgagctttgtggtgccgaagctgatctccattgtgccgcggactctgccttcctctgccgttcttgtgacgctaagttccatgcctcaaattttctcttcgctcgtcatttccggcgtgtcatctgcccaaattgcaaatctcttactcaaaatttcgtttctggtcctcttcttccttggcctccacgaacaacatgttgttcagaatcgtcgtcttcttcttgctgctcgtctcttgactgtgtctcaagctccgagctatcgtcaacgacgcgtgacgtaaacagagcgcgagggagggaaaacagagtgaatgccaaggccgttgcggttacggtggcggatggcatttttgtaaattggtgtggtaagttaggactaaacagggatttaacaaacgctgtcgtttcatatgcgtctttggctttggctgtggagacgaggccaagagcgacgaagagagtgttcttagcggcggcgttttggttcggcgttaagaacacgacgacgtggcagaatttaaagaaagtagaagatgtgactggagtttcagctgggatgattcgagcggttgaaagcaaattggcgcgtgcaatgacgcagcagcttagacggtggcgcgtggattcggaggaaggatgggctgaaaacgacaacgtttga

SEQ ID NO: 328 - protein, 225 aa, Arabidopsis thaliana
MVSFCELCGAEADLHCAADSAFLCRSCDAKFHASNFLFARHFRRVICPNCKSLTQNFVSGPLLPWPPRTTCCSESSSSSCCSSLDCVSSSELSSTTRDVNRARGRENRVNAKAVAVTVADGIFVNWCGKLGLNRDLTNAVVSYASLALAVETRPRATKRVFLAAAFWFGVKNTTTWQNLKKVEDVTGVSAGMIRAVESKLARAMTQQLRRWRVDSEEGWAENDNV

SEQ ID NO: 329 - DNA, 1301 bp, Arabidopsis thaliana
cagatctggtaccgtcgacccgattgatcaattccaatattacgtcctttttttcttgaatctctctatatactcaatggaagcagctgcggaggctgtatcagccgctagggagcaatcattgatccttaaagggaaacggactaagcggcaacgtcctcagtccccaatccctttctctatcattcctcctatgtcttcgcatgaaccggatgctgaagaagagtctactagtcttgtttccaaggagaagagtctcaatgatgaaatcaacaacaataacatcaagaataataacaatactttgatcaatggtgttacatcttcatcttctgcctcttcatcttccaacaacaatgccacattaaaggccacggctgacgaagaagatcaagatatggctaattgtttgatcctcctcgcccaaggtcactctcttccccacctccaaccgcaaccgcacccccaacaacaaacaagacagcttatgatgagttaccaagattccggtaacaacaacaacaatgcgtatagatctagcagcaggaggtttctagagacatcttcatctaacgggaccacaacgaacggtggtggaggcagagccggttactatgtttaccagtgcaaaacatgtgaccggacttttccgtctttccaagctcttggtgggcatagagccagccacaagaagcctaaagccgctatgggtcttcactctaaccatgaccacaagaagtctaactacgatgacgccgtttctctccatctcaacaacgttctcaccacaactcctaacaacaatagtaaccatagatcgcttgtggtatacggcaaaggtagtaataataaggtccatgaatgtgggatatgtggagccgaattcacatccgggcaagcattaggtggtcacatgagacgccatagaggtgcagtggtagccgcagcagccgcctctaccgccaccgtatcggttgcggccattccggctactgcaaacacggctttgtcattgtcgccaatgtcgtttgatcagatgtcggagggtccaattcaggctcccgttaagagagcgaggagcgcggttgtgtcgttagatttagatctgaatctacctgccccggaagatgagaatcgggtcaacggattaagctttgcttcaaagcaagaacacgaacaagaacatgaacaaacacaacagaagaaacagagagaagaacaaaagtctcttgtcttgtcttctgctcctacattggtggattgccattactaaaatcaaaattcattaatacctaatcaaa

SEQ ID NO: 330 - protein, 398 aa, Arabidopsis thaliana
MEAAAEAVSAAREQSLILKGKRTKRQRPQSPIPFSIIPPMSSHEPDAEEESTSLVSKEKSLNDEINNNNIKNNNNTLINGVTSSSSASSSSNNNATLKATADEEDQDMANCLILLAQGHSLPHLQPQPHPQQQTRQLMMSYQDSGNNNNNAYRSSSRRFLETSSSNGTTTNGGGGRAGYYVYQCKTCDRTFPSFQALGGHRASHKKPKAAMGLHSNHDHKKSNYDDAVSLHLNNVLTTTPNNNSNHRSLVVYGKGSNNKVHECGICGAEFTSGQALGGHMRRHRGAVVAAAAASTATVSVAAIPATANTALSLSPMSFDQMSEGPIQAPVKRARSAVVSLDLDLNLPAPEDENRVNGLSFASKQEHEQEHEQTQQKKQREEQKSLVLSSAPTLVDCHY

SEQ ID NO: 331 - DNA, 485 bp, Arabidopsis thaliana
ctccctcgcgcgatatcatatacaaatgaatagaaaatacttggatcgtcgatcatattcatggtccggatcacaagcaagaccatacatatgcgaattttgcgagagaggtttttccaacgcacaagctttaggagggcacatgaacatccacagaaaagacagggcaaaacttcgacaagcgaacctaaaagaagaagacagtgaagatgccatttgcaccacttcgagaaatcggtttgggcaagagcttattgagttacctttcttcgttgatacggtcggtccaagaagaaaaggagaagatgataaaagcgaaaaaggtttaggagatgaagaaaagaaaaatatgaggatacttcaaaaggctttatctcaaagtgcagacgtgatagatcttgagctccgtctaggattagatccttataaaaaaacaacaagtacaagtacgtaactaataactatatatgtgaatactttaatcc

SEQ ID NO: 332 - protein, 142 aa, Arabidopsis thaliana
MNRKYLDRRSYSWSGSQARPYICEFCERGFSNAQALGGHMNIHRKDRAKLRQANLKEEDSEDAICTTSRNRFGQELIELPFFVDTVGPRRKGEDDKSEKGLGDEEKKNMRILQKALSQSADVIDLELRLGLDPYKKTTSTST

SEQ ID NO: 333 - DNA, 762 bp, Arabidopsis thaliana
atggacgaggctaccggagaaacagaaactcaagatttcatgaacgtcgaatccttctctcagcttcctttcattcgccgtcctaaagataagaaccctaaacccattcgtgtcttcggaaaagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacgcgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattattcacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaa

SEQ ID NO: 334 - protein, 253 aa, Arabidopsis thaliana
MDEATGETETQDFMNVESFSQLPFIRRPKDKNPKPIRVFGKDFTGRDFSITTGQEDYTDPYQTKNKEEEEEEDQTGDNSTDNNSISHNRRFECHYCFRNFPTSQALGGHQNAHKRERQLAKRGVSSYFYHPDNNPYSYRHYPSWTNGPLTAARSYGGFSSGPKPSGYYSRPSYGSQLGLWRLPPRVQGVYNSNAAFTSNGSSSSSNSTLPLLTRSQTQLSSQVGGSAAQNRMSSYGYGLSPNVQDHVSLDLHL

SEQ ID NO: 335 - DNA, 1014 bp, Arabidopsis thaliana
atggagccaaagtgtgaccattgtgcaacctcgcaagcattgatttactgcaaatccgatttggctaaactatgcctaaactgcgacgtccatgtacactctgcgaatcctctgtctcacaggcacatacgctctttgatctgcgagaaatgcttctcacagccagccgcaatccgctgtctcgacgagaaggtttcatactgccaaggatgtcattggcacgaaagcaactgttcggagttaggacacagagttcagagcttgaatcctttctctggttgtccttctcctacagattttaacagaatgtggtcttcaattcttgaacctcctgtctccggcttgcttagtccgttcgttggttcttttcccttgaatgatctcaacaataccatgttcgataccgcttattccatggtaccacacaacatcagttacactcagaatttcagtgataatttgtctttcttttccacggaatctaagggatatcctgatatggttcttaaacttgaagaaggagaagaagatctatgtgaagggcttaacttggatgatgcaccattaaactttgacgtaggagatgatattatcggatgttcatcagaagtacacatagaaccggaccatacggcatcgccaccaggtcagcaaatgaacatcaacactggacttcagcttcctctatcacctgtcttgttcggacaaatccatccatctcttaacatcactggtgaaaacaatgcagctgattaccaggattgtgggatgtctccagggtttataatgagtgaagcgccatgggaaacgaattttgaagttagttgtccacaagcaagaaacgaggctaagttgagatacaaggagaagaaattaaagcgctcttttgggaaacagattcgatatgcatctcgcaaagcaagagctgacacgaggaaaagagtgaaaggaagatttgtgaaagctggtgacagttatgattatgatccatcatcaccgacgacgaacaattga

SEQ ID NO: 336 - protein, 337 aa, Arabidopsis thaliana
MEPKCDHCATSQALIYCKSDLAKLCLNCDVHVHSANPLSHRHIRSLICEKCFSQPAAIRCLDEKVSYCQGCHWHESNCSELGHRVQSLNPFSGCPSPTDFNRMWSSILEPPVSGLLSPFVGSFPLNDLNNTMFDTAYSMVPHNISYTQNFSDNLSFFSTESKGYPDMVLKLEEGEEDLCEGLNLDDAPLNFDVGDDIIGCSSEVHIEPDHTASPPGQQMNINTGLQLPLSPVLFGQIHPSLNITGENNAADYQDCGMSPGFIMSEAPWETNFEVSCPQARNEAKLRYKEKKLKRSFGKQIRYASRKARADTRKRVKGRFVKAGDSYDYDPSSPTTNN

SEQ ID NO: 337 - DNA, 942 bp, Arabidopsis thaliana
atgatttcaaagtaccaagaagatgtcaagcagccacgagcttgcgaactttgtctgaacaaacacgcagtttggtactgtgcctccgatgatgctttcttgtgccatgtttgtgatgaatcagtgcattctgcaaaccatgtagcgacaaaacacgagagagtttgtcttagaacaaacgagatatcgaatgatgtgcgtgggggaacaacattaacctcggtttggcacagcgggtttcgaagaaaagcaagaactcctagatctcggtatgagaaaaagccacaacaaaagatagatgatgagagaagaagggaagatcctcgtgttcccgagattggaggcgaagtgatgtttttcataccagaagcaaatgatgatgatatgacttctcttgtgccagagtttgagggattcacagagatgggattcttcttgagcaaccacaatggtactgaagaaacaacgaaacaattcaactttgaagaagaagctgacacaatggaggatctatattacaatggagaagaagaagataaaactgatggagctgaagcatgtcctggacaatatttgatgagctgcaagaaagattacgacaatgtcataacggtttcagaaaagacagaagaaattgaagattgttatgagaataatgcaaggcatagactgaattacgaaaatgttatagcagcttgggataaacaagaatctcctagagatgtaaaaaacaacacaagtagcttccagctagttcctccagggatagaggagaagagagtaagaagtgagagagaagctagagtttggagatacagagataaaaggaagaatcgtttgttcgagaagaagataaggtacgaggttagaaaggttaacgccgacaaaaggccgagaatgaaaggtcgatttgtccgacgatctttagccatcgactcttag

SEQ ID NO: 338 - protein, 313 aa, Arabidopsis thaliana
MISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 339 - DNA, 1700 bp, Arabidopsis thaliana
actgggtctgtgtaaagttgataactttttttggtttagagagagaaaggacagagctttacagagatggagatgaagcagatgaagtttcttactcaccaagctttcttttcctctgttcgatcaggagatcttagtcaacttcaacagttagttgacaatttaaccggagatgagctaatcgatgagtcatcgccgtgttctgctgtggctgagcttatgtctgtgcaaaacgacgccggagagaccgccgtctatatctccgccgcagagaatcttgaagacatttttcgttacttgattaggttttctagtttggaaacagttaagatcagatccaaatccgacatgaacgcttttcatgtcgctgccaagcgaggtcacttgggaattgtgaaggagttactgagactatggccagagctttgcagaatctgcgacgcttccaacacgagtccgctttacgcagctgcggttcaagatcacttagaaatagtaaatgcaatgcttgatgttgatcctagctgtgcaatgattgtgagaaagaacgggaaaacatctttgcacactgcgggaaggtacgggcttcttcggatagtgaaagctctcatagagaaagacgcagcgattgttggtgttaaagataagaaaggtcagactgctcttcacatggctgttaaaggacgaagtttggaagtagtcgaagagattttgcaggctgattacacaatattgaatgagagagatcgaaaagggaacactgctttgcatattgctactcgaaaggcgcggccacagataacgagcttattgctgacctttacggcgattgaagtgaatgcgattaacaaccagaaagaaactgctatggatttggcggataagctgcaatatagcgaatctgctttggagatcaatgaggctttggtagaagctggggctaagcatgggaggttcattggtcgagaagatgaggcgagagcattgaagcgagcagtgagtgatatcaaacacgaggtgcaatcgcagcttttgcagaatgagaaaaccaaccgtcgtgtctctgggatcgcgaaagagctgaggaaactccacagagaagcggttcagaacacgactaactccataacggtagtggcggttctgtttgcttccatagcgttcttggccatattcaacttgccgggtcagtatttcacggaggggtcgcatgtgggacaagccaatattgcagggagaaccggattccgcgtgttctgtcttttaaacgcgacatctctgtttatatcgttagcggttgtggtagttcaaataactttggtggcgtgggacacacgggcgcagaagaaagttgtgtctgtagtgaataagctaatgtgggcagcttgtgcttgcacattcggagcatttttggcgattgcatttgcggttgttggaaaggggaactcgtggatggcgattaccataacgttgcttggagcaccgatcttggtagggacattggcaagtatgtgttatttcgtgtttcggcagcggtttaggagcggcaacgattcacagagaaggattaggagagggagtagtaagtcgttttcatggtcttactctcatcatgtatccgattttgaagatgaatcagatttcgagaagattattgctctttgaattaagtttcttaagcgtctttgtatagatcgtct

SEQ ID NO: 340 - protein, 532 aa, Arabidopsis thaliana
MEMKQMKFLTHQAFFSSVRSGDLSQLQQLVDNLTGDELIDESSPCSAVAELMSVQNDAGETAVYISAAENLEDIFRYLIRFSSLETVKIRSKSDMNAFHVAAKRGHLGIVKELLRLWPELCRICDASNTSPLYAAAVQDHLEIVNAMLDVDPSCAMIVRKNGKTSLHTAGRYGLLRIVKALIEKDAAIVGVKDKKGQTALHMAVKGRSLEVVEEILQADYTILNERDRKGNTALHIATRKARPQITSLLLTFTAIEVNAINNQKETAMDLADKLQYSESALEINEALVEAGAKHGRFIGREDEARALKRAVSDIKHEVQSQLLQNEKTNRRVSGIAKELRKLHREAVQNTTNSITVVAVLFASIAFLAIFNLPGQYFTEGSHVGQANIAGRTGFRVFCLLNATSLFISLAVVVVQITLVAWDTRAQKKVVSVVNKLMWAACACTFGAFLAIAFAVVGKGNSWMAITITLLGAPILVGTLASMCYFVFRQRFRSGNDSQRRIRRGSSKSFSWSYSHHVSDFEDESDFEKIIAL

SEQ ID NO: 341 - DNA, 3771 bp, Arabidopsis thaliana
atgaagagaaagcattactttgagtttaaccatccatttaatccatgtcctttcgaggtgttctgctgggggacatggaaggccgtggagtacttaaggatcgagaatggaacgatgacaatgcgtctcttagaaaatggacaagttttggatgatataaaaccatttcagaggcttcgaattagatcaagaaaggcgactttgatcgactgtacttcttttttaagacccggtatcgatgtttgcgttctttatcagagagatgaagagactccagaaccagtttgggtggatgcaagggttttatctatagagaggaagcctcatgaatctgaatgcttgtgtacgttccatgtcagtgtttatatagaccaaggctgcattggtttggagaagcatagaatgaataaagttccggtactcgtgggactcaacgaaatcgccatccttcaaaagttttgcaaggaacaaagcttggaccgttactatagatggagatactctgaggactgttcttcgttggtgaaaacaagactaaacttagggaagttcttgcctgatcttacatggttgcttgttacatcagttttgaaaaacattgtgtttcagattagaaccgttcacgagaagatggtttatcagattgtgacggatgaagattgcgaaggctctagtagctctttgagtgcaatgaacattacggttgaagacggtgttgtcatgtctaaggttgttttgttcaatccagctgaggatacttgtcaagatagtgatgtaaaggaggagattgaagaggaggtaatggagctgcgtcggtccaagagaagaagcgggcggcctgagagatacggagactctgagattcagccggattcgaaggatggatgggtaaggatgatgccatataggtacaacatatggaatgtttcaagtgatgatgatgatgaagaagaagattgcgaggatgataaagatactgatgatgatttatacttaccgttatcgcatttacttagaaagaaaggaagcaaaaagggatttagtaaggataagcagagagagatagttttggtagacaaaactgagaggaagaagagaaagaaaacagagggatttagtcgaagttgtgagctttcggttattcctttcactcctgtctttgaacctataccgttggaacagtttggtctcaatgcaaatagtttgtgtggtggtgtctctggaaatttgatggatgagatcgataagtatcgtagtaaagcagcgaaatacgggaagaagaagaagaagaagattgaaatggaagagatggaatctgatctaggttggaatggacctattgggaatgtggttcataaaagaaatggaccgcattctcgaataaggtccgtttctagggaaaccggagtttctgaggaaccgcagatttataagaagagaacgttgagcgcaggtgcgtataacaagttgatagactcgtacatgagtagaattgattctacaattgcagccaaggacaaagcaaccaatgttgttgagcagtggcaagggttaaagaaccccgcaagcttttcgatcgaagccgaagaaaggttgagtgaggaggaggaggatgatggcgagacttcagagaatgagattctatggagggaaatggaactatgcttggcttcttcttacattcttgatgaccatgaggtgagagtggataacgaggcgttccataaagcaacctgtgattgtgaacatgactatgaattgaatgaagaaatcggaatgtgttgcagattgtgtggtcatgtaggaactgagataaaacatgtttctgcaccttttgcgcggcacaagaaatggacgacggagactaagcaaatcaacgaagatgacattaatactactatagttaaccaagatggagttgagagccatactttcactataccagttgcttcctcagatatgccatcggctgaagaaagtgacaatgtctggtctttaatacctcagcttaagagaaaactgcatttgcaccagaaaaaagcttttgagtttctctggaagaacctagccgggtcagtggttcccgcgatgatggatccgagttcagataagataggtgggtgtgtagtttctcatactcccggagcaggaaaaacatttctaatcatagcttttctcgcgagctacttgaagatatttccgggtaaaagacctttggttcttgctccaaaaacaactttgtacacttggtacaaggagttcatcaaatgggagattccggtccctgttcacttgctccatggtcgtagaacctactgtatgtccaaagagaagaccattcagttcgagggaattccaaaaccaagccaagatgttatgcatgttcttgactgtttagacaaaatccagaaatggcatgcacagccgagtgttcttgtaatgggttacacatcgtttctaactttgatgagggaagattcaaagtttgctcatagaaagtacatggctaaagtactgagagagtctcctggattactggttctagacgagggacataacccgaggagtaccaagtcgagattacgaaaggccttgatgaaagttgatactgacttgaggattctgctttctggtacattgtttcagaacaacttctgtgagtacttcaacactttgtgcttggctagacccaagtttgttcatgaggttctagtggagttggacaagaagttccagaccaaccaagccgagcaaaaggcgcctcacttgcttgaaaatagagctcggaagttcttccttgacattatagccaagaagattgacacaaaagtgggcgatgagcgcttgcagggtctcaacatgttgaggaatatgacgagtggtttcatcgataactatgaagggagtggaagcggaagtggtgatgttctcccaggtttgcagatttacacattgttgatgaattccactgatgtacagcacaagagtcttaccaaacttcagaacataatgtcaacttaccatggatatccactcgagctcgagttactcataacgttagctgctatccatccttggttggtcaaaaccacaacctgttgcgccaaattcttcaaccctcaggagcttttagagattgagaagctcaagcacgatgcaaagaaaggatcaaaagtcatgtttgtgcttaatcttgtgttccgggtggtcaagagggagaaaatcctcatattttgtcacaacattgcgccgatccgcctgtttcttgagctgttcgagaatgtattcaggtggaagagaggccgagagctcctgaccttgacaggggatctcgagctgtttgaaagaggcagagtaatagacaaatttgaagagccaggaggccagtcccgtgttctgctggcttcgattacagcctgtgcagaaggcatcagtctaaccgctgcttcacgggtgatcatgcttgattcagagtggaatccttctaagacaaagcaagcaatcgcacgtgcattcagaccgggacagcagaaagtggtgtacgtttaccagctcttgtcgagaggaacacttgaagaagacaaatacaggaggacgacctggaaagaatgggtctccagtatgattttcagtgaagaatttgtggaggacccatctcaatggcaagctgagaagattgaggacgatgttcttagagaaatcgtggaggaagacaaagtcaaatccttccatatgatcatgaagaacgagaaagcttcaacaggtggctga

SEQ ID NO: 342 - protein, 1256 aa, Arabidopsis thaliana
MKRKHYFEFNHPFNPCPFEVFCWGTWKAVEYLRIENGTMTMRLLENGQVLDDIKPFQRLRIRSRKATLIDCTSFLRPGIDVCVLYQRDEETPEPVWVDARVLSIERKPHESECLCTFHVSVYIDQGCIGLEKHRMNKVPVLVGLNEIAILQKFCKEQSLDRYYRWRYSEDCSSLVKTRLNLGKFLPDLTWLLVTSVLKNIVFQIRTVHEKMVYQIVTDEDCEGSSSSLSAMNITVEDGVVMSKVVLFNPAEDTCQDSDVKEEIEEEVMELRRSKRRSGRPERYGDSEIQPDSKDGWVRMMPYRYNIWNVSSDDDDEEEDCEDDKDTDDDLYLPLSHLLRKKGSKKGFSKDKQREIVLVDKTERKKRKKTEGFSRSCELSVIPFTPVFEPIPLEQFGLNANSLCGGVSGNLMDEIDKYRSKAAKYGKKKKKKIEMEEMESDLGWNGPIGNVVHKRNGPHSRIRSVSRETGVSEEPQIYKKRTLSAGAYNKLIDSYMSRIDSTIAAKDKATNVVEQWQGLKNPASFSIEAEERLSEEEEDDGETSENEILWREMELCLASSYILDDHEVRVDNEAFHKATCDCEHDYELNEEIGMCCRLCGHVGTEIKHVSAPFARHKKWTTETKQINEDDINTTIVNQDGVESHTFTIPVASSDMPSAEESDNVWSLIPQLKRKLHLHQKKAFEFLWKNLAGSVVPAMMDPSSDKIGGCVVSHTPGAGKTFLIIAFLASYLKIFPGKRPLVLAPKTTLYTWYKEFIKWEIPVPVHLLHGRRTYCMSKEKTIQFEGIPKPSQDVMHVLDCLDKIQKWHAQPSVLVMGYTSFLTLMREDSKFAHRKYMAKVLRESPGLLVLDEGHNPRSTKSRLRKALMKVDTDLRILLSGTLFQNNFCEYFNTLCLARPKFVHEVLVELDKKFQTNQAEQKAPHLLENRARKFFLDIIAKKIDTKVGDERLQGLNMLRNMTSGFIDNYEGSGSGSGDVLPGLQIYTLLMNSTDVQHKSLTKLQNIMSTYHGYPLELELLITLAAIHPWLVKTTTCCAKFFNPQELLEIEKLKHDAKKGSKVMFVLNLVFRVVKREKILIFCHNIAPIRLFLELFENVFRWKRGRELLTLTGDLELFERGRVIDKFEEPGGQSRVLLASITACAEGISLTAASRVIMLDSEWNPSKTKQAIARAFRPGQQKVVYVYQLLSRGTLEEDKYRRTTWKEWVSSMIFSEEFVEDPSQWQAEKIEDDVLREIVEEDKVKSFHMIMKNEKASTGG

SEQ ID NO: 343 - DNA, 852 bp, Arabidopsis thaliana
atggtaggatcatttttaccacctggtttcagattttatccaacagatgaagaacttgtaggttattacctgcacagaagaaacgaagggcttgagatcgagctcgaaataatcccattaatggacttatacaagtttgatccttgggaacttccagagaaatccttcttgccaaatcgagatatggaatggtttttcttctgtcatcgcgacagaaaataccagaacggatctcgaataaacagagcaactaaatctggttattggaaagccactggcaaagatcgaaaaatcgtttgccactcttcttcttcttcatcatcttcctctatcaccggctgccgaaaaaccctagttttttatatgggtcgagctccttttggtggtagaaccgagtgggtaatgcatgagtatcgcctcttcgacaacgatacttcacaaggatcactaaacttcaagggagacttcgcgctgtgtcgtgtgataaagaggaatgagcatacgcttaagaaatgtgaaattatctcaccagaggtttcagatgagtcattaagcaataatgttaacaatttttgtcaagcaagtgacctagaaaagggttcttgtgatgcaagtaacacacgtttgtcttctcctgatttcatccttgaatcatcttttcagggaaattcacattcaaaaacagaagaagattccggtttccaagtatttacattacccgaattcgaatatccgctagaggtttttgcagatttgaatttcgatttggaaatggaggatccattcatgttcgattatcatccagagcctcatatgaacaatgaagtcatgagccatcacattcgtgggtaa

SEQ ID NO: 344 - protein, 283 aa, Arabidopsis thaliana
MVGSFLPPGFRFYPTDEELVGYYLHRRNEGLEIELEIIPLMDLYKFDPWELPEKSFLPNRDMEWFFFCHRDRKYQNGSRINRATKSGYWKATGKDRKIVCHSSSSSSSSSITGCRKTLVFYMGRAPFGGRTEWVMHEYRLFDNDTSQGSLNFKGDFALCRVIKRNEHTLKKCEIISPEVSDESLSNNVNNFCQASDLEKGSCDASNTRLSSPDFILESSFQGNSHSKTEEDSGFQVFTLPEFEYPLEVFADLNFDLEMEDPFMFDYHPEPHMNNEVMSHHIRG

SEQ ID NO: 345 - DNA, 1164 bp, Arabidopsis thaliana
atgatcaaagaggagaccgtttcatacttccaaactttcgatggtgttatggcagaatctgacaaggaagaggagcttgatgcaacaaaagcaaaggtggagaaagttcgggaagaaaatgagaaattaaagctcttactctctacgattcttaataattacaactctcttcaaatgcaagtctctaaagttctcggacaacaacaaggagcttcgtctatggagctagaccacattgatcgtcaagatgaaaataacgactatgatgtggatatatcacttaggcttggaagatcagagcaaaagatctctaaaaaggaggaaaataaggtggacaagatttctactaagaacgtagaggagtcaaaagataaaagatctgcactgggttttggatttcagattcaaagctatgaagcctcgaaactagatgatctttgtaggcaggttaagcttgcaaacgctgaaaataaatgtgtatcttcgaggaaagatgtcaaatcagttagaaatgaaaaccatcaagatgttttggaggagcatgaacaaacaggtttgaagaaaactagggtttgtgttaaagcatcatgtgaagacccatcaataaacgacggttgccagtggaggaaatatggtcaaaagactgcgaaaaccaatcctctcccacgagcctattaccgttgctccatgtcgtcaaattgtcccgttagaaaacaggtgcaaagatgtggagaagaagaaacctccgcttttatgacaacgtacgaaggaaaccatgaccatcctctccccatggaagcaagccacatggcagctggaacttccgcggctgcctccttattacaatctggctcctcctcttcctcctcctccacctcagcgagtctaagctatttcttcccttttcaccacttctctatctccaccactaactcgcacccgactgtaacattggacctcacacgaccaaactatcccaatcagttaccagacgactaccctctatcgtcctcctctttcagtctcaacttttcctctccagatcctccacctccatcatcgcatgaccacaccttgaactttagtggcttgcgaacacaagctccgttgagtacagattcattattggcccgttatcgaacgagactttccggacagcaataa

SEQ ID NO: 346 - protein, 387 aa, Arabidopsis thaliana
MIKEETVSYFQTFDGVMAESDKEEELDATKAKVEKVREENEKLKLLLSTILNNYNSLQMQVSKVLGQQQGASSMELDHIDRQDENNDYDVDISLRLGRSEQKISKKEENKVDKISTKNVEESKDKRSALGFGFQIQSYEASKLDDLCRQVKLANAENKCVSSRKDVKSVRNENHQDVLEEHEQTGLKKTRVCVKASCEDPSINDGCQWRKYGQKTAKTNPLPRAYYRCSMSSNCPVRKQVQRCGEEETSAFMTTYEGNHDHPLPMEASHMAAGTSAAASLLQSGSSSSSSSTSASLSYFFPFHHFSISTTNSHPTVTLDLTRPNYPNQLPDDYPLSSSSFSLNFSSPDPPPPSSHDHTLNFSGLRTQAPLSTDSLLARYRTRLSGQQ

SEQ ID NO: 347 - DNA, 549 bp, Arabidopsis thaliana
atgaatcccaagaaaaccaaaggaaaacaaaagattaacatcaagaaaattgaaaaagatgaaggcagatcggtcacattctctaagcgtctaaatggtatctacactaaaatcagtgagctttctattctctgtggtgttgaagttgcgtttatcgggtattcttgctctggaaaaccatacacttttggcagtccatccttccaagccgtggcggagcggtttctcaacggcgatgcctcgtcgtcttcttcatcatcattggtcatgaatgctcacaagcaagcgaagattcaagagctttgcaaaaaatacaatagattggtggaggagttaaaggtggacgaagtcaaagtcaagaaggcagctgcattggcggagacgagggtcgtgaataaggatgtgtggtggaaagtggatccaaatgacgtgaaggatcacgaaaaggcgaagaagatgatggagaagtatcaagagctctatgataaactgtgtgagcaagctgcttcaaggatcaagagaggacatgatgagaataataacaaatga

SEQ ID NO: 348 - protein, 182 aa, Arabidopsis thaliana
MNPKKTKGKQKINIKKIEKDEGRSVTFSKRLNGIYTKISELSILCGVEVAFIGYSCSGKPYTFGSPSFQAVAERFLNGDASSSSSSSLVMNAHKQAKIQELCKKYNRLVEELKVDEVKVKKAAALAETRVVNKDVWWKVDPNDVKDHEKAKKMMEKYQELYDKLCEQAASRIKRGHDENNNK

SEQ ID NO: 349 - DNA, 447 bp, Arabidopsis thaliana
atgttttatactaatatggagacggttcataactgcttcaatgatgctacgataaccggtgatgaaatcattgatatattggcgtttcttcaatcagacgagtcggacaatccaagcggtataaacgaggtagtaccggtggatgataagaagagaagacggacgatatcaaaccgggaatcggccaagagatcgaggatgaaaaagaagaaacgttttgaagagttaactgaagaggtgaaccggttaaacataagaaatcaggagctgaaaaaccggttagctaatgttgttagttgtggtaattttatatctagggagaataaccggttgaaaaccgaatcggtttgccttgagataaggcttttagagttgtaccgttttttagtggccatgcaatcgccaatctcaacgagtgtaaattacatcacaacgctcgagatttaa

SEQ ID NO: 350 - protein, 148 aa, Arabidopsis thaliana
MFYTNMETVHNCFNDATITGDEIIDILAFLQSDESDNPSGINEVVPVDDKKRRRTISNRESAKRSRMKKKKRFEELTEEVNRLNIRNQELKNRLANVVSCGNFISRENNRLKTESVCLEIRLLELYRFLVAMQSPISTSVNYITTLEI

SEQ ID NO: 351 - DNA, 1482 bp, Arabidopsis thaliana
taggtaaagctaaaagggtctgattcgtttgttttttcactgaagaatttggaaggaagtgattccgttgtgaaacagaaaagaagtatgggtactcacattgatatcaacaacttaggcggcgatacttctagagggaatgagtcaaagccattggcgaggcagtcttcgttatattccttaacgtttgatgagcttcagagcacattaggtgagccggggaaagattttgggtctatgaatatggatgagttactcaagaacatatggactgctgaggatactcaagcctttatgactactacatcttcggttgcagccccgggacctagtggttttgttccgggaggaaatggtttacagaggcaaggctccttgaccttgcctagaacgcttagtcagaagactgtcgatgaagtctggaaatacctgaattcgaaagaaggtagtaatgggaatactggaacggatgcgcttgagaggcaacagactttaggggaaatgactctggaagatttcttactccgtgctggcgttgttaaagaagataatactcagcagaacgaaaacagtagtagcgggttttatgctaacaacggtgctgctggtttggagtttggatttggtcagccgaatcaaaacagcatatcgttcaacgggaacaatagttctatgatcatgaatcaagcacctggtttaggcctcaaagttggtggaaccatgcagcagcagcagcagccacatcagcagcagttgcagcagccacatcagagactgcctccaactatctttccaaaacaagcgaatgtaacatttgcggcgcctgtaaatatggtcaacaggggtttatttgagactagcgcagatggtccagccaacagtaatatgggaggagcagggggtactgttacagctacttctcctgggacgagcagtgcagaaaacaatacttggtcatcaccagttccttacgtgtttggtcggggaagaagaagcaatacgggcctggagaaggttgttgagagaaggcaaaagagaatgatcaagaatcgggaatccgctgctagatcaagggctcgaaaacaggcttataccttggaattggaagctgagattgaaagtctcaagctagtgaatcaagatttgcagaagaaacaggctgaaataatgaaaacccataatagtgagctaaaggaattttcgaagcagcctccattgctggccaaaagacaatgcttgagaagaacccttaccggtccgtggtaagaaggtgaagtcaaagcaagaagaacctgctaatgtaatacaggaccactcaaaaggaagacactgggagagtaatatgtaatagaagatagtgctactgtacaggagaaattacagagacgcttacaatgtagaaatcttttgagctgaatttaactaagagtgcagtctgtgtagagtatgagagctttcaatatgaattcataattttcataa

SEQ ID NO: 352 - protein, 392 aa, Arabidopsis thaliana
MGTHIDINNLGGDTSRGNESKPLARQSSLYSLTFDELQSTLGEPGKDFGSMNMDELLKNIWTAEDTQAFMTTTSSVAAPGPSGFVPGGNGLQRQGSLTLPRTLSQKTVDEVWKYLNSKEGSNGNTGTDALERQQTLGEMTLEDFLLRAGVVKEDNTQQNENSSSGFYANNGAAGLEFGFGQPNQNSISFNGNNSSMIMNQAPGLGLKVGGTMQQQQQPHQQQLQQPHQRLPPTIFPKQANVTFAAPVNMVNRGLFETSADGPANSNMGGAGGTVTATSPGTSSAENNTWSSPVPYVFGRGRRSNTGLEKVVERRQKRMIKNRESAARSRARKQAYTLELEAEIESLKLVNQDLQKKQAEIMKTHNSELKEFSKQPPLLAKRQCLRRTLTGPW

SEQ ID NO: 353 - DNA, 780 bp, Arabidopsis thaliana
atgcacaaggaaagagggaaaatgccggtttctagcaacagaaatagagtatcgccatacccgcttcgctcttgcaggaacaagaaacaaaaagaagtcgaggcgtcgtcgtcacctgttgagttagagagtgttagtgaatgggaggatgtgaggtgtgtgatttgtatggagcctcctcacaatgctgtcctcttgcaatgctcttctttctccaaaggatgtcgtgcttacatgtgtgatacaagcgctcgtcactccaattgtttcaagcagtaccgcagaagcaacagctcaagccgttgtagtggcaagactctacattgtccctactgcagaggagaggttcaggggactatgaagtcgacttgtgctcggagattcatgaatgctagaccgaggtgttgtactgttgacaagtgcgatttctcagggacctatgcgcagctgaaaaatcacttgaaaactgagcatcctggttttacaccgccaaagttagacccttgggagcaacacatgtgggagcagttggagagagaggcggagtacattgaaatgctcaacgctcgtcagagatgggatgcagaacagagattgttggcgacttctctccatcagcttccatatcgtcatcccatgattgatctcaactttgatgcgttggtgcataatctgtttcttggtgcgtccatggagagccgtgcaagcaccgacaattacccggctcacataccccgtctggagttccatgcccccatgtatcccagatggacgccatga

SEQ ID NO: 354 - protein, 259 aa, Arabidopsis thaliana
MHKERGKMPVSSNRNRVSPYPLRSCRNKKQKEVEASSSPVELESVSEWEDVRCVICMEPPHNAVLLQCSSFSKGCRAYMCDTSARHSNCFKQYRRSNSSSRCSGKTLHCPYCRGEVQGTMKSTCARRFMNARPRCCTVDKCDFSGTYAQLKNHLKTEHPGFTPPKLDPWEQHMWEQLEREAEYIEMLNARQRWDAEQRLLATSLHQLPYRHPMIDLNFDALVHNLFLGASMESRASTDNYPAHIPRLEFHAPMYPRWTP

SEQ ID NO: 355 - DNA, 1119 bp, Arabidopsis thaliana
gttctttctctatatccttcaatcaatgtgaaaaaaaagctctcccttttggcagtttccgatgtttggtcgccattcgattatcccaaataaccagattggtaccgcctctgcttccgctggtgaagaccatgtctctgcctccgctacgtctggtcacattccttacgacgatatggaagaaatccctcatcctgactctatctatggtgctgcctccgatttgattcccgatggctctcaattggttgctcaccgatccgatggctctgaattacttgtttctcggccaccggaaggggcgaatcagcttacgatctcgttccgtggacaagtttacgtttttgatgccgttggtgctgacaaggtggatgctgtgttgtcgctgttgggtggttctactgagcttgctcctggtccgcaggtgatggaactagctcaacagcagaatcatatgcctgttgtagaatatcagagccgctgtagccttccgcaacgggcacaatccttggataggtttcggaagaagaggaatgctagatgtttcgagaagaaagtaagatacggtgttcgccaagaagttgccttaagaatggcacgtaataaaggtcaattcacctcttcaaagatgacagatggggcttataactctggcacagatcaagattctgcccaagatgatgcccatccagaaatatcgtgtactcattgcggcattagttccaaatgtacaccaatgatgcgacgtggcccttccggccccaggactctctgcaatgcctgtggacttttttgggctaacaggggtacattgagggatctctcaaagaaaacagaagagaatcagttggctttaatgaaaccggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatctcag

SEQ ID NO: 356 - protein, 309 aa, Arabidopsis thaliana
MFGRHSIIPNNQIGTASASAGEDHVSASATSGHIPYDDMEEIPHPDSIYGAASDLIPDGSQLVAHRSDGSELLVSRPPEGANQLTISFRGQVYVFDAVGADKVDAVLSLLGGSTELAPGPQVMELAQQQNHMPVVEYQSRCSLPQRAQSLDRFRKKRNARCFEKKVRYGVRQEVALRMARNKGQFTSSKMTDGAYNSGTDQDSAQDDAHPEISCTHCGISSKCTPMMRRGPSGPRTLCNACGLFWANRGTLRDLSKKTEENQLALMKPDDGGSVADAANNLNTEAASVEEHTSMVSLANGDNSNLLGDH

SEQ ID NO: 357 - DNA, 1126 bp, Arabidopsis thaliana
cctcttcttttatgttcatcgccgtcgaagtttctccggtaatggaagacatcacacggcagagcaaaaaaacttcggttgagaatgaaaccggcgatgatcagtcagcaacatcagtagtccttaaagctaaacgcaaacgccgatcgcaaccacgagacgctccaccccaacgtagctccgtccatagaggcgtcacaaggcatcgatggactggaaggtacgaagcacatttgtgggataagaatagttggaacgaaactcagaccaagaaaggaagacaagtatatttaggggcatatgacgaggaagatgcagcagcacgtgcctacgacttagcagcattgaaatattggggacgagacaccatcttgaacttccctgtaaattttctcggaatcctattgtgtaattatgaagaagacatcaaagaaatggaaagccagtcaaaggaagagtatattggatctttgagaagaaaaagtagtgggttttcacgaggtgtatcaaaatacagaggcgttgcaaagcatcaccacaatgggagatgggaagctcgaatcggaagagtgtttggcaataaatatttataccttggaacttacgcgacgcaagaagaagcagctatagcgtacgatatcgcagctatcgagtaccgtggactcaacgccgttactaacttcgacatcagccgttatctgaaactcccggtgccggagaaccctatcgataccgcgaataatctcctcgagagtccgcattctgatcttagcccatttataaaacctaaccacgagtctgacttatcacagagtcaatcttcgtcagaggacaacgatgatcggaaaacaaagctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaa

SEQ ID NO: 358 - protein, 352 aa, Arabidopsis thaliana
MFIAVEVSPVMEDITRQSKKTSVENETGDDQSATSVVLKAKRKRRSQPRDAPPQRSSVHRGVTRHRWTGRYEAHLWDKNSWNETQTKKGRQVYLGAYDEEDAAARAYDLAALKYWGRDTILNFPVNFLGILLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYLKLPVPENPIDTANNLLESPHSDLSPFIKPNHESDLSQSQSSSEDNDDRKTKLLKSSPLVAEEVIGPSTPPEIAPPRRSFPEDIQTYFGCQNSGKLTAEEDDVIFGDLDSFLTPDFYSELNDC

SEQ ID NO: 359 - DNA, 1428 bp, Arabidopsis thaliana
gtattggttttgaacaggggatgggaagggttaagttgaagattaaaagacttgagagcacaagcaacaggcaagttacatacacgaagagaaaaaatgggattttgaagaaagccaaagagttatcgattttgtgtgatattgatattgtccttcttatgttttcccctaccggaagagctactgctttccatggagaacacagttgcattgaagaggttatttccaagtttgcgcaattaactccacaagaaaggacaaaaaggaaactggagagccttgaagcattgaagaaaacttttaagaaactggatcatgatgtaaatatacatgactttttaggagcaaggaatcaaactattgagggtctaagtaaccaagtagccatttaccaagctcagctaatggagtgtcataggaggttgagttgttggacgaacatcgatagaatagaaaacactgagcacctcgatttattggaagaatcattgaggaaatccattgaaagaatccagattcacaaggaacattacagaaagaaccaactcttgccaatagaatgtgcaacaacacagtttcacagcgggatacagttgcctatggcgatgggaggtaatagtagtatgcaagaagctcactccatgtcttggcttcctgataatgatcaccagcaaacaatcttacctggtgattccagttttcttccccatagagagatggatggttcgattcccgtttactcaagctgcttctttgagtctacgaaaccagaagatcagatatgcagcaacccgggacaacagtttgagcagttagaacaacaaggaaacggttgtttggggttacaacaacttggagaggaatattcatatcctacaccgtttggtactactttgggaatggaagaagatcaagagaaaaagataaaatctgaaatggaattgaacaacttgcaacaacagcaacagcaacaacaacaacaacaacaacaagatccttcaatgtatgatcccatggctaataataatggtggctgctttcagattcctcatgatcagtccatgtttgtcaatgatcatcatcatcatcatcaccaccatcatcaaaattgggttccagattcaatgtttggtcagacttcttacaaccagcaaccgaactaactcaagacatggctcatgtatgtatgatgactggacttatgtctgaccaaggactagtttgagccattgcctacaatgtctaagataaatatatatatgtagacagcgagagagtgtgtgtacatgtttttgtatgtgtgagcttgtgtcatatactcaggggagttttaggcatttgtgtataagagatgttgtctaggaaccgtatattacctttaacaagaatgataagtatatcaatatattaatgtttttaaaaaaaaaa

SEQ ID NO: 360 - protein, 380 aa, Arabidopsis thaliana
MGRVKLKIKRLESTSNRQVTYTKRKNGILKKAKELSILCDIDIVLLMFSPTGRATAFHGEHSCIEEVISKFAQLTPQERTKRKLESLEALKKTFKKLDHDVNIHDFLGARNQTIEGLSNQVAIYQAQLMECHRRLSCWTNIDRIENTEHLDLLEESLRKSIERIQIHKEHYRKNQLLPIECATTQFHSGIQLPMAMGGNSSMQEAHSMSWLPDNDHQQTILPGDSSFLPHREMDGSIPVYSSCFFESTKPEDQICSNPGQQFEQLEQQGNGCLGLQQLGEEYSYPTPFGTTLGMEEDQEKKIKSEMELNNLQQQQQQQQQQQQQDPSMYDPMANNNGGCFQIPHDQSMFVNDHHHHHHHHHQNWVPDSMFGQTSYNQQPN

SEQ ID NO: 361 - DNA, 964 bp, Arabidopsis thaliana
atttgatactagacatacaaattcctttttattgttgtcattaccatgacgaggaagaagctaaacctatcttacatcaccaatgagtcaatgagaaaagcaacattcaataagagaaagaaagggcttgtgaaaaaaatccacgagctttccgttctctgcggaatcgaagcatgtgcagtgatttatagtccgttcaactcaaaccctgaagtctggccatcgaattcagaagttaaaaatgtaatggaaaattttgagatgttgacaaagttggagcaagagaagaaaatggtgagccacgaaggttttatcagacaaaacatctcaaaaactatggagagtaacaacaaaaagatgatcgataatgcggagaggacgatgaaagaagccatgttccaacttcttagtggaaaaggggagaagcttaatttgactgatagaaaccgtgaagatttgtgtaagtacattgatcaatatcttaaagaactttatcaccacaaaaacaaaaccataaatcaatcacatattgaacctggagaatcttcgggagctacaaatgccatgacaccaacatctgttgttgaagtgagttcttattcctttccaattatctcgatgttttcaactctccttgactaatcaatgatttctcgtctttgaagcctattatctcttcaatccagcgaccaaatcaggttaatatcttctccagtaattttctatctagtgatgctgaccagtaaagttattctctagtgataaatccatttggtgtttatgatcagaatccaaattttaatcatcttagtcataatcaatatcaatatcaacaacagtttggatatccgattttggttcaagatggaatttacaatccgagtcaaattcagaatcaacatgaggaatggctggatgatcatatgatgaatcattctaaggaaataagtcatcctttgatgga

SEQ ID NO: 362 - protein, 198 aa, Arabidopsis thaliana
MTRKKLNLSYITNESMRKATFNKRKKGLVKKIHELSVLCGIEACAVIYSPFNSNPEVWPSNSEVKNVMENFEMLTKLEQEKKMVSHEGFIRQNISKTMESNNKKMIDNAERTMKEAMFQLLSGKGEKLNLTDRNREDLCKYIDQYLKELYHHKNKTINQSHIEPGESSGATNAMTPTSVVEVSSYSFPIISMFSTLLD

SEQ ID NO: 363 - DNA, 902 bp, Arabidopsis thaliana
actcatttcctcatcttttggtctttctcttttcattcttagaaaaagaaaatttgaaaaaaagataaaaagaaaaagaaaagtaaatctaaaaagttattaggaaaaacccccatcaatattctactaatgtctgaccaaaatagcctcatgtgtgtattctctcgtccataaatatggacctccaacaatgcaattcttcccttttccccttctaatctctctcgcatctctacattttgagatcattttaaattgtcctctcttttattttccggttaagcaccatgatgtctactatttccccggttttctcaaccgaaccgggtctattaacctctgtcctcccagcttttgaaaccagtttcactccatgggacatttcacacctcttctcggtcttcgattcattaatcgatccaaaaccggtttcgacccatgactatggttcagtaaaccagatcggttcagacatgtctccgaccgacaataccgacgagcggaaaaagaaacggaaattatcgaaccgggaatcggctaagcggtcaagagagaagaaacaaaagcacttggaggagatgagtatccagctaaaccaactcaaaattcagaaccaagaattgaagaaccagcttcggtacgttttataccattgtcaacgaacgaagatggaaaatgatcgtctacttatggagcaccgtatactgcatgataagttgttgaacatcagacaagttttgatgtttcgtcaaacctaacgaagctcatcaaactgtgccacttggccttgtaataacagtactgttgttacggtccagcaagatccgtcgatcatgttatcataagttgaggtttctgaaattgtttcgacggtaaaatgggaacaatttgtaaaaacaatt

SEQ ID NO: 364 - protein, 156 aa, Arabidopsis thaliana
MMSTISPVFSTEPGLLTSVLPAFETSFTPWDISHLFSVFDSLIDPKPVSTHDYGSVNQIGSDMSPTDNTDERKKKRKLSNRESAKRSREKKQKHLEEMSIQLNQLKIQNQELKNQLRYVLYHCQRTKMENDRLLMEHRILHDKLLNIRQVLMFRQT

SEQ ID NO: 365 - DNA, 1071 bp, Arabidopsis thaliana
tcgacggcaaaagttgaaaataaaacaataaacagtcgaaattctccggcgaagatgagaaccggaaaaggaaatcaagaggaagaagattacggagaagaagactttaactctaaacgtgaaggtccttcttccaacactactgttcatagcaacagagattcaaaggaaaatgataaagctagtgcgatacgttctaaacattcggtcactgagcaacgtagaagaagcaaaatcaatgaaagatttcagatattgagagaactaattcccaacagtgaacaaaaacgtgacactgcttcattccttttagaggtgatagattatgttcagtatttacaagagaaggtgcaaaagtatgaaggatcgtatccaggttggagtcaggaaccaacaaagttgacgccatggaggaataatcattggcgagttcaaagtttggggaaccacccagtagctataaataatggatctggtccagggataccttttcctggaaagtttgaagacaacactgtgacttcgacacctgcaattattgcagaaccgcaaatcccgattgaatctgacaaagcaagagctataaccggcatatcgattgaaagtcaacctgagttagacgacaaaggattaccaccactacaaccaattcttccaatggtacaaggcgaacaagctaatgaatgtcctgcaactagtgatgggctaggccaaagtaatgacctggttattgaaggtggaaccattagcatctctagtgcctactcgcatgagttattgagctcattaacacaagcactccagaatgcaggcattgatctgtcgcaagcaaagctttctgtgcagatcgatcttgggaagcgagccaatcaaggtctaactcatgaagagccatcaagtaagaatccattatcatatgatacgcaaggaagggattcaagcgttgaggaagaatctgaacattctcacaagcggatgaaaacactgtgacatttctctctcaggctccacggcgctggaatatataaatgtattgacagattccttgtatcgtgtacattgttcggcttc

SEQ ID NO: 366 - protein, 311 aa, Arabidopsis thaliana
MRTGKGNQEEEDYGEEDFNSKREGPSSNTTVHSNRDSKENDKASAIRSKHSVTEQRRRSKINERFQILRELIPNSEQKRDTASFLLEVIDYVQYLQEKVQKYEGSYPGWSQEPTKLTPWRNNHWRVQSLGNHPVAINNGSGPGIPFPGKFEDNTVTSTPAIIAEPQIPIESDKARAITGISIESQPELDDKGLPPLQPILPMVQGEQANECPATSDGLGQSNDLVIEGGTISISSAYSHELLSSLTQALQNAGIDLSQAKLSVQIDLGKRANQGLTHEEPSSKNPLSYDTQGRDSSVEEESEHSHKRMKTL

SEQ ID NO: 367 - DNA, 958 bp, Arabidopsis thaliana
attagatatcccctccaattactcaaaattattatcaaaataagaaagagctcaacattgttctctgactctataaataactgttcttggaaattttccaagagaacaagaaacaaaaacaaaacgttgtttaagtgtggttctatagatttcttgtgaatgtcttctgaacaaggaaatggatcgaatccttccacgtcaccggaggtagaagggactaaaacaatcccctttcgccggagattgcaaagaggacaaagagttttcgctccaaagctgatggaggctctacgtcgatcaagggtaagctctgaagaagctccggtaaggcatcttagtcgtagatggagagccacaacggcgcagaaggtatattccctaaagctctacgacgctcttcaacgatcgcggcggagcgcaacagtccgggacacggccgacaaagtccttgcgacgaccgctcgtggtgcaactcggtggagccgagccattttggttagtcgattcggaacgagtctgaggcggcgtaggaataccaaaccggcgtcggcattagctgcggcgatcaggggaagtggtggaagtgggaggaggaggaagttatcggcggtgggaaatcgggtccgggttttgggtgggttggtgccgggttgccggagaacggcgttaccggagcttttggacgagacagcagattacatagcggctttggaaatgcaagtccgagccatgacagctctatcaaagattctgtcggagcttcagccgtctactaatctcggctcggctttatagccgagtgtataagccgatgaatttgtttcaattaattcttttacgattttatcgtgggaatgtcttattgtttttaatgatttgtttgccctggaaaaaaaaaattgtcaaaatcatcacgagttggacgaaaatactatgtttttctaaaaaccttataata

SEQ ID NO: 368 - protein, 211 aa, Arabidopsis thaliana
MSSEQGNGSNPSTSPEVEGTKTIPFRRRLQRGQRVFAPKLMEALRRSRVSSEEAPVRHLSRRWRATTAQKVYSLKLYDALQRSRRSATVRDTADKVLATTARGATRWSRAILVSRFGTSLRRRRNTKPASALAAAIRGSGGSGRRRKLSAVGNRVRVLGGLVPGCRRTALPELLDETADYIAALEMQVRAMTALSKILSELQPSTNLGSAL

SEQ ID NO: 369 - DNA, 1674 bp, Arabidopsis thaliana
atggcggattcttcacccgattcgtgtttcaaaggaggcaaatttagtgctccagggtttcgatttcatccaactgatgaagagcttgtgatgtattatttgaagaggaagatttgtaggaagaggcttagagttaatgttatcggtgttgttgatgtttacaaaatggatcctgaggaattgcctggtcaatcaatgttgaagacgggagatagacagtggttctatttcactccaaggagtaggaagtatccaaacgcagctaggtctaatagaggaactgaaaatgggtattggaaggctacagggaaggatcgagtcattgagtataattctagatcggtgggacttaaaaagactcttgttttctatagaggccgggctcctagtggtgagcggactgattgggtgatgcatgagtatacgatggatgaagatgaactagggagatgtaagaaccctcaggagtactatgctctttataagttgttcaagaaaagtggggctggtcctaagaatggtgaacagtatggtgctccgtttcaagaagaggaatgggttgatgatgataatgaagatgtgaatgctattgctgtagctgtgccagagcaacctgtggttcgttatgaggatgctcgtcgtgtggatgagaggagactttttaatcctgttattcttcagttagaggatatcgatgagcttctcaatggaatccctaatgcacctggtgttcctcaaagatgtattcctcaggtgaatagtgaagaagagctgcagagtacgttggtgaataattctgctagagagttcttgccaaacggtcagcaatacaacaggccctcaagttttgactcattagagaccgctgaggtcacctcagctcctctggtgtttgagaaggaagatttcattgaaatggatgatcttcttctgatccctgaattcggagcttcttcaactgagaaagccgcacagttctcgaaccatggtgaattcgacgattttaatgagtttgaccaattgttccatgacgtttccatgtctttggatatggaacctattgatcagggaacttctgcaaatctgtcttctctgagtgattctgctaactacacatcagaccaaaaacagcaactcctttatcaacagttccaggaccagactcccgagaaccagctgaacaacatcatggatcctagtacaactctcaatcaaatcactagcgatatttggttcgaggatgatcaggccattctatttgatcaacaacaatccttttctggagcatttgcttcaccctcatcaggtgtgatgcctgattccaccaatcctactatgagtgtgaatgcccaaggccatgaaatccaaaatggtggtggaacaacaagccagttctcatcggctttgtgggcattaatggactcaataccttcaacgccagcctctgcgtgtgagggtccccttaaccgaacctttgtacgtatgtctagcttcagccgtatgaggttcaatggaaaggctaatggaacgccagtgagtactaccatagcaaagaagggtattagaaacagaggttttcttctattatcaatcgtgggtgctttgtgtgccatcttctgggtgttggtagccacagttcgagtctcaggtagaagtcttctcttgaaagactag

SEQ ID NO: 370 - protein, 557 aa, Arabidopsis thaliana
MADSSPDSCFKGGKFSAPGFRFHPTDEELVMYYLKRKICRKRLRVNVIGVVDVYKMDPEELPGQSMLKTGDRQWFYFTPRSRKYPNAARSNRGTENGYWKATGKDRVIEYNSRSVGLKKTLVFYRGRAPSGERTDWVMHEYTMDEDELGRCKNPQEYYALYKLFKKSGAGPKNGEQYGAPFQEEEWVDDDNEDVNAIAVAVPEQPVVRYEDARRVDERRLFNPVILQLEDIDELLNGIPNAPGVPQRCIPQVNSEEELQSTLVNNSAREFLPNGQQYNRPSSFDSLETAEVTSAPLVFEKEDFIEMDDLLLIPEFGASSTEKAAQFSNHGEFDDFNEFDQLFHDVSMSLDMEPIDQGTSANLSSLSDSANYTSDQKQQLLYQQFQDQTPENQLNNIMDPSTTLNQITSDIWFEDDQAILFDQQQSFSGAFASPSSGVMPDSTNPTMSVNAQGHEIQNGGGTTSQFSSALWALMDSIPSTPASACEGPLNRTFVRMSSFSRMRFNGKANGTPVSTTIAKKGIRNRGFLLLSIVGALCAIFWVLVATVRVSGRSLLLKD

SEQ ID NO: 371 - DNA, 2959 bp, Arabidopsis thaliana
caaaattcatagtaaggtctcgccatgtcccgatgcataaatgagataacgatccacaaaattttcattttaaaaatttcatctttttttgttttcatcttccgtgaagaagtagtaccacataacccccatcagacatctttaaagctttcttcttttccttgtttcttttggttttgagatttgggtttcttttcatatctgttccttctatctcagacaacaaattgcaacagaggaaatttaaaaacccacttgaggaaggaatctttgagaatctctctctgacttatgttgcttcattgattttggagatatatccatggaagatagtttccttcaatctgagaacgtggttatggacgctgacttcatggatggattgttactagatggttgttggttagagactacagatggatctgagtttcttaacatagctccttcaacttcttctgttagcccttttgatccaacttccttcatgtggtctccaactcaagatacatcagctctttgcacatcaggagttgtatctcagatgtatggtcaggattgtgtagaaagatctagtcttgatgagtttcaatggaacaaacgatggtggattggaccaggaggtggtggttcttcggttactgagaggttggttcaagcagttgaacacattaaagattacacaacagcgagaggctcacttattcagttatgggttccggttaatagaggcggtaagcgagttttgaccacaaaggaacaaccttttagccatgatccgttgtgtcaaagacttgcaaactatagagagatctctgtgaattatcacttctctgctgagcaagatgattccaaggctttagctggtttgcctgggagggttttcttggggaagcttcctgaatggactcctgatgttaggtttttcaagagcgaggagtatccgagagtacaccatgctcaggactgcgatgtccgtggaacgctggcgattccggtgtttgaacaaggtagtaagatttgcttgggtgttattgaggttgtaatgaccactgagatggttaaactaagacctgagcttgaaagcatttgcagagcacttcaggcagttgatcttaggagcaccgagcttccgattccaccttctctaaagggatgtgacttatcctacaaagctgccttacctgaaatccgaaacctcttgagatgtgcttgtgagactcataaactacctttagctcagacatgggtttcttgtcaacagcaaaacaaaagcgggtgccgtcacaacgatgagaactacatccattgcgtatcaaccattgatgatgcttgctacgttggtgatccaacagttcgtgagttccatgaagcttgctctgagcatcacctcttgaaaggccaaggagttgcaggtcaagccttcttgaccaatggaccttgcttttcatctgatgtatctaactacaagaaatcagagtaccctctctctcaccatgctaatatgtacggtttacatggcgcggttgcaattcgcctgcggtgcatccacacgggctctgctgatttcgtcttagagttctttttgcctaaagactgcgatgatctggaggaacagaggaaaatgttgaatgctctttcaactattatggctcatgtgcctagaagcttaaggactgttacagacaaagaactagaagaagagagtgaagtgatagagagggaagagatagtaacgccaaagatagaaaacgcatctgaactccacggaaattccccatggaatgcctctcttgaagaaatccagcggagtaataatactagtaatcctcagaatcttggactggtatttgatggaggagacaaaccaaatgatggttttggcttaaaaagaggttttgactacaccatggattctaatgtcaatgagagcagcactttctctagtggtggtttcagtatgatggccgagaaaaagcgtacaaaagcagataaaaccatcactttggatgttcttcgacagtatttcgctgggagcttgaaagatgcagccaagaatatcggtgtttgtccaacgaccttgaagagaatatgcagacagcatggtatacaaagatggccttcaagaaagataaaaaaagtgggacattctctgcagaagatccaacgagtgattgattcggttcaaggtgtttctggtcctcttcccataggctcattctatgcaaatttccccaatttagtctcacagtcacaagaaccatcacaacaagccaagaccacgcctcctcctccgccgccagtgcagcttgcaaagtcccctgtatcctcgtatagtcacagttcaaactctagccaatgttgctccagtgaaacccaactaaacagcggtgcaacaaccgatcctccttcaactgatgtaggaggtgcattgaagaagacgagcagcgaaatcgagcttcaaagctcgagtcttgacgagacaattttgactctctccagtttagaaaacatccctcaaggcaccaacttgttatcatctcaagatgatgactttctgaggattaaagttagctacggagaagagaagatcagattacggatgcggaattcgcgcaggttaagagatctattgtgggagattgggaagcggtttagcatagaggatatgagcaggtatgatctaaagtacttagacgaagacaatgaatgggttttgttgacttgcgacgaagatgtagaagagtgtgtagatgtctgcagaactacaccgagtcataccattaagcttttgcttcaggcttcttctcatcatttccctgaacgttcttcagctactgaatacagtttatggcactgaccttaaatcagagaaagaagaaagaaaaagaagcgttttaggacatgacacaaaagatagtaatacctttgtgttctgttataattgttcataattttatct

SEQ ID NO: 372 - protein, 844 aa, Arabidopsis thaliana
MEDSFLQSENVVMDADFMDGLLLDGCWLETTDGSEFLNIAPSTSSVSPFDPTSFMWSPTQDTSALCTSGVVSQMYGQDCVERSSLDEFQWNKRWWIGPGGGGSSVTERLVQAVEHIKDYTTARGSLIQLWVPVNRGGKRVLTTKEQPFSHDPLCQRLANYREISVNYHFSAEQDDSKALAGLPGRVFLGKLPEWTPDVRFFKSEEYPRVHHAQDCDVRGTLAIPVFEQGSKICLGVIEVVMTTEMVKLRPELESICRALQAVDLRSTELPIPPSLKGCDLSYKAALPEIRNLLRCACETHKLPLAQTWVSCQQQNKSGCRHNDENYIHCVSTIDDACYVGDPTVREFHEACSEHHLLKGQGVAGQAFLTNGPCFSSDVSNYKKSEYPLSHHANMYGLHGAVAIRLRCIHTGSADFVLEFFLPKDCDDLEEQRKMLNALSTIMAHVPRSLRTVTDKELEEESEVIEREEIVTPKIENASELHGNSPWNASLEEIQRSNNTSNPQNLGLVFDGGDKPNDGFGLKRGFDYTMDSNVNESSTFSSGGFSMMAEKKRTKADKTITLDVLRQYFAGSLKDAAKNIGVCPTTLKRICRQHGIQRWPSRKIKKVGHSLQKIQRVIDSVQGVSGPLPIGSFYANFPNLVSQSQEPSQQAKTTPPPPPPVQLAKSPVSSYSHSSNSSQCCSSETQLNSGATTDPPSTDVGGALKKTSSEIELQSSSLDETILTLSSLENIPQGTNLLSSQDDDFLRIKVSYGEEKIRLRMRNSRRLRDLLWEIGKRFSIEDMSRYDLKYLDEDNEWVLLTCDEDVEECVDVCRTTPSHTIKLLLQASSHHFPERSSATEYSLWH

SEQ ID NO: 373 - DNA, 771 bp, Arabidopsis thaliana
atgagttcgtcaaaacattcctctgtttttaactattctgctctgtttctatcactgtttcttcaacaaatggatcagaactctcttcatcatctcgattctccaaaaatcgaaaacgagtatgaaccagattcgttatacgacatgttagataagttgcctccgcttgattctctcctagatatggaagatttgaaaccaaatgcagggttgcactttcagttccattacaatagctttgaagatttcttcgaaaacattgaagtggataacacaattccatctgatattcacttgttgacacaagagccctacttctcaagtgactcctcttcctcttcaccattggctatccaaaacgacggtctcatttccaacgtgaaagttgaaaaggtaacagttaagaagaagaggaaccttaagaaaaagaggcaagacaaattggagatgtctgagatcaaacaatttttcgataggccgatcatgaaagcggctaaagaactgaacgtgggactcactgtgttgaagaagcgatgcagggaattaggaatttaccggtggcctcaccggaagctcaagagtctaaactctcttataaagaatctcaagaatgttggaatggaagaggaagtgaagaacttggaggaacataggtttcttattgaacaagaacctgatgcagaactcagtgatggaaccaagaagctaaggcaagcttgtttcaaagccaattataagagaagaaaatcacttggtgatgattattattga

SEQ ID NO: 374 - protein, 256 aa, Arabidopsis thaliana
MSSSKHSSVFNYSALFLSLFLQQMDQNSLHHLDSPKIENEYEPDSLYDMLDKLPPLDSLLDMEDLKPNAGLHFQFHYNSFEDFFENIEVDNTIPSDIHLLTQEPYFSSDSSSSSPLAIQNDGLISNVKVEKVTVKKKRNLKKKRQDKLEMSEIKQFFDRPIMKAAKELNVGLTVLKKRCRELGIYRWPHRKLKSLNSLIKNLKNVGMEEEVKNLEEHRFLIEQEPDAELSDGTKKLRQACFKANYKRRKSLGDDYY

SEQ ID NO: 375 - DNA, 548 bp, Arabidopsis thaliana
agacaacatcatttctaccgacaaagatttgatatcgaatccaacaagtgaaagatgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtgactgct

SEQ ID NO: 376 - protein, 162 aa, Arabidopsis thaliana
MGLSSLPGPSEGMLCVILVNTALSISIVKGIVRSFLGIVGISLSPSSSSPSSVTVSSENSSTSESFDFRVCQPESYLEEFRNRTPTLRFESLCRCKKQADNECSVCLSKFQGDSEINKLKCGHLFHKTCLEKWIDYWNITCPLCRTPLVVVPEDHQLSSNVW

SEQ ID NO: 377 - DNA, 1310 bp, Arabidopsis thaliana
aacctctctgtcattactctggtcagcgattcttctttcttcttcttctcagatcctttcaccgagtaagaagattttaaagatgccgtcaacgccgacgacgccgactacaacaacgccgatcacggcttcgtattggtgttacagctgtacgcgtttcgtcagcgtttgggctgatcaaggcacaacaaccgtcggtagcgtcgcttgccctcactgcgacggcggttttatcgaacagattaacgattcttcctccgccgctaccgaattaacgattccggcttctactgaagtaagatcgatcaataacaaccgtagatccgtgattagacgccggagatccggtcgtcgtccgtcctttaatccggtcatcgtacttcaaggaggcgccggcgagagagaagagggagaagaaggagatgcggctagagatcgacgcgcttttgagttttattacgatgacggatccggatcgggtcttagaccgcttccggattctgtatctgagatcttgatgggatctggattcgagcggttacttgaacagctaagccaaatcgaagcgtcggctactggaattggtagatctggaaaccctccggcgtctaaatcggcgattgagtctttacctagagtcgaaatctcggattgccacataggctcggaggctaattgcgctgtttgcacggagattttcgagacggagacggaggcgcgtgagatgccgtgtaaacaccttttccacgacgattgcatcgtaccgtggctatcgattcgaaactcttgtcccgtgtgcagattcgagctaccttcagagcctaatcgacggagcaacaacaacgaggaggataacgccgtggggatgacgatttggagacttcccggtggtggattcgccgtagggaggtttaacgcagcaatgagagacggagagagagttttgccagtggtgttaacagaaatggatggtggtgggattggtaatagccaggatggtcctagacggatctcatgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattgattca

SEQ ID NO: 378 - protein, 407 aa, Arabidopsis thaliana
MPSTPTTPTTTTPITASYWCYSCTRFVSVWADQGTTTVGSVACPHCDGGFIEQINDSSSAATELTIPASTEVRSINNNRRSVIRRRRSGRRPSFNPVIVLQGGAGEREEGEEGDAARDRRAFEFYYDDGSGSGLRPLPDSVSEILMGSGFERLLEQLSQIEASATGIGRSGNPPASKSAIESLPRVEISDCHIGSEANCAVCTEIFETETEAREMPCKHLFHDDCIVPWLSIRNSCPVCRFELPSEPNRRSNNNEEDNAVGMTIWRLPGGGFAVGRFNAAMRDGERVLPVVLTEMDGGGIGNSQDGPRRISWVRSHGTLESDSNGTGSGSGSGGRLRRMVRGMVSLMRRVRPNRSSSSSSAAISTSSDNLDLNIEVESRVLDRSNSVMRRYFRRNRSNRDSSSSVLH

SEQ ID NO: 379 - DNA, 1228 bp, Arabidopsis thaliana
aactcaaaatcatgagaagctccgatcatatggcgtttgccggcgttttgccgattgttttcttgcttatattatcatcagcggatctagcagcgagtcaatcacagcccggtccaacaaatcaaccgtataactacggcagactaagtccagccatggcagtgatcgtcgtgatcctaatcgctgctctcttcttcatgggcttcttctctatctacttccgtcactgctcaggcgtaccagacgccggtgtttctccagctggtggagctagatccagagcaaccgtcaacgcggcggcgcgtggtctcgacgtttcagttgtcgagacttttcctacgttcttgtactcagatgtgaaaacgcagaagcttggtaaaggagagttagagtgtgcgatatgtttgaacgagttcgaagacgacgaaacgctgcgtttgcttcccaagtgtgatcacgtgtttcatccgcactgcatcgatgcttggctcgaggctcacgtgacttgtcccgtttgcagagcgaatcttgctgaacaggtagctgaaggtgagtcagttgaaccgggaggaactgaaccggatcttgaattgcagcaggttgtggtgaatcctgaaccggtggttactgcaccggtaccggaacaattggtgactagtgaagtcgattcgaggagattacctggtgtaccggtggatcttaaaagagttaaattctcgagatcgcatacgacgggacattcggtggttcaaccgggagaatgtaccgaacggtttactcttcggttaccggaagatgtgaggaagaggataatgaaggattggaaattgaaccggacgaatagtcttctggttcttcctagaggagggagttcgaggagaggtaaaccgattgaccggtcaagggctcggtctgatcgatggttgtttcgtaaaacgccttcgtttctgtggaggagtcgtgatgatggttcgattaggttaggtgctaccggtagcgttcgagccagtgctgtaccgaattcaaccggtagtgattcggtacgtgcaggagaccggtgggcttttcttagaaacgcgtcgtttttgtggaggaactcttcggtacatgtgccaagaggaggagtcaataaagacggcgaaggaacttcggttaaatcgaccggtgcaagtggctcaactagcggttcggtgagattaccggtttagttgacttttcttttctcatc

SEQ ID NO: 380 - protein, 398 aa, Arabidopsis thaliana
MRSSDHMAFAGVLPIVFLLILSSADLAASQSQPGPTNQPYNYGRLSPAMAVIVVILIAALFFMGFFSIYFRHCSGVPDAGVSPAGGARSRATVNAAARGLDVSVVETFPTFLYSDVKTQKLGKGELECAICLNEFEDDETLRLLPKCDHVFHPHCIDAWLEAHVTCPVCRANLAEQVAEGESVEPGGTEPDLELQQVVVNPEPVVTAPVPEQLVTSEVDSRRLPGVPVDLKRVKFSRSHTTGHSVVQPGECTERFTLRLPEDVRKRIMKDWKLNRTNSLLVLPRGGSSRRGKPIDRSRARSDRWLFRKTPSFLWRSRDDGSIRLGATGSVRASAVPNSTGSDSVRAGDRWAFLRNASFLWRNSSVHVPRGGVNKDGEGTSVKSTGASGSTSGSVRLPV

SEQ ID NO: 381 - DNA, 682 bp, Arabidopsis thaliana
ctcacccattctccaccttatcatcacaatccaaaactctctctctctctctctctctgtctcttgtcttatcatttatctctctaacggcgaggcaatgggttttccggtgggatattctgagctacttctcccaaaaatctttttctacttgttatctttcttaggtttgatacgtaaactcatctccacaatgttcaagatcattggtctaccagatttcttagaacctgaaccggtttcaacctcatggcccgacccaccacccacgttgaccaaacctgactcagcagcaatactagccggagagatgttaccggttgttcgattctcggatataaaccgaccggaatccgagtgttgcgcagtgtgtctctacgatttcgagaacgacgacgagatccgacggctgacgaattgtcgacatatatttcatcggggatgtttggaccgttggatgatgggttataatcagatgacgtgtccactttgtcgtacacagtttatacctgatcatcttcaactggagtttaatcaaaggctctggtctcaatcttctgctgtttcttctcaacttcttgatgaatcatcatcttaggacgtattaaatctttgtccaaacaaaaaaaaaagacatattaaatcctttttttttggtactttcattgggaattgggtttgg

SEQ ID NO: 382 - protein, 166 aa, Arabidopsis thaliana
MGFPVGYSELLLPKIFFYLLSFLGLIRKLISTMFKIIGLPDFLEPEPVSTSWPDPPPTLTKPDSAAILAGEMLPVVRFSDINRPESECCAVCLYDFENDDEIRRLTNCRHIFHRGCLDRWMMGYNQMTCPLCRTQFIPDHLQLEFNQRLWSQSSAVSSQLLDESSS

SEQ ID NO: 383 - DNA, 680 bp, Arabidopsis thaliana
ccacatggccctaacctctttcttcaccatcaaatgtcaaccgccaccctcgtcgtcttccctcctccacctcctgtccctatccctacctatataactagcctcggccttggctactccatagccatagctctaggtttcctcgttcttatctccacaatcattctctcttcttacatctgttgccgcgcctcacgcctccgcttctctgcctccgccgcaaacgcaaacgcaaacgcatcgtttagcgaccgtggcgttatcgtcccaagaatcatattcgtagctgaagacgacgatcttgagtctggaaacgtcgtcgttggaggtcttgatcattcagtcatcaactcttaccctaaattccatttcactaaagatatcaccgccgtagtaaacggtgatgggtttcacgacggagaaggaagagagacgacgtgttcgatctgtttatgtgagtacatggaagaagagatgttaaggatgatgcctgagtgtaaacactacttccatgtttattgtcttgacgcttggcttaagctcaatggttcttgtcccgtttgtcggaattctccacttccgacgccgcaatctacgccgcagtcaactcctttgtcggaagttgtgccgttgtctcaatacgccgccgatcggaggagatccagaagataaaacatttc

SEQ ID NO: 384 - protein, 212 aa, Arabidopsis thaliana
MSTATLVVFPPPPPVPIPTYITSLGLGYSIAIALGFLVLISTIILSSYICCRASRLRFSASAANANANASFSDRGVIVPRIIFVAEDDDLESGNVVVGGLDHSVINSYPKFHFTKDITAVVNGDGFHDGEGRETTCSICLCEYMEEEMLRMMPECKHYFHVYCLDAWLKLNGSCPVCRNSPLPTPQSTPQSTPLSEVVPLSQYAADRRRSRR

SEQ ID NO: 385 - DNA, 1013 bp, Arabidopsis thaliana
ttttcactatactgtcagctccaaaacatacctgaataagtgaatatacattaaaacctaatctatcatcatatccatctctttccctctctgcatttagagatatggatgcatccccaaagtacacaggtgtacggaagaggaagtggggaaaatgggtggctgagattcgtctccccaacagccgtgacaggatctggttaggctctttcgactctgctgagaaggcggcgcgtgctttcgacgcggctctttactgtcttcgtggccccggagcacgcttcaacttccccgacaatcctccggagattcccggtggtcgttctctgacgccgcagcagattcaggtcgtagctagccgtttcgcctgcgaggaggagctactaccaccggaacaacatcatccgtcaccgccacgtggcgaccataataccgaggaagaagtgataatttcggcacgtggggaaattaatagtggtagtggtgggcctacgttagggcaagttggggaagataataacaacgagggtaatagtaatgacacgtcgtcgtattggcctttaatatgggaggaggagaattttgtaggtcctcctaactcagatcatgagttcggttttttcacagatgattcaaccaatttgtacttcccgacacaacaacaacaacaacatcagctctcgtctgatttttactatgatggagcttgtgaagatgatttctctcattacaatattaacctttggaatttctgagatccatttttttggtgatcttggaccaaatattcctatattgattaattcaatttgtggatttcgaattcgagatttcaaatgatcttgaaccagaattttcaccacccactagtagtgtgaatcatttgtttgaactttgaagcgaatcctatatgccacaatgtaagcaagcctgagtaatagcttcactacttaattatcttattcttcttcttctttttggttattaaaaccaatctgtttcatatgattttt

SEQ ID NO: 386 - protein, 216 aa, Arabidopsis thaliana
MDASPKYTGVRKRKWGKWVAEIRLPNSRDRIWLGSFDSAEKAARAFDAALYCLRGPGARFNFPDNPPEIPGGRSLTPQQIQVVASRFACEEELLPPEQHHPSPPRGDHNTEEEVIISARGEINSGSGGPTLGQVGEDNNNEGNSNDTSSYWPLIWEEENFVGPPNSDHEFGFFTDDSTNLYFPTQQQQQHQLSSDFYYDGACEDDFSHYNINLWNF

SEQ ID NO: 387 - DNA, 864 bp, Arabidopsis thaliana
atgggaaaccagaaactaaagtggacggcggaggaagaggaggcgttactcgccggaatcagaaagcacggtcctggaaagtggaagaatattctccgggatccagaattcgctgatcagctcatccatcgctccaacattgacctaaaggataagtggcgtaacttgagtgttccccctggtactcaaagtttaactaataaggcacggccagcaaaagtcaaagaggaaggcgacactccggctgcagatgcaaatgatgctgtcactattccacggcctattcctactattccacctcctcccggtcggcgtactttaccttctgagttgatccctgatgaaaatacaaagaatgctcctaggtatgacggggtgatatttgaagctctctctgctttagccgatggtaatggatctgatgtcagttccatttatcatttcattgagcccaggcatgaagtaccgccaaattttagaagaatccttagtacaagactgaggaggcttgcagctcagagcaaacttgaaaaggttagcaccttcaaatctatacagaacttctataagatacccgatccatcaggaacaaaaataggtgtcccaaaaccaaaggagacacatacgaagctgcgccaagcaaacaatcagacctctgctgattcacaacagatgatcgaggaagctgcaataaccgcagcctgtaaagtcgtagaggcggagaataaaatagacgttgccaaactagcagcagaagagtttgagaagatgacaaagattgcagaagaaaatagaaaactcctggtcatagctactgagatgcatgaactatgttcctgtggggagactatgctcttggcttga

SEQ ID NO: 388 - protein, 287 aa, Arabidopsis thaliana
MGNQKLKWTAEEEEALLAGIRKHGPGKWKNILRDPEFADQLIHRSNIDLKDKWRNLSVPPGTQSLTNKARPAKVKEEGDTPAADANDAVTIPRPIPTIPPPPGRRTLPSELIPDENTKNAPRYDGVIFEALSALADGNGSDVSSIYHFIEPRHEVPPNFRRILSTRLRRLAAQSKLEKVSTFKSIQNFYKIPDPSGTKIGVPKPKETHTKLRQANNQTSADSQQMIEEAAITAACKVVEAENKIDVAKLAAEEFEKMTKIAEENRKLLVIATEMHELCSCGETMLLA

SEQ ID NO: 389 - DNA, 1414 bp, Arabidopsis thaliana
aaaaaaaaaaggaagcagaagaagattcttattttatctttacactgttcagaaatcttcggtggacggataacttgcagagttctgattgaggctggttttgtgagaattatagttgcagcaagaaagcgtttcagatattttttaatggccgctgaggatcgaagtgaggaactaagcagcaatgtagaaaatggaagttgcaattccaatgaaggaattaatcctgaaaccagcagtcattggattgaaaacgttgtcaaggttaggaaaccgtacacagtaactaagcagagagagaagtggagtgaggaagagcatgataggtttcttgaagctatcaagctttatggtcgtggttggcgtcaaatccaagaacacataggtacaaaaaccgctgtacagatacgaagccatgctcaaaagttcttctccaagatggctcaggaagctgacagtagaagtgaaggatcggttaaagcgattgtgatcccgcctcctcgtccaaagagaaaaccggcacatccttatcctcggaaatcgcctgttccatatactcagtctcctccaccaaatttgtcagctatggagaaaggaaccaagtctccaacctcagtgttatcatcgtttggttcagaggatcaagtcaatagatgctcttcgcctaattcgtgtaccagtgacatccaatccattggtgcaacttccattgataaaaagaataactacacaacatccaagcaacctttcaaagatgattctgacattggttcaacacccatttcaagcattactcttttcgggaagattgtccttgtcgcggaagaatctcacaaaccatcctcttacaatgatgatgatcttaaacaaatgacgtgtcaggagaatcactactcagggatgctagttgacactaatttatctcttggtgtatgggaaacgttttgtactggttctaatgcatttggctcggttacagaagcatctgagaacttggagaaaagtgcagagccgataagttcttcatggaaacggttaagctccttagaaaaacaaggatcttgtaatcctgtaaatgcaagtgggttcaggccatacaagagatgcctatcagaaagagaagtaacatcatcattgacgctggtagcttcagatgaaaagaaaagccaaagagcacgtatatgctagttttagccattgtacagtttggagtcaattttgatgatccgtgaacattgttttagccatttgctgggtgacttggatcatagcattccacgaaccaaatcctaaatccgagttggtaagtggttttacttgtccgccacatgtaattcttgtaatgaagtttctcctgctgtctcacgttaagaagacacttctttttttcttcatatacaaatcagttttaaca

SEQ ID NO: 390 - protein, 346 aa, Arabidopsis thaliana
MAAEDRSEELSSNVENGSCNSNEGINPETSSHWIENVVKVRKPYTVTKQREKWSEEEHDRFLEAIKLYGRGWRQIQEHIGTKTAVQIRSHAQKFFSKMAQEADSRSEGSVKAIVIPPPRPKRKPAHPYPRKSPVPYTQSPPPNLSAMEKGTKSPTSVLSSFGSEDQVNRCSSPNSCTSDIQSIGATSIDKKNNYTTSKQPFKDDSDIGSTPISSITLFGKIVLVAEESHKPSSYNDDDLKQMTCQENHYSGMLVDTNLSLGVWETFCTGSNAFGSVTEASENLEKSAEPISSSWKRLSSLEKQGSCNPVNASGFRPYKRCLSEREVTSSLTLVASDEKKSQRARIC

SEQ ID NO: 391 - DNA, 849 bp, Arabidopsis thaliana
atgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgggatatgcttcatgggatgatgcctcaatgctgctaaacagagttatttcaccacaacatgaacttgctactcttcgtggagcagaagctgatattggatcaaagggcttattaaatgttagtagcccttctacatctggcatgggaagctcaagccgaacagtatcaggttctgagattgtaagaaaggctaaacagcctccagtgcttcacggtgttcctgattttgctgaagtttataatttcattgggagtgtctttgatcctgaaacgagaggccatgtggaaaagctcaaggaaatggatcctataaatttcgaaactgttctgttattgatgagaaacctcacatttaacttatcaaaccctgatttagaatccacttcggattgtaatgatgctgcagaggaaagtcctcttatcatatga

SEQ ID NO: 392 - protein, 282 aa, Arabidopsis thaliana
MSSSPSRNPTNAEAPPPPPTSTDAVAEGSSKKVRKPYTITKSRESWTEEEHDKFLEALQLFDRDWKKIEDFVGSKTVIQIRSHAQKYFLKVQKNGTLAHVPPPRPKRKAAHPYPQKASKNAQMPLQVSTSFTTTRNGDMPGYASWDDASMLLNRVISPQHELATLRGAEADIGSKGLLNVSSPSTSGMGSSSRTVSGSEIVRKAKQPPVLHGVPDFAEVYNFIGSVFDPETRGHVEKLKEMDPINFETVLLLMRNLTFNLSNPDLESTSDCNDAAEESPLII

SEQ ID NO: 393 - DNA, 1412 bp, Arabidopsis thaliana
gcaaccaacacatttctctgtctgtctctctttctctctctctcactcactctctctttgttccatggacttgcaactgaaacaatggagaagtcagcagcagaatgagtcagaagaacaaggctctgctgcaactaagatatcaaactttttctttgatcagattcagtcccaaactgctacttctgctgctgcggctcctcttcctctctttgtccctgaacccacttcttcctcttctttctcttgcttctctcctgactcttctaattcttcttcttcttccaggttcctcaagatgggaaacttcttcagctgggcacagtggcaagaacttgagctacaagcactgatctatagatacatgttggctggtgcttctgttcctcaagagcttctcttacctattaagaaaagtctcctccatcaatctcctatgcatttccttcaccatcctcttcaacatagttttcctcatcaccaaccttcttggtattggggaagaggagcaatggatcctgagccagggaggtgtaagagaactgacggcaagaaatggagatgttcaagggatgttgtagcgggccacaagtattgtgaccgccacattcaccgtggaagaaaccgttcaagaaagcctgtggaaaccgccacaaccaccatcacaacgacagccacaacaaccgcatcttcttttgtcttaggtgaggagcttggtcatggaccaaacaacaaccacttcttctcctctggttcatctcaacctctccaccttagtcatcaacaaagttgttcttcagagatgaaacaagaaagcaacaacaacaagaggccatatgaagctaacagtggattcagcaatggaagatcagacgatggtcacatcttgaggcatttctttgacgattggccacgatcatcagactctacctccagtccaatgagctcatccacttgtcatctttcaatctccatgcccggtaacaacacgtcctcagatgtttctctaaaactttccacaggcaatgaagaagaagaagagaacatgagaaataacaacaatgagagggagcaaatgaattggtggagcaatggagggaatcaccacaacaatatgggaggaccattagctgaggctttgaggtcagcttcttcgacgtcaagtgttcttcatcagatgggaatctctactcaagtttttcattaaagaaaagtgtttgtaatctttttggtttgtgctctttgaatctttattttctgcagaaaataatctttgaatttgtcttcttttggaattgtgagttctgcttttggaattgttttgttccttactctgctattatatttatgtttaaagcttgacaattttgtataagcaatgaaactaatatgatcctctgcctgcaagtaag

SEQ ID NO: 394 - protein, 380 aa, Arabidopsis thaliana
MDLQLKQWRSQQQNESEEQGSAATKISNFFFDQIQSQTATSAAAAPLPLFVPEPTSSSSFSCFSPDSSNSSSSSRFLKMGNFFSWAQWQELELQALIYRYMLAGASVPQELLLPIKKSLLHQSPMHFLHHPLQHSFPHHQPSWYWGRGAMDPEPGRCKRTDGKKWRCSRDVVAGHKYCDRHIHRGRNRSRKPVETATTTITTTATTTASSFVLGEELGHGPNNNHFFSSGSSQPLHLSHQQSCSSEMKQESNNNKRPYEANSGFSNGRSDDGHILRHFFDDWPRSSDSTSSPMSSSTCHLSISMPGNNTSSDVSLKLSTGNEEEEENMRNNNNEREQMNWWSNGGNHHNNMGGPLAEALRSASSTSSVLHQMGISTQVFH

SEQ ID NO: 395 - DNA, 1077 bp, Arabidopsis thaliana
ccaaaccaacacctgcaaatcctctctctctctctcactccaagaaaccaaaaaaaaagatgtcagtcaaccattaccacaacactctctcgttgcatcatcaccaccaaaacgacgtagctatagcacaacgagagtctttgttcgagaaatcactcacaccaagcgacgtcggaaagctaaaccgcttagtcataccaaaacaacacgccgagaaatacttccctctcaataataataataataatggcggcagcggagatgacgtggcgacgacggagaaagggatgcttcttagcttcgaggatgagtcaggcaagtgttggaaattcagatactcttattggaacagtagccaaagctacgtgttgaccaaaggatggagcaggtacgtcaaagacaaacacctcgacgcaggcgacgttgttttctttcaacgtcaccgttttgatctccatagactcttcattggctggcggagacgcggtgaagcttcttcctctcccgctgtctccgttgtgtctcaagaagctctagttaatacgacggcgtattggagcggcttgactacaccttatcgtcaagtacacgcgtcaactacttaccctaatattcaccaagagtattcacactatggcgccgtcgttgatcatgctcagtcgataccaccggtggtcgcaggtagctcgaggacggtgaggctttttggcgtgaacctcgaatgtcatggtgatgccgtcgagccaccaccgcgtcctgatgtctataatgaccaacacatttactattactcaactcctcatcccatgaatatatcatttgctggggaagcattggagcaggtaggagatggacgaggttgatgactgacattcaaaaagaagtgacaactttctagatttttaactttagaatttagattatgggcccatacttggcccaattgtcatagagaaaaaatggacaagaattaatattattagtagcttcgttatgtatttagtatttaactaatttgaaaataaaaataaaagatgagattttgtttctaaaaaaaaaaaaaaaaaaaaaaaaaaa

SEQ ID NO: 396 - protein, 267 aa, Arabidopsis thaliana
MSVNHYHNTLSLHHHHQNDVAIAQRESLFEKSLTPSDVGKLNRLVIPKQHAEKYFPLNNNNNNGGSGDDVATTEKGMLLSFEDESGKCWKFRYSYWNSSQSYVLTKGWSRYVKDKHLDAGDVVFFQRHRFDLHRLFIGWRRRGEASSSPAVSVVSQEALVNTTAYWSGLTTPYRQVHASTTYPNIHQEYSHYGAVVDHAQSIPPVVAGSSRTVRLFGVNLECHGDAVEPPPRPDVYNDQHIYYYSTPHPMNISFAGEALEQVGDGRG

SEQ ID NO: 397 - DNA, 1791 bp, Arabidopsis thaliana
atgtcaccgccgtcggcaaccgccggtgacatcaaccaccgtgaagtagacccgacgatctggcgcgcttgtgctggagcctccgtccagatccctgtccttcactctagggtttactactttccacaaggtcacgttgagcactgttgccctctcctctctactcttccttcctccacctcgccggttccatgtatcatcacttcaattcagttgctcgccgatccggtcaccgacgaggtctttgctcaccttattcttcaaccgatgacgcagcagcagtttactccgactaattattcacgattcggcagattcgatggcgatgttgatgataacaacaaggtgactaccttcgccaaaattctcacgccttctgatgctaacaatggaggtggcttctccgttcctcgtttctgtgctgattccgtcttccctctgcttaattttcaaatcgatccaccggttcagaagctctacgtcactgatatccatggagctgtttgggatttcaggcatatctatcgcggtacaccgaggcgtcacttgctaacaacgggatggagtaagttcgtcaatagcaagaagctcatcgctggagattcggtggtgtttatgagaaaatctgcagatgagatgttcatcggcgttaggagaactccgatctcaagcagcgacggaggaagtagctattacggaggagatgagtataacggttactacagtcagagtagcgttgccaaggaagatgatgggagtccgaagaagacgtttaggagatctgggaatggtaagttgactgctgaggctgtgacggatgcgatcaatagagcgtctcagggattaccatttgaggtggtgttttatccggctgctggatggtctgagtttgttgtgagagctgaagatgttgagtcttcaatgtctatgtattggactcctgggactcgagtcaagatggctatggagactgaagattcttctcggatcacatggtttcaaggcatcgtttcctctacttatcaggagaccggtccatggcgtggatctccatggaagcagcttcagatcacatgggatgaacctgagattctgcaaaacgtgaagagggtgaatccatggcaagtggaaattgctgcacatgcaactcaactgcatacccctttccctccagcaaagaggttgaagtatccacaacccggaggagggttcttgagtggagatgatggagaaatcctttatcctcaaagtggactgtctagtgcagcagcacctgatccaagtccttctatgttctcgtattctacatttcctgctggcatgcagggagccaggcaatatgattttgggtctttcaatccaaccggattcattggaggaaatcctccccagctattcaccaataacttcttaagtccgcttcctgatttgggaaaagtgtcgactgagatgatgaactttggcagtccgccatcagataacttatcgcctaatagcaacaccactaatctgtcctctggaaatgacctggttggaaaccgaggccccctttcaaagaaagttaactcgattcagttgtttggcaagatcattaccgtggaggagcattctgagagcggtcctgcagagtctggcttgtgtgaagaggatggcagcaaagagtccagcgacaatgagacacagttgtccttatcacatgctcctccaagcgtgcctaaacattccaacagcaacgcaggttctagctcccaaggtatattccgatctctctcaagtacaataatcaattga

SEQ ID NO: 398 - protein, 596 aa, Arabidopsis thaliana
MSPPSATAGDINHREVDPTIWRACAGASVQIPVLHSRVYYFPQGHVEHCCPLLSTLPSSTSPVPCIITSIQLLADPVTDEVFAHLILQPMTQQQFTPTNYSRFGRFDGDVDDNNKVTTFAKILTPSDANNGGGFSVPRFCADSVFPLLNFQIDPPVQKLYVTDIHGAVWDFRHIYRGTPRRHLLTTGWSKFVNSKKLIAGDSVVFMRKSADEMFIGVRRTPISSSDGGSSYYGGDEYNGYYSQSSVAKEDDGSPKKTFRRSGNGKLTAEAVTDAINRASQGLPFEVVFYPAAGWSEFVVRAEDVESSMSMYWTPGTRVKMAMETEDSSRITWFQGIVSSTYQETGPWRGSPWKQLQITWDEPEILQNVKRVNPWQVEIAAHATQLHTPFPPAKRLKYPQPGGGFLSGDDGEILYPQSGLSSAAAPDPSPSMFSYSTFPAGMQGARQYDFGSFNPTGFIGGNPPQLFTNNFLSPLPDLGKVSTEMMNFGSPPSDNLSPNSNTTNLSSGNDLVGNRGPLSKKVNSIQLFGKIITVEEHSESGPAESGLCEEDGSKESSDNETQLSLSHAPPSVPKHSNSNAGSSSQGIFRSLSSTIIN

SEQ ID NO: 399 - DNA, 1231 bp, Arabidopsis thaliana
ctcttctttttttcaatgaaacctctcttcatttataagtaacccaacaaaaaaataaaattatctccctcttatttcttctcttcacgtcacaaagacaattcgattccaaataatggaccgacgtaaccctttccaacatcaccaccaccaccatcagcttcatcatcacttgatccaacagcaacagcttcctccgccgccgctgagcaccacggcgacgatggatcccggcggaggaggaggaggtggggagagaatcccacagtggagcatagaggagacaaaggagcttttggctataagagaagaacttgatcaaactttcatggagaccaaacgtaataagcttctttgggaagtcgtggctgctaagatggccgacaagggttttgtccgaagcgcagaacaatgtaagagcaagtggaagaacctcgtcactagatacaaggcgtgtgagaccactgagccagatgctattaggcagcagttcccattctacaatgagattcagtcgatttttgaagcaagaatgcaaagaatgctgtggtcagaagccacagaaccaagcacttcctcgaagagaaaacatcatcaattttcatctgatgatgaagaagaagaagttgacgaaccaaatcaagatatcaacgaggaattattgtctttagtagagacacagaaaagagagacagaagtgattactactagtacttcgaccaatccaagaaaacgtgcaaaaaaaggaaaaggcgttgcgagtggtacgaaagctgaaactgcgggtaatacactaaaagatatattggaggagtttatgaggcaaacggtgaagatggaaaaggaatggagagatgcatgggagatgaaggagatagagagggagaagagagagaaagagtggcggaggagaatggcggagctagaggaggaaagagccgccacagaaaggaggtggatggagagagaggaagagagacggttgagagaagaagctagggctcagaagagagattctctcatcgatgctttgcttaataggcttaatagagatcataatgatgatcatcataatcaaggtttctaagttctcattatttgtgttaagcataagttaattagctagttaatttgttaggcaaatcaatttagataatatatctaaattaatgtttgttttataatatttatatgaactattgaaatttccaaaacaaaaaaaaaaaaaaaa

SEQ ID NO: 400 - protein, 323 aa, Arabidopsis thaliana
MDRRNPFQHHHHHHQLHHHLIQQQQLPPPPLSTTATMDPGGGGGGGERIPQWSIEETKELLAIREELDQTFMETKRNKLLWEVVAAKMADKGFVRSAEQCKSKWKNLVTRYKACETTEPDAIRQQFPFYNEIQSIFEARMQRMLWSEATEPSTSSKRKHHQFSSDDEEEEVDEPNQDINEELLSLVETQKRETEVITTSTSTNPRKRAKKGKGVASGTKAETAGNTLKDILEEFMRQTVKMEKEWRDAWEMKEIEREKREKEWRRRMAELEEERAATERRWMEREEERRLREEARAQKRDSLIDALLNRLNRDHNDDHHNQGF

SEQ ID NO: 401 - DNA, 1330 bp, Arabidopsis thaliana
ccctccaagatattcctctattaggtgcaaaaatcaggtaaatctctatctgtccgatttgaaaccctagatctgcctttcttctctcttcttttgcttttctgggttttgctcaaagatgggtgacagcgaagatgaaacaggatacccaaaaaagttttactctttgaatcggcaaaaccatccaatgtatagtagaccaatacctaagcgtcacgcgtattacaatgaagaagaagacgaagatgaagtcgaaggagaagaggaagatccacaaggaggatacattcgtggaaatgagaggtttcagaagagacagaaaccaaacaaagtagtttctgggtttgaatttgctggtcctagtgatgctaaagttgcgtatgattggagagagcaagaagcttttgtgttgcttgaagtttggggagataggtttttgcaattgggtagaaggagtttgaggaacgaggattggaatgaagtagctgagaaagtgagtgaggagctaaggatggagaaatctgagacgcaatgtaggagaatgattgatgacttgaagaggaagtatagaaaagagaagattaaggttgagaaatcaggtttaggttcaagtaaatggtcgtttttcaataagttggatatgttgctttgtgtttcgcccaagtcggatttaggtttagcttgtggtgttgattcaggtgagtttgtgtttatgaacactaaggtttatttagataagtctaatgggtttgatgagatgatggatagtcctggtgattctgaagaggaggaggatgaggatgatgaggttgagtacgagaggaagaaggttaatgacgctgcttcgtataagatgttggcggattctgttgagaggtttgggaaggtttatgagaagatggagaagagtaagaaagagcaaatgaaggagttggagaagatgagagctgattttcagagagatttggagttgcagaagaagcagattgttgatagagctcagagtgagattgctaggttacgtgaagaggaggagaatcatcatggtggtggtgatgatgatgagagtgaagatgaagaaatggagaatgattctgatgttaatctcagtgatgagtaagttataaactatgtaggtttgtgttgtttgtagatgcaacaaaatatgttctgtttttttttttggttttagggaattcagaacttaagtcttataagttttgtaatttgtgtttggtctttgcaactttagtcgaggttatttgcagtttatcttgaaacttaaattaatgcataaacatatttccttcttaaaaaaaaaaaaaaaaaa

SEQ ID NO: 402 - protein, 333 aa, Arabidopsis thaliana
MGDSEDETGYPKKFYSLNRQNHPMYSRPIPKRHAYYNEEEDEDEVEGEEEDPQGGYIRGNERFQKRQKPNKVVSGFEFAGPSDAKVAYDWREQEAFVLLEVWGDRFLQLGRRSLRNEDWNEVAEKVSEELRMEKSETQCRRMIDDLKRKYRKEKIKVEKSGLGSSKWSFFNKLDMLLCVSPKSDLGLACGVDSGEFVFMNTKVYLDKSNGFDEMMDSPGDSEEEEDEDDEVEYERKKVNDAASYKMLADSVERFGKVYEKMEKSKKEQMKELEKMRADFQRDLELQKKQIVDRAQSEIARLREEEENHHGGGDDDESEDEEMENDSDVNLSDE

SEQ ID NO: 403 - DNA, 1370 bp, Arabidopsis thaliana
gcggttgtgtgttacgagagctagagttgaatttgctttggtcaacacaatggggacttgtggttgctgacttttgtgattttcagttttctacttggatttagatggatgtttcttccattgtgcgaaatacaaccctaactgatcaagatcctttgttaatggaccacggtaaccgcgagcacatcgttgacattacaagcaatgacgaggaggactcttcatcaagatcttctctcgatgagcttactcctcaaggtaactcacatcaaggtgaagagacagtattatcatcatcaaatgctacacaacaacacccaactcatccatctcctcctcagcaaagaccaacttcttctaggagaggagataacgggaatggtcgccgtactaggagtccattgaattctggcctctggatctcagttgagttagttgtcactgtcgctcagattgttgcagccattgtagttatggttctggctaaagatgaacatcctgaagcgccattatttacttgggttattggatatacttgtggctgtctagccactctccctattctctattggcgttttcgcacttataatcgagctacagggcaagactcttcacaacgtgctacctcttctcaaggcaatagtgagtccacaccatatacagcagtctcagttgctcaagcagcagatgaagaaaatagcactggcgtgagtgcagcacctagaaacaatcaagttggggaaagcttaagaacaaggctcaacgggctagtggaccacttcaagatggcgattgattgtttctttgcggtgtggtttgttgtggggaatgtatggatatttggaggtcactcatctccttctgattctcctaaactgtacaggttatgcatagcgttccttactttcagttgcattggatatgcaatgccattcatactatgtgcaaccatatgttgttgtttgccttgcttaatctcggttctcggatttcgagagaacttctcacaaactagaggagccactgccgaggccatcaacgcattgcctgtctacaggttcaaatcaaaaagtagaaatgatttggagttttcagaagaaggtgaaggtggatttcttctcttggggtctcagaagaaacgtcttatatcaggcgaggatgccagctgttgcatctgcttgactagatatggagacgacgaacaagttagagagctgccatgctcacatgtcttccatgtagactgtgtagacaaatggcttaaaatcaatgcgacttgccctctctgcaaaaatgaggttggagaaagcagcagtgcttcctcatagacaaaagctgagttgatcgcaactgtttggaatttgggatcc

SEQ ID NO: 404 - protein, 407 aa, Arabidopsis thaliana
MDVSSIVRNTTLTDQDPLLMDHGNREHIVDITSNDEEDSSSRSSLDELTPQGNSHQGEETVLSSSNATQQHPTHPSPPQQRPTSSRRGDNGNGRRTRSPLNSGLWISVELVVTVAQIVAAIVVMVLAKDEHPEAPLFTWVIGYTCGCLATLPILYWRFRTYNRATGQDSSQRATSSQGNSESTPYTAVSVAQAADEENSTGVSAAPRNNQVGESLRTRLNGLVDHFKMAIDCFFAVWFVVGNVWIFGGHSSPSDSPKLYRLCIAFLTFSCIGYAMPFILCATICCCLPCLISVLGFRENFSQTRGATAEAINALPVYRFKSKSRNDLEFSEEGEGGFLLLGSQKKRLISGEDASCCICLTRYGDDEQVRELPCSHVFHVDCVDKWLKINATCPLCKNEVGESSSASS

SEQ ID NO: 405 - DNA, 1154 bp, Arabidopsis thaliana
aagaacacaatgccagtttctgcagagccttcttcatcttcttcaacaacaatcggtcaacacatgagactccaacgacctaggaatcatcgaaatctcccacccatttccaccgccgacgaacctctaatccccaaacctagccgcgtctctaaatccgccatgtcttccttcttcctcttgccagaaactactaagaagaaacccaacggaacggcgtcgtttcgtggtctaggctgcacaacctccgcatctcagcaagtttcagtcccggcagtgattcgctcctccgcggattgggatgctagtaatttcaaaattaagaagacgaagaagaagaacaagaacaagggtagtagtagctacaatggtggttcgattaagatcttgagcgaagctagtactagtagtagcgtcgcttgcgcagcgattcctgatgtttggtgtggtcctggagttgggttttcaacggatgctgtcgtcggaggctccattgacacagttgtttcagatcctccgagaaggaatattccggtgagacgcaaaatcgatggagataaaaccaatagtaacagtaataatcatagagagggttcttcttctcttcttcctagacgatctctcaatcaagagtctaatccttattttgattctgattcgagttttttgacatcgcgggctgagcagactgatagatatcatcgtcatctaagactgccttaccctgatggactcgctgagatgatgatgatgcagaatggttttgtgatgggaggagtattaagctcattcgatcaattccgtgacatgaggctcaatgtcgataacatgacatacgagcaacttttggagcttggtgaaagaattgggcatgtgaacactggacttactgaaaaacagatcaaaagttgtcttcggaaagtcaaaccatgccggcaagatacaacagttgctgatagaaagtgcatcatctgtcaagacgagtatgaggcgaaggacgaggtaggggaattacgatgtgggcacaggttccatatcgactgtgtgaatcaatggcttgtgaggaagaactcttgtccggtctgtaaaacgatggcgtacaataagtcttagttagatattatctcttcctgtgatgtgattcttgatttcgg

SEQ ID NO: 406 - protein, 367 aa, Arabidopsis thaliana
MPVSAEPSSSSSTTIGQHMRLQRPRNHRNLPPISTADEPLIPKPSRVSKSAMSSFFLLPETTKKKPNGTASFRGLGCTTSASQQVSVPAVIRSSADWDASNFKIKKTKKKNKNKGSSSYNGGSIKILSEASTSSSVACAAIPDVWCGPGVGFSTDAVVGGSIDTVVSDPPRRNIPVRRKIDGDKTNSNSNNHREGSSSLLPRRSLNQESNPYFDSDSSFLTSRAEQTDRYHRHLRLPYPDGLAEMMMMQNGFVMGGVLSSFDQFRDMRLNVDNMTYEQLLELGERIGHVNTGLTEKQIKSCLRKVKPCRQDTTVADRKCIICQDEYEAKDEVGELRCGHRFHIDCVNQWLVRKNSCPVCKTMAYNKS

SEQ ID NO: 407 - DNA, 528 bp, Arabidopsis thaliana
atggcgacccaagattctcaagggattaaactctttggcaaaaccataacattcaacgccaacatcacacagacgataaaaaaagaagagcagcaacaacaacaacagccagagctacaagcaacaacagccgttagatcaccctcatcggatctgacggctgagaagcgtccagacaagatcataccatgtccgagatgcaagagcatggagactaagttttgttacttcaacaactacaacgttaatcaaccaagacacttctgcaaaggttgtcaacgttactggaccgccggtggagctctccggaatgttcccgtcggtgccggtcgtcggaagtcaaaacctcccggacgtgtcggtgggttcgctgagttgcttggagctgcgactggagctgttgatcaggtcgagctagatgctttgctagtggaagagtggagagctgctacggcgtctcacggtggtttccggcatgattttccggtgaagaggctccgttgttacaccgatggtcaatcttgttaa

SEQ ID NO: 408 - protein, 175 aa, Arabidopsis thaliana
MATQDSQGIKLFGKTITFNANITQTIKKEEQQQQQQPELQATTAVRSPSSDLTAEKRPDKIIPCPRCKSMETKFCYFNNYNVNQPRHFCKGCQRYWTAGGALRNVPVGAGRRKSKPPGRVGGFAELLGAATGAVDQVELDALLVEEWRAATASHGGFRHDFPVKRLRCYTDGQSC

SEQ ID NO: 409 - DNA, 1122 bp, Arabidopsis thaliana
atgttgaaacaagagagtaacgacataggtagtggagagaacaacagggcacgaccctgtgacacatgccggtcaaacgcctgcaccgtgtattgccatgcagattctgcctacttgtgcatgagctgtgatgctcaagttcactctgccaatcgcgttgcttcccgccataaacgtgtccgggtctgcgagtcatgtgagcgtgctccggctgcttttttgtgtgaggcagatgatgcctctctatgcacagcctgtgattcagaggttcattctgcaaacccacttgctagacgccatcagcgagttccaattctaccaatttctggaaactctttcagctccatgaccactactcaccaccaaagcgagaaaacaatgaccgatccagagaagagactggtggtggatcaagaggaaggtgaagaaggtgataaggatgccaaggaggttgcttcgtggctgttccctaattcagacaaaaataacaataaccaaaacaatgggttattgtttagtgatgagtatctaaaccttgtggattacaactcgagtatggactacaaattcacaggtgaatacagtcaacaccaacaaaactgcagcgtaccacagacgagctacgggggagatagagttgttccgcttaaacttgaagaatcaaggggccaccagtgccataaccaacagaattttcagttcaatatcaaatatggctcctcagggactcactacaacgacaatggttccattaaccataacgcatacatttcatccatggaaactggtgttgtgccggagtcaacagcatgtgtcacaacagcttcacacccaagaacgcccaaagggacagtagagcaacaacctgaccctgcaagccagatgataacagtaacacaactcagtccaatggacagagaagccagggtcctgagatacagagagaagaggaagacaaggaaatttgagaagacaataaggtatgcttcgaggaaggcatatgcagagataagaccgcgggtcaatggccggttcgcaaagagagaaatcgaagccgaggagcaagggttcaacacgatgctaatgtacaacacaggatatgggattgttccttcattctga

SEQ ID NO: 410 - protein, 373 aa, Arabidopsis thaliana
MLKQESNDIGSGENNRARPCDTCRSNACTVYCHADSAYLCMSCDAQVHSANRVASRHKRVRVCESCERAPAAFLCEADDASLCTACDSEVHSANPLARRHQRVPILPISGNSFSSMTTTHHQSEKTMTDPEKRLVVDQEEGEEGDKDAKEVASWLFPNSDKNNNNQNNGLLFSDEYLNLVDYNSSMDYKFTGEYSQHQQNCSVPQTSYGGDRVVPLKLEESRGHQCHNQQNFQFNIKYGSSGTHYNDNGSINHNAYISSMETGVVPESTACVTTASHPRTPKGTVEQQPDPASQMITVTQLSPMDREARVLRYREKRKTRKFEKTIRYASRKAYAEIRPRVNGRFAKREIEAEEQGFNTMLMYNTGYGIVPSF

SEQ ID NO: 411 - DNA, 789 bp, Arabidopsis thaliana
atgaatattaacaaaacctatctctctgtctatatatacacacacacacacacacatatatctcctatcattcatcgtacacacacactctctatgacaaagctccccaacatgacgacaacactcaaccatctatttgatctgccggggcagatttgccatgtccagtgtggtttttgcaccactattttgctggtgagtgtaccgtttacaagcttgtcaatggtggtgactgtgagatgtgggcattgcacaagccttctctctgtcaatttgatgaaggcttccttcattcctctccatctccttgcttctctctcccatcttgatgagaccgggaaagaggaggttgcagctacagatggtgtggaagaagaagcatggaaggtgaatcaggagaaggagaacagtccaacgactttggtttcatcttcagacaatgaagatgaagatgtgtctcgtgtttaccaagttgtcaataaaccacctgagaagcgacaaagagctccttcagcttacaattgcttcatcaaggaagagatcaggaggttaaaggctcagaatccaagcatggctcacaaggaagctttcagcttagctgccaaaaattgggcccattttcctccagctcacaacaagagagctgcttcagatcaatgtttttgtgaggaagataacaatgcgatactaccatgcaatgtttttgaggaccatgaagaaagcaataatgggttccgagagagaaaggctcagaggcattccatttggggaaaatctccatttgagtaa

SEQ ID NO: 412 - protein, 262 aa, Arabidopsis thaliana
MNINKTYLSVYIYTHTHTHISPIIHRTHTLSMTKLPNMTTTLNHLFDLPGQICHVQCGFCTTILLVSVPFTSLSMVVTVRCGHCTSLLSVNLMKASFIPLHLLASLSHLDETGKEEVAATDGVEEEAWKVNQEKENSPTTLVSSSDNEDEDVSRVYQVVNKPPEKRQRAPSAYNCFIKEEIRRLKAQNPSMAHKEAFSLAAKNWAHFPPAHNKRAASDQCFCEEDNNAILPCNVFEDHEESNNGFRERKAQRHSIWGKSPFE

SEQ ID NO: 413 - DNA, 758 bp, Arabidopsis thaliana
tcattgggataactaaaagtttcaagaagagaaacatatcattgaagagagaacccacacaaaaaaaaatgtctgtagatttctcatctgagcgtgtttgctatgtccactgcagcttctgcaccacgattttagcggtaagtgtaccatacgcaagtttgttcacacttgtgacggtgagatgtggccattgtaccaatttgctatccctcaacattggagtttcacttcatcaaacctcagctcctcccattcaccaagatcttcagcctcatagacagcacacaacctctctggtgacaaggaaagattgtgcatcgtcttctaggagcaccaacaatttatcggaaaacattgatcgtgaggctcctagaatgcctcctattcgcccaccggagaaaagacaacgtgttccttcggcctacaacagattcatcaaggaggaaatccaaaggattaaggcttgcaatccagagattagccaccgtgaggcatttagcactgctgctaaaaattgggcacattttcctcacattcactttggattaaagctggatggcaacaagaaaggcaagcaattagaccagtcagttgcaggccaaaagtctaatggctattactaaagcctttatatatatacacacatatatacacttatacgtatatatatgtgtatagatatatatgcgtgtgtatgatttatgtttatctttgtacgtacgcattaatgaatgtgtaagcagagagctgatgatgga

SEQ ID NO: 414 - protein, 184 aa, Arabidopsis thaliana
MSVDFSSERVCYVHCSFCTTILAVSVPYASLFTLVTVRCGHCTNLLSLNIGVSLHQTSAPPIHQDLQPHRQHTTSLVTRKDCASSSRSTNNLSENIDREAPRMPPIRPPEKRQRVPSAYNRFIKEEIQRIKACNPEISHREAFSTAAKNWAHFPHIHFGLKLDGNKKGKQLDQSVAGQKSNGYY

SEQ ID NO: 415 - DNA, 890 bp, Arabidopsis thaliana
ctatctgaacatcgatcagtcatatcttttcaatcaaatcaaagccctcctctctctcttactccttttttgttttaaatcaagaaaaagactccatgtcgagcatgtccatgtcgtcctcctcagctccagcttttccaccggaccacttctcatctacggaccagctctgttacgtccattgcagcttctgcgacactgtccttgctgtgagtgttcctccgagtagtttgttcaagacggtgacggtcagatgcggccactgttcgaaccttttgtcggtgaccgtgagcatgagagctcttcttcttccatccgtttccaaccttggccattcctttttacctccccctcctcctcctcctcctccaaatcttttggaggaaatgcgaagcggagggcagaatataaacatgaacatgatgatgagccatcacgcttcagctcaccacccgaacgagcatttggttatggcgactcgcaacggaagatcagtggatcatctacaagagatgcctcggccaccaccagccaatagacccccagagaagcgacaaagagtaccatctgcatacaaccgattcatcaaagaggagatccaacgtataaaggcaggcaaccctgatatcagccacagagaagccttcagtgctgctgccaaaaactgggctcatttccctcacatacactttggactcatggctgaccatcctcccacgaagaaggctaacgtgcgccaacaggaaggagaggatgggatgatgggaagagaagggttttacggttcagctgccaacgttggggtggcccataactagctacgaagactttcccaatcttttgtaatcttcaaaatgtggttactttcagctcaaacttaacgcggccgc

SEQ ID NO: 416 - protein, 240 aa, Arabidopsis thaliana
MSSMSMSSSSAPAFPPDHFSSTDQLCYVHCSFCDTVLAVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 417 - DNA, 590 bp, Arabidopsis thaliana
caatccattcgctaaagaccatgaacctagaagagaaaccaaccatgacggcttcaagggcttcccctcaagccgaacatctctactacgtccggtgtagcatctgcaacaccatcctcgcggttgggataccattgaagagaatgcttgacacggtaacggtgaaatgcggccattgtggtaacctctcgtttctcaccacaactcctcctcttcaaggccatgttagcctcacccttcagatgcagagctttggtggaagtgactataagaagggaagctcttcttcttcctcttcctccacctccagcgaccagcccccatctccctcacctccctttgtcgtcaaacctcctgagaagaagcagaggctcccatctgcatacaaccgcttcatgagggatgagatccaacgcatcaaaagtgccaatccggaaataccacaccgtgaagctttcagtgctgctgccaaaaattgggctaagtacatacccaactctcctacttccattacttccggaggccacaacatgatccatggcttgggattcggtgagaagaagtgaacaaaactcaggggaaaagaagcc

SEQ ID NO: 418 - protein, 181 aa, Arabidopsis thaliana
MNLEEKPTMTASRASPQAEHLYYVRCSICNTILAVGIPLKRMLDTVTVKCGHCGNLSFLTTTPPLQGHVSLTLQMQSFGGSDYKKGSSSSSSSSTSSDQPPSPSPPFVVKPPEKKQRLPSAYNRFMRDEIQRIKSANPEIPHREAFSAAAKNWAKYIPNSPTSITSGGHNMIHGLGFGEKK

SEQ ID NO: 419 - DNA, 561 bp, Arabidopsis thaliana
catcttgtttggtcctatttctcagatcgatcatggctaactctgtgatggcaaccgaacagctctgctacatcccttgcaacttttgcaacataattcttgcggtgaatgtcccatgcagcagcctgttcgacatcgtgaccgtccgatgcggtcactgcaccaatctgtggtctgtaaacatggcagctgctcttcagtcgctttcacgccctaatttccaggcaacaaactatgcagtaccagagtatggatcctcctcaagaagccacacaaaaatcccttcaagaatttcaactcgtaccataactgagcaacggattgtaaaccgtcctccggagaagcggcagcgagtaccttctgcgtacaatcaattcataaaagaggaaattcagaggattaaggcgaataatccagacataagccacagagaagcattcagcactgctgccaagaattgggcacactttcctcatattcactttggtctaatgctggagagtaacaagcaagctaagatagcctaataattctcgagattaatggtaatataagtgttgg

SEQ ID NO: 420 - protein, 164 aa, Arabidopsis thaliana
MANSVMATEQLCYIPCNFCNIILAVNVPCSSLFDIVTVRCGHCTNLWSVNMAAALQSLSRPNFQATNYAVPEYGSSSRSHTKIPSRISTRTITEQRIVNRPPEKRQRVPSAYNQFIKEEIQRIKANNPDISHREAFSTAAKNWAHFPHIHFGLMLESNKQAKIA

SEQ ID NO: 421 - DNA, 849 bp, Arabidopsis thaliana
atggacccgtcgtcaagctccagagcacggtcaatgccaccgccggtgcctatggagggattgcaggaagcagggccttctccttttctaacaaagacgttcgagatggttggtgatccaaacacaaaccacattgtgtcttggaacaggggaggcatcagttttgtcgtgtgggatccacattccttctcggccactattctgcctctatacttcaagcacaacaacttctccagctttgtcagacaacttaacacttatggattcagaaagatcgaggcagagagatgggagtttatgaatgaaggtttcttgatgggtcagagggaccttctcaaaagcatcaagcgacgaacctcctcttcttcccctccttcgcttaactactctcagtctcagcccgaggctcatgacccaggcgtcgagcttccgcagctccgagaagagaggcatgtcctaatgatggagatctcgacgctcagacaggaggagcaaagagcgagaggctacgtccaagccatggagcagaggattaatggagcagagaagaaacagaggcatatgatgtccttcttgaggcgtgcggtggagaatccttcccttctgcagcagattttcgagcagaagagagaccgagaggaggccgcgatgattgatcaggctggcttgatcaaaatggaagaggtggagcacctgtcggagctggaggctctggcgcttgagatgcaaggatatggacggcaacggactgatggtgtggagagggagcttgacgacgggttttgggaagagttactcatgaacaatgaaaactccgacgaagaagaggcgaatgtgaagcaagattag

SEQ ID NO: 422 - protein, 282 aa, Arabidopsis thaliana
MDPSSSSRARSMPPPVPMEGLQEAGPSPFLTKTFEMVGDPNTNHIVSWNRGGISFVVWDPHSFSATILPLYFKHNNFSSFVRQLNTYGFRKIEAERWEFMNEGFLMGQRDLLKSIKRRTSSSSPPSLNYSQSQPEAHDPGVELPQLREERHVLMMEISTLRQEEQRARGYVQAMEQRINGAEKKQRHMMSFLRRAVENPSLLQQIFEQKRDREEAAMIDQAGLIKMEEVEHLSELEALALEMQGYGRQRTDGVERELDDGFWEELLMNNENSDEEEANVKQD

SEQ ID NO: 423 - DNA, 3855 bp, Arabidopsis thaliana
atgatatatcataggtaattaggtatcatatctcatggagataaacgggtaaataaatataatcttatttgctaaataaaaaataatcaagtttaagttttaacatcttcatatacaatctggtttctgtgatctccctgtattagcaaaaaaaaaacatgatttaaaaaagaatttggaaagaaaagaaaagagcgggaaataaatccaaagatttgaccaagttaaaccaaaacttttttactatctgagaaaaccattcagtttccccaaaataaaataaaaaatcagccttaaatcccgtgtctagggttttctttcgtagctgattgggggctgcaagagtttcgccgaggacgattgagaattttgattttcgaaaaatggattctgtggaggaagaaggtgttgttagggttgaagaagagaacggacgcggtggtctccgtaggcatcggagggtttctacgaagctggcgaattacgtagatcctccgactgacgacgaagaagatggaggacccaagcgaaagggcaaaaggggtggaaatagggctccgaaaaagacaccgaagaaagacgaggagatgcaaaagaacgaaattgatgaagcaaaccgagtcactggtctggtgaaggaaaaaagagccgcgactaagattctgaatcgcaaagactccattattgaagtaggagaagcttctggaagcatgcccaaggaagtaaagggaattaggattgggaaaaggaagggagaaatcgatggtgagattccaactaagccgggcaagaagccaaagactacagtagacccgagaatcattggttacagaccggacaatatgtgccatcaatgtcaaaagagcgataggattgttgaacggtgtcagacctgcaatagtaagcgttattgtcatccatgcttggacacttggtacccccttatagcaaaagaagatgttgccaagaaatgcatgttctgctctagtacttgcaattgcagagcatgcttgcgtctagatactaaattgaaagggataaattcgaacctcatagtcagcgaggaagaaaaggtccaagcctctaagtttattctgcagagccttctcccacatctgaaaggaataaatgatgaacaagttgctgagaaggaagttgaggccaaaatatacggactgaagtttgaagaggtgaggccccaagacgctaaagctttccctgatgaaagactatactgtgatatctgcaagacttctatctatgatctccataggaattgcaagtcctgtagttttgatatctgccttagctgttgccttgagatccgcaatggaaaggctctggcatgtaaggaggatgtgtcttggaattatattaaccgaggtttagagtatgaacatggacaagaaggaaaagtgattgaaaagccggcgaataagctagatgataagttgaaagataagctggatggtaagccggatgataagccgaagggtaagccaaagggtaggccaaagggtaagccggatgataagccgaagggtaaactgaagggtaagcaggatgataaaccggatgataagccagatgagaagccggttaatacagaccatatgaagtacccttctctgtggaaagcaaatgaagctgggatcattacttgttgttgtggtgctggggagttagtgctgaaacgactacttccggatggttggatatctgagttggtcaacagagttgaaaaaactgctgaagctggcgagcttttgaatttacctgaaacggttttggagcgatgcccttgttctaactctgacagacatattgacatagacagctgtaatttgttaaaagctgcttgtcgagaaggttcagaagacaattatctttactctccaagtgtatgggatgttcaacaagatgatttgaagcattttcagcaccattgggtaaaaggcgagcctgtgattgtgagaaatgtgcttgaagctacatctggtttaagctgggaaccaatggtaatgcatcgtgcctgccgccagataagccatgtccagcatggatcacttaaggatgttgttgctgttgattgtttggacttctgtgaggtaaaagttaatcttcatgaattttttactggatacacggatggccgatatgatcgaatgggttggccactagttctgaaactgaaagattggcctccagctaaagtcttcaaagataacttgccacgtcatgctgaggagttcttatgtagtttgcctttgaagcattacactcatccggttaatggacctttgaatctcgctgtcaagcttccccaaaattgcttgaagccagacatgggaccaaagacgtacgttgcttctggatttgctcaagaattaggccgtggagattctgttactaagctccactgcgacatgtctgatgcggtgaatattttgacgcacatatctgaagtgcccaatatgcaacctggaattggaaatctgaaaaagaagcatgccgaacaagatctcaaggagctgtatagctcagtagctaacaaggaggaaatgatggagattcttgaaaattccagacaacaagtccaaaatgttgaaactgatgatggagctctttgggacattttccgtagagaagatattcctaaattagaaagttacattgagaaacatcacaaggagttcagacatctctactgctgtcctgtgtctcaggttgttcatcctatacatgaccagaacttctatctgacgcggtatcatataatgaagctgaaagaagaatatggcattgaaccttggaccttcaatcggaagcttggtgatgctgttttgatacctgtaggttgccctcatcaagttagaaatttgaagtcctgcaataaggtagcgcttgacttcgtctcacctgaaaatgtcagcgagtgtttacgcttgacaaaacagtatcgtctacttccaccaaatcattttgcaaaagaagacaagttaggggttaagaagatgatagtccatgcagttgataaagctctcagagacttaagtggagagaagtctccagaacctgaagagaagaaacaaaatatgagagggccgaagaagggggcagccaaggcagttgccaaggctctcaaagacttatctccaagtgaaaagaagtcttcggaagcagctgaagaggagatatcaaatgggatagtcaatgcaatcgataagggtctcaaagacttacctccaagtgaagagaagtcttccgaagccaaagtggagatatcaaatgggatagtcagtgcaatggataaggatctcgaacacatatcttcaagcgaaaagaagtctacggaagaggaaggggtgaaaagaccaaatattgtgaggacatatgagcggagaaaaaagctgggaagtgaagtaaccaacgcatacattgacagattagaaatggagaagatgtagtagtagtagtagttttcaattaacatcatcttttgttatagctttagcaaactcttttgctactttcatatctctaagttaaacagagtagtactaagggatagactaagaagatacttagttatatctatgtttggcatattttgtattctctcctcaatcatctacaaactctgtgaatttactcgagtctaagaagtatttaacttcattcctgtagaaaaatagctatcaacataacagtaacaggtatagaaattgtttgttaagttactctatatgcaacctattcttaacgaaacaaattgcttatttttgtttcaagttgtctaagttataagtggagaagaaagattctttaacttacatagctagctaggccttaaag

SEQ ID NO: 424 - protein, 1027 aa, Arabidopsis thaliana
MDSVEEEGVVRVEEENGRGGLRRHRRVSTKLANYVDPPTDDEEDGGPKRKGKRGGNRAPKKTPKKDEEMQKNEIDEANRVTGLVKEKRAATKILNRKDSIIEVGEASGSMPKEVKGIRIGKRKGEIDGEIPTKPGKKPKTTVDPRIIGYRPDNMCHQCQKSDRIVERCQTCNSKRYCHPCLDTWYPLIAKEDVAKKCMFCSSTCNCRACLRLDTKLKGINSNLIVSEEEKVQASKFILQSLLPHLKGINDEQVAEKEVEAKIYGLKFEEVRPQDAKAFPDERLYCDICKTSIYDLHRNCKSCSFDICLSCCLEIRNGKALACKEDVSWNYINRGLEYEHGQEGKVIEKPANKLDDKLKDKLDGKPDDKPKGKPKGRPKGKPDDKPKGKLKGKQDDKPDDKPDEKPVNTDHMKYPSLWKANEAGIITCCCGAGELVLKRLLPDGWISELVNRVEKTAEAGELLNLPETVLERCPCSNSDRHIDIDSCNLLKAACREGSEDNYLYSPSVWDVQQDDLKHFQHHWVKGEPVIVRNVLEATSGLSWEPMVMHRACRQISHVQHGSLKDVVAVDCLDFCEVKVNLHEFFTGYTDGRYDRMGWPLVLKLKDWPPAKVFKDNLPRHAEEFLCSLPLKHYTHPVNGPLNLAVKLPQNCLKPDMGPKTYVASGFAQELGRGDSVTKLHCDMSDAVNILTHISEVPNMQPGIGNLKKKHAEQDLKELYSSVANKEEMMEILENSRQQVQNVETDDGALWDIFRREDIPKLESYIEKHHKEFRHLYCCPVSQVVHPIHDQNFYLTRYHIMKLKEEYGIEPWTFNRKLGDAVLIPVGCPHQVRNLKSCNKVALDFVSPENVSECLRLTKQYRLLPPNHFAKEDKLGVKKMIVHAVDKALRDLSGEKSPEPEEKKQNMRGPKKGAAKAVAKALKDLSPSEKKSSEAAEEEISNGIVNAIDKGLKDLPPSEEKSSEAKVEISNGIVSAMDKDLEHISSSEKKSTEEEGVKRPNIVRTYERRKKLGSEVTNAYIDRLEMEKM

SEQ ID NO: 425 - DNA, 1026 bp, Arabidopsis thaliana
atgggttcttcgtcgaacggaggagtgccacctggtttccggtttcatccgacggacgaagagcttctccattactacttgaagaagaaaatctcttaccaaaagtttgagatggaagtcatcagagaggttgacttaaacaagcttgagccttgggatttgcaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgaagatggatgggtggtatgtagagtgtttatgaagaaaaatttgttcaaggtagtaaatgaaggtagctcaagcattaactcattggaccaacacaaccatgacgcatctaacaacaaccatgcacttcaagctcgtagctttatgcaccgagacagtccataccagctagtacgtaaccacggagccatgacattcgaacttaacaagcctgaccttgctcttcatcaatacccaccaatcttccacaagccaccttcacttggatttgactactcttcaggacttgcaagggacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcgtcctctgtggttcagccagttcccgcgacgaaccagctaacattgcgtagtgagatggatttctggggttattctaaatag

SEQ ID NO: 426 - protein, 341 aa, Arabidopsis thaliana
MGSSSNGGVPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRLEDADDPQANPSEDGWVVCRVFMKKNLFKVVNEGSSSINSLDQHNHDASNNNHALQARSFMHRDSPYQLVRNHGAMTFELNKPDLALHQYPPIFHKPPSLGFDYSSGLARDSESAASEGLQYQQACEPGLDVGTCETVASHNHQQGLGEWAMMDRLVTCHMGNEDSSRGITYEDGNNNSSSVVQPVPATNQLTLRSEMDFWGYSK

SEQ ID NO: 427 - DNA, 786 bp, Arabidopsis thaliana
atgggaagaggaagggttcagctacggcggatcgagaataagataaggagacaagtgacattttcaaagcgaaggaccggtttggtaaagaaagctcaagagatctcagtgttatgtgatgctgaagttgctttgattgttttctcccccaaaggcaaactctttgagtactctgctggttccagcatggagagaattcttgatcgatatgagaggtctgcctacgccggtcaagatattcctacaccaaatttggattcacagggagagtgctcaacagaatgttcaaagctcttgaggatgattgatgtcctgcaaagaagcctgaggcacttaagaggagaagaggtggatggtctaagtatcagagaccttcaaggtgtggagatgcaacttgatactgccctcaagaaaactcgctctagaaagaaccagctcatggtagagtccatagcacagcttcagaaaaaggagaaggaactaaaagaactgaagaaacagctaacaaagaaggctggtgaaagggaagactttcaaacgcaaaacctcagccatgacttagcctccttggcaacaccgccatttgaatcaccccatgagcttcgccggacaatatctcctcctcctcctcctttatcttcgggggatacatcacaaagggatggagttggagaagtagctgccggaaccctaattcgaaggacgaatgcaacgttgcctcattggatgccccagctcaccggagaatagaggtccgaaacaatcttggttttttaaatttttctg

SEQ ID NO: 428 - protein, 249 aa, Arabidopsis thaliana
MGRGRVQLRRIENKIRRQVTFSKRRTGLVKKAQEISVLCDAEVALIVFSPKGKLFEYSAGSSMERILDRYERSAYAGQDIPTPNLDSQGECSTECSKLLRMIDVLQRSLRHLRGEEVDGLSIRDLQGVEMQLDTALKKTRSRKNQLMVESIAQLQKKEKELKELKKQLTKKAGEREDFQTQNLSHDLASLATPPFESPHELRRTISPPPPPLSSGDTSQRDGVGEVAAGTLIRRTNATLPHWMPQLTGE

SEQ ID NO: 429 - DNA, 1772 bp, Arabidopsis thaliana
agtcaagctctgaagtcgaagcaaagttaattacagagagagagaaaggatggagagagaactcagacgaccgaacccaatcaacagctctcgccggccggagatattttcttcaggcggtagtagtactcaactaccggaaagcccacgaggcccaatggagttcttgtctagatcctggagtgtctctgccttggaagtctccagagctctccacaccgccaaatcagcttcagccaccaacaggcctccctcatccattaacactccgataccggaagaaacgctaaaccctgagaaagaagaatgtccgccggagaacagtactagtgttagtagccagttctcgttcgctgcctcggccacttcacagcttgttcttgagcgcataatgtctcaatcggaggtgtcaccgttaacgtcggggaggctatcacacagcagcggcccactcaacggcggcggttcttttacggagacagacagtcctcctatctccccttccgatgaattcgacgacgtcatcaagtattttcgcacccacaacaccatacatcctctcttctccggcacaggaggcagccgtggtaccaccggaaatgggagcaatacccccatggctggaaccggtccaaagacagttggtaggtggctcaaggaccgtaaggaaaagaagaaagaagagactaggactcagaatgcacaggttcacgcagctgtttctgttgcagcggttgcatctgctgtggcagctgtagcagcagccacagcagcttcttcccctggtaagaacgagcagatggccagaatcgatatggccatggcttcagcggctgctctggtggctgctcagtgtgtggaggctgcagaaatcatgggagcagatagggatcatttgacatccgtggtgagctctgccgtgaatgttaagtcccatgacgatattgtcacccttactgcagctgctgcaacaggtactgcattaaaacgtagtcacccttacttctgtagagattccatacctgaattcacccccttttcttttgcagctctgcgaggagcagctacactcaaggcaagagcgcttaaggaagtatggaacatagctgcagtattgccagccgagaaaggggcaagttcagcgttgtgtggacaggttgacacaaagcatagtgatagcagctttagtggagaattacctgtggctggggaagacttccttggcgtctgtaaccaggaattactagctaaaggcactgagctcctcaaacgaactcgtggaggtgaactccactggaagattgtctctgtctacatcaacaaagcaggccaagctgtgctgaaaatgaaaagtaaacacgttggagggaccttcacaaagaagaagaaacatatggtgcttgaagtgagaaaggatatacctgcatgggctggcagagatcttttcaacggagacaagcatcactactttggcttaaagacagaaacaaagagggtcattgaatttgagtgcagaaaccaaagggaatacgagatatggactcagggcgtatccaggctacttgccattgctgctgagaagaagcagaaaagttccatgtccaaatggatggcaccttaacaacataagctaggaaagaagtagatgctttgtagaacgaactgcttatgataagaataggtttaaacataatggagtagaagacattcccttttgtaatatccttttattcaattgagtgaacagagatgacttctaaagctaacaacaa

SEQ ID NO: 430 - protein, 523 aa, Arabidopsis thaliana
MERELRRPNPINSSRRPEIFSSGGSSTQLPESPRGPMEFLSRSWSVSALEVSRALHTAKSASATNRPPSSINTPIPEETLNPEKEECPPENSTSVSSQFSFAASATSQLVLERIMSQSEVSPLTSGRLSHSSGPLNGGGSFTETDSPPISPSDEFDDVIKYFRTHNTIHPLFSGTGGSRGTTGNGSNTPMAGTGPKTVGRWLKDRKEKKKEETRTQNAQVHAAVSVAAVASAVAAVAAATAASSPGKNEQMARIDMAMASAAALVAAQCVEAAEIMGADRDHLTSVVSSAVNVKSHDDIVTLTAAAATGTALKRSHPYFCRDSIPEFTPFSFAALRGAATLKARALKEVWNIAAVLPAEKGASSALCGQVDTKHSDSSFSGELPVAGEDFLGVCNQELLAKGTELLKRTRGGELHWKIVSVYINKAGQAVLKMKSKHVGGTFTKKKKHMVLEVRKDIPAWAGRDLFNGDKHHYFGLKTETKRVIEFECRNQREYEIWTQGVSRLLAIAAEKKQKSSMSKWMAP

SEQ ID NO: 431 - DNA, 687 bp, Arabidopsis thaliana
atgggagaagagctttctgtagggtttcggttctatccgaccgaagtagagctccttacgtattacctaagaatccagcttggtggaggaaatgccaccattcatagtctcataccgatcctcgatgtgtttagcgttgagcctactcagcttccaaatcttgcgggagagaggtgtcgaggagatgcagaacaatggattttctttgtgccaagacaagagcgtgaagctagaggaggcagaccaagtaggaccactggttcaggatactggaaagcaactggttcacctggacccgtgttctcgccggataaccgagtgatcggagtaaagaagacgatggttttctataccggaaaagcacctactgggagaaagacaaagtggaagatgaatgaatataaagcagttgaaacagccagtgtatctaccatcccaaagtcaggaagctcgagagcctttgacagacgtcccacagaagcttatgcgatagagagaaatcttcctagcaatggagttgagacatcatctcgtgccacaatatcaacctcaccagaaacttcacattcaggaggaaaccaagttgatttaccggtgaatgctactactattacacaaagcatctcagatatggttgatgagctatcgcaacctttttgggagtgggaacaaatgaattggtcttaa

SEQ ID NO: 432 - protein, 228 aa, Arabidopsis thaliana
MGEELSVGFRFYPTEVELLTYYLRIQLGGGNATIHSLIPILDVFSVEPTQLPNLAGERCRGDAEQWIFFVPRQEREARGGRPSRTTGSGYWKATGSPGPVFSPDNRVIGVKKTMVFYTGKAPTGRKTKWKMNEYKAVETASVSTIPKSGSSRAFDRRPTEAYAIERNLPSNGVETSSRATISTSPETSHSGGNQVDLPVNATTITQSISDMVDELSQPFWEWEQMNWS

SEQ ID NO: 433 - DNA, 2169 bp, Arabidopsis thaliana
atgagtttcgtcgtcggcgtcggcggaagtggtagtggaagcggcggagacggtggtggtagtcatcatcacgacggctctgaaactgataggaagaagaaacgttaccatcgtcacaccgctcaacagattcaacgccttgaatcgagtttcaaggagtgtcctcatccagatgagaaacagaggaaccagcttagcagagaattgggtttggctccaagacaaatcaagttctggtttcagaacagaagaactcagcttaaggctcaacatgagagagcagataatagtgcactaaaggcagagaatgataaaattcgttgcgaaaacattgctattagagaagctctcaagcatgctatatgtcctaactgtggaggtcctcctgttagtgaagatccttactttgatgaacaaaagcttcggattgaaaatgcacaccttagagaagagcttgaaagaatgtctaccattgcatcaaagtacatgggaagaccgatatcgcaactctctacgctacatccaatgcacatctcaccgttggatttgtcaatgactagtttaactggttgtggaccttttggtcatggtccttcactcgattttgatcttcttccaggaagttctatggctgttggtcctaataataatctgcaatctcagcctaacttggctatatcagacatggataagcctattatgaccggcattgctttgactgcaatggaagaattgctcaggcttcttcagacaaatgaacctctatggacaagaacagatggctgcagagacattctcaatcttggtagctatgagaatgttttcccaagatcaagtaaccgagggaagaaccagaactttcgagtcgaagcatcaaggtcttctggtattgtcttcatgaatgctatggcacttgtcgacatgttcatggattgtgtcaagtggacagaactctttccctctatcattgcagcttctaaaacacttgcagtgatttcttcaggaatgggaggtacccatgagggtgcattgcatttgttgtatgaagaaatggaagtgctttcgcctttagtagcaacacgcgaattctgcgagctacgctattgtcaacagactgaacaaggaagctggatagttgtaaacgtctcatatgatcttcctcagtttgtttctcactctcagtcctatagatttccatctggatgcttgattcaggatatgcccaatggatattccaaggttacttgggttgaacatattgaaactgaagaaaaagaactggttcatgagctatacagagagattattcacagagggattgcttttggggctgatcgttgggttaccactctccagagaatgtgtgaaagatttgcttctctatcggtaccagcgtcttcatctcgtgatctcggtggagtgattctatcaccggaagggaagagaagcatgatgagacttgctcagaggatgatcagcaactactgtttaagtgtcagcagatccaacaacacacgctcaaccgttgtttcggaactgaacgaagttggaatccgtgtgactgcacataagagccctgaaccaaacggcacagtcctatgtgcagccaccactttctggcttcccaattctcctcaaaatgtcttcaatttcctcaaagacgaaagaacccgtcctcagtgggatgttctttcaaacggaaacgcagtgcaagaagttgctcacatctcaaacggatcacatcctggaaactgcatatcggttctacgtggatccaatgcaacacatagcaacaacatgcttattctgcaagaaagctcaacagactcatcaggagcatttgtggtctacagtccagtggatttagcagcattgaacatcgcaatgagcggtgaagatccttcttatattcctctcttgtcctcaggtttcacaatctcaccagatggaaatggctcaaactctgaacaaggaggagcctcgacgagctcaggacgggcatcagctagcggttcgttgataacggttgggtttcagataatggtaagcaatttaccgacggcaaaactgaatatggagtcggtggaaacggttaataacctgataggaacaactgtacatcaaattaaaaccgccttgagcggtcctacagcttcaactacagcttga

SEQ ID NO: 434 - protein, 722 aa, Arabidopsis thaliana
MSFVVGVGGSGSGSGGDGGGSHHHDGSETDRKKKRYHRHTAQQIQRLESSFKECPHPDEKQRNQLSRELGLAPRQIKFWFQNRRTQLKAQHERADNSALKAENDKIRCENIAIREALKHAICPNCGGPPVSEDPYFDEQKLRIENAHLREELERMSTIASKYMGRPISQLSTLHPMHISPLDLSMTSLTGCGPFGHGPSLDFDLLPGSSMAVGPNNNLQSQPNLAISDMDKPIMTGIALTAMEELLRLLQTNEPLWTRTDGCRDILNLGSYENVFPRSSNRGKNQNFRVEASRSSGIVFMNAMALVDMFMDCVKWTELFPSIIAASKTLAVISSGMGGTHEGALHLLYEEMEVLSPLVATREFCELRYCQQTEQGSWIVVNVSYDLPQFVSHSQSYRFPSGCLIQDMPNGYSKVTWVEHIETEEKELVHELYREIIHRGIAFGADRWVTTLQRMCERFASLSVPASSSRDLGGVILSPEGKRSMMRLAQRMISNYCLSVSRSNNTRSTVVSELNEVGIRVTAHKSPEPNGTVLCAATTFWLPNSPQNVFNFLKDERTRPQWDVLSNGNAVQEVAHISNGSHPGNCISVLRGSNATHSNNMLILQESSTDSSGAFVVYSPVDLAALNIAMSGEDPSYIPLLSSGFTISPDGNGSNSEQGGASTSSGRASASGSLITVGFQIMVSNLPTAKLNMESVETVNNLIGTTVHQIKTALSGPTASTTA

SEQ ID NO: 435 - DNA, 1575 bp, Arabidopsis thaliana
atggctgtgtattaccctaatagtgtcggcatgcaatctctttaccaagaatccatttacctcaacgaacaacaacaacaacaacaacaagcttcttcttcctctgctgcatctttctccgagattgtttccggtgatgttcgaaacaacgagatggtatttatcccaccaacaagcgacgtagccgtcaacggaaacgtaacggtgtcaagtaacgatctaagctttcacggtggaggactttctttaagtcttggtaatcagatccagtcagctgtctctgtttctccgtttcagtatcattaccagaatctttcgaaccaattgagttacaataatcttaatccttctactatgtctgatgagaatgggaagagcttgagtgttcatcagcatcactctgatcaaattttaccttcctctgtttacaacaacaatggtaataatggtgttggattctacaacaattaccgttacgagacatcagggtttgtgagtagtgtactgagatctcgttaccttaaaccaacacaacaattgcttgatgaagttgttagtgtaaggaaagatttgaaattggggaataagaagatgaagaatgataaaggtcaagactttcacaatgggtctagtgataacattacagaagatgataaatctcaatcgcaggagttgtctccttcagaacgtcaggagctacagagcaagaagagcaagcttttaacaatggtggatgaggtagataaaaggtataaccaataccatcatcaaatggaagctttagcatcgtctttcgagatggtaacaggtcttggagcagctaagccttacacatccgtagctctgaatagaatctctcgccatttccgctgtttacgcgacgcgataaaagaacagattcaggtgatcagagggaagcttggggagagagagacttctgatgaacaaggagagaggataccgcgtcttaggtacttagatcaacggttgagacaacagagagctttgcatcaacaacttggaatggttagaccagcttggagaccacaaagaggcttacctgaaaactctgtctctatacttcgagcttggctctttgagcatttccttcatccatatcctaaagaatcagagaaaatcatgctttcaaagcagacaggactatcgaaaaaccaggttgcaaattggtttattaacgcgagagttcgactatggaaaccaatgattgaagagatgtataaagaagagtttggagaatcagcagagttactctctaactctaatcaagacaccaaaaaaatgcaggaaacatctcagctcaaacacgaagactcttcgtcttcgcaacaacagaatcagggaaacaacaacaacaacatcccatatacatctgatgcagaacaaaacctagtctttgcagatcctaaaccagaccgtgctactactggagattacgacagcttgatgaactatcatgggtttggtattgatgattacaatcgttacgttggccttggaaaccaacaagatggcagatattctaatccccatcaattacacgactttgttgtctaa

SEQ ID NO: 436 - protein, 524 aa, Arabidopsis thaliana
MAVYYPNSVGMQSLYQESIYLNEQQQQQQQASSSSAASFSEIVSGDVRNNEMVFIPPTSDVAVNGNVTVSSNDLSFHGGGLSLSLGNQIQSAVSVSPFQYHYQNLSNQLSYNNLNPSTMSDENGKSLSVHQHHSDQILPSSVYNNNGNNGVGFYNNYRYETSGFVSSVLRSRYLKPTQQLLDEVVSVRKDLKLGNKKMKNDKGQDFHNGSSDNITEDDKSQSQELSPSERQELQSKKSKLLTMVDEVDKRYNQYHHQMEALASSFEMVTGLGAAKPYTSVALNRISRHFRCLRDAIKEQIQVIRGKLGERETSDEQGERIPRLRYLDQRLRQQRALHQQLGMVRPAWRPQRGLPENSVSILRAWLFEHFLHPYPKESEKIMLSKQTGLSKNQVANWFINARVRLWKPMIEEMYKEEFGESAELLSNSNQDTKKMQETSQLKHEDSSSSQQQNQGNNNNNIPYTSDAEQNLVFADPKPDRATTGDYDSLMNYHGFGIDDYNRYVGLGNQQDGRYSNPHQLHDFVV

SEQ ID NO: 437 - DNA, 761 bp, Arabidopsis thaliana
atgactttagaggagcagaagaaagtcataatgcccgaggccgtcgcatcggagccatcaccaccatccaaggaggagaagtccgacgattcgaaagctattgttctcgtcgtcgctgcaaaagaacctacggaagacaagaaagtaggttcagttcaccgagatgctgttttggttagactcgagcaagataagaggatatctctaatcaaagcttgggaagaggctgagaaatccaaagtggagaacaaagctcagaagaagatttcttcagttggagcttgggaaaacagcaagaaagcttctgtggaagctgagctaaaaaagatcgaggagcaactaaataagaagaaagcacactacacagagcaaatgaagaacaagatagctcaaatccacaaggaagctgaggagaagagagcgatgaccgaagctaaacgcggagaagatgttctcaaagccgaagaaatggctgcaaagtaccgtgccaccggaactgctccaaccaagctatttggattcttctgatcggagaaatggtctttgatgttgcattgtggtttcatttgttattaacttgagaaagaagagattattggtagttgaagtggttggtgtgggtttcatttggcaacataaaaagttacatggccataatgtaacgtcttattatgtttggagtaatgtgttttactcatgtgtaatttgtacagcttaaccttgagagacttcttttgaactttctaaacttaaactcccaa

SEQ ID NO: 438 - protein, 175 aa, Arabidopsis thaliana
MTLEEQKKVIMPEAVASEPSPPSKEEKSDDSKAIVLVVAAKEPTEDKKVGSVHRDAVLVRLEQDKRISLIKAWEEAEKSKVENKAQKKISSVGAWENSKKASVEAELKKIEEQLNKKKAHYTEQMKNKIAQIHKEAEEKRAMTEAKRGEDVLKAEEMAAKYRATGTAPTKLFGFF

SEQ ID NO: 439 - DNA, 1317 bp, Arabidopsis thaliana
atgacacttgctagcgattttggttttccatccgctatatcttcatcttttacaattctagaagagagataccacaataactttcctaacactttgtgtgtttcatcaggacaggaatcgatgaataacaaccccgtcccctgtcaggtgtttcctctggtctctggtggtagttctggtgggaatttgttttcatcttcttccggattctgcaatggtgtctatgtttcatcttcctcccaggcacggccatctgtttctaccgtgccaagagacagaattactgttgctcacgtctctggtgaagggcagaggcaggaatgccctgtggaaacacattccttgcaattgatcaatcaacctcaagaacagaaaattatgacttggtcttcagaccagattcggggcttcttcgattttcctgttccagatccacaagcagcgagcagcagaactatggtttcatccaaggaagtgctttcaaaatgcgaatggccagactgggcggatcagttgatctctgatgatagtcttgaaccaaattggtcggagcttctaggtgatcctaatgtactcaatctatattcaaaggttcaaacacagtcttctgatatagcaaggcaagagatcgtctttagaaatcagcatcaggtggatccatcaatggagccgtttaatgccaaaagcccaccagctagttcaatgacatctaagcaaagaatgcgttggacaccagaacttcatgaagcatttgtcgaagctatcaatcagctcggtggtagtgaacgagccacccctaaggctgttttgaagctcatcaatagccctgggttgaccgtttatcatgtcaaaagccatttgcagaaatacagaactgcaaggtataaaccagagctttccaaagatacagtaaagaatttgaaaaccattgaagatatcaaatctcttgacttgaagacgagcattgaaatcactgaagctctccggttacagatgaaagttcaaaaacaactccacgagcaacttgagatccaaagatcactgcagttacaaatcgaagaacaaggtcggtatcttcagatgatgattgagaaacaacagaagatgcaagagaacaaaaaagactctacttcctcatcatcaatgccagaagctgacccttcagctccatcaccaaacctttcacaacctttcctccataaagcaaccaattcagaaccatcaataactcagaaactgcagaatggttctagcacaatggatcaaagtgaatctacttctgggactagtaatagaaaacgggttagagaagattag

SEQ ID NO: 440 - protein, 438 aa, Arabidopsis thaliana
MTLASDFGFPSAISSSFTILEERYHNNFPNTLCVSSGQESMNNNPVPCQVFPLVSGGSSGGNLFSSSSGFCNGVYVSSSSQARPSVSTVPRDRITVAHVSGEGQRQECPVETHSLQLINQPQEQKIMTWSSDQIRGFFDFPVPDPQAASSRTMVSSKEVLSKCEWPDWADQLISDDSLEPNWSELLGDPNVLNLYSKVQTQSSDIARQEIVFRNQHQVDPSMEPFNAKSPPASSMTSKQRMRWTPELHEAFVEAINQLGGSERATPKAVLKLINSPGLTVYHVKSHLQKYRTARYKPELSKDTVKNLKTIEDIKSLDLKTSIEITEALRLQMKVQKQLHEQLEIQRSLQLQIEEQGRYLQMMIEKQQKMQENKKDSTSSSSMPEADPSAPSPNLSQPFLHKATNSEPSITQKLQNGSSTMDQSESTSGTSNRKRVRED

SEQ ID NO: 441 - DNA, 2094 bp, Arabidopsis thaliana
tgccactgtttcagcaaaaacggtcacaaaaaatatgataaatgtgatgaatccaatgaaaggtggaacagagaaaggtttagatcctcagctatggcatgcatgtgctggtggtatggttcgtatgcctcctatgaactctaaagtcttttactttcctcaaggtcacgccgaaaacgcttacgattgtgtcgatttcggtaatctccctattcctcccatggttttgtgtcgtgttttagccattaagtatatggctgatgctgaatctgacgaggttttcgctaaactgagattgattcctttgaaagatgatgagtatgttgatcacgagtatggtgatggtgaagatagtaacggtttcgagagtaatagtgagaaaacgccttcgtttgctaagactttgactcagtctgatgctaataacggtgggggtttctctgttcctcgttattgcgctgagacgattttcccgaggttggattataacgccgagccgccggttcagaccattcttgctaaggatgttcatggtgatgtttggaagttcagacatatttatagagggacgcctcggcgtcaccttcttacaaccggatggagtaattttgtaaaccagaagaagcttgtggcgggagattcgattgtcttcatgagagcggagaatggagatctttgtgtaggtattaggagggctaagagaggagggataggtaatggacccgaatattcagcgggttggaatccgatcggtggaagttgcggctactcttctctgttaagggaagatgaaagcaatagtttgaggagaagtaattgttcccttgcggataggaaggggaaagtgacggctgaatctgttatagaagcagccactcttgctattagcggaagaccgtttgaggttgtgtactatccgagagctagcacttcagagttttgtgtcaaggcattagatgctcgagctgccatgcggattccgtggtgctcaggtatgaggtttaagatggcttttgagacagaggattcgtctcggataagttggtttatggggactgtttcagctgttaatgtctctgatcctatccgttggcctaactctccttggcggcttctacaggtggcgtgggatgagccagatttactccaaaacgtgaagcgagttaacccgtggttggtggaattggtatcaaacgtacatccgatcccgcttacttcgttttcgccaccgaggaaaaagatgcggctacctcagcatccagattacaacaatctgatcaattcgattccagtaccttcattcccaagcaatccccttattagatcaagcccgttaagctctgttctggacaatgttcccgtgggtttacagggagccaggcataatgctcatcagtactacgggttatcatcttcggatcttcaccattactacttgaatagaccacctcctcctcctcctccatcctctctccaactttctccttctctcggtctccgaaacatcgataccaaaaacgaaaaaggattttgctttttgacaatgggaacaacaccatgcaatgataccaaatctaaaaagtcccatattgtattgttcggcaagcttatactacccgaggaacagctatcagaaaaaggctcaacggataccgcaaacatagagaaaacgcagatttcatcaggcgggtcgaaccaaaacggcgttgcgggaagggagttttcttcgtcagatgaaggatcaccttgctctaagaaagttcatgatgcatcaggtttggaaacagggcattgtaaagtgtttatggagtcagacgatgtaggtcgaaccttagacctatcggttcttggttcatacgaagaattgagtcggaaactctctgacatgtttggaatcaaaaagtctgagatgttaagctctgttctctatagggatgcatcaggagccatcaaatacgcaggaaacgaacctttcagtgagttcttgaagacagctcgaagattgacaattctgacggaacaaggaagtgagagcgttgtagtataacttggcagagtgttttgttggagcttggaagtcaaaactcaacgatt

SEQ ID NO: 442 - protein, 670 aa, Arabidopsis thaliana
MINVMNPMKGGTEKGLDPQLWHACAGGMVRMPPMNSKVFYFPQGHAENAYDCVDFGNLPIPPMVLCRVLAIKYMADAESDEVFAKLRLIPLKDDEYVDHEYGDGEDSNGFESNSEKTPSFAKTLTQSDANNGGGFSVPRYCAETIFPRLDYNAEPPVQTILAKDVHGDVWKFRHIYRGTPRRHLLTTGWSNFVNQKKLVAGDSIVFMRAENGDLCVGIRRAKRGGIGNGPEYSAGWNPIGGSCGYSSLLREDESNSLRRSNCSLADRKGKVTAESVIEAATLAISGRPFEVVYYPRASTSEFCVKALDARAAMRIPWCSGMRFKMAFETEDSSRISWFMGTVSAVNVSDPIRWPNSPWRLLQVAWDEPDLLQNVKRVNPWLVELVSNVHPIPLTSFSPPRKKMRLPQHPDYNNLINSIPVPSFPSNPLIRSSPLSSVLDNVPVGLQGARHNAHQYYGLSSSDLHHYYLNRPPPPPPPSSLQLSPSLGLRNIDTKNEKGFCFLTMGTTPCNDTKSKKSHIVLFGKLILPEEQLSEKGSTDTANIEKTQISSGGSNQNGVAGREFSSSDEGSPCSKKVHDASGLETGHCKVFMESDDVGRTLDLSVLGSYEELSRKLSDMFGIKKSEMLSSVLYRDASGAIKYAGNEPFSEFLKTARRLTILTEQGSESVVV

SEQ ID NO: 443 - DNA, 1866 bp, Arabidopsis thaliana
atggcttctgctcaatctttctacaaccaaagctctgtcttgaaaatcaatgtcatggttgtggacgatgatcatgttttccttgatatcatgtcacgcatgcttcaacactccaaatacagagatccatcagttatggagatcgcagttatagctgtagacgatccgaagaaagcattatctactctaaaaattcaacgagacaatatagatctcataatcacagattattatatgcctggtatgaacggtttacaactcaaaaaacaaatcactcaggaatttggaaatttaccggtcttagttatgtcatcggacaccaacaaagaagaggagagtttaagttgtggagcgatgggtttcattccaaaacccatacatcctactgacttaacaaagatttaccagtttgctttaagcaacaagaggaacggtaagtcaacactatcgaccgagcaaaaccacaaggacgcagatgttagtgtccctcagcaaatcacgttggttcctgagcaagctgacgtcttaaagaccaagaggaagaactgctcatttaaatcggattcaagaaccgtgaacagtacaaatggaagttgtgttagtacggatggttcaagaaaaaatcgaaaaagaaaacccaacggtggtcctagtgatgatggcgagtctatgtcgcaacccgcgaaaaagaaaaagattcagtggacggattctcttcacgacctattcttacaggctatccgacatattggtcttgataaggcggtgccaaaaaagatcctagcgttcatgagcgtaccatacttgacaagagagaacgtagccagccatttacagaaatatcggatattcttgagaagagttgcggagcagggtttgtatagcatgttgtcggatagaggcatagactcgatgtttcgacaaactcacattaaggagccgtacttcaactattacacaccatctacttcttggtatgacacaaggcttaacaatagatcattctattccaaacccgtacatggctttggacagtctaaactcttgtccacaacacgtgagcccgtctgcttcaaccagatgccttacaactacatgaaccggtcatccacctatgagccgcaccgtattggatctggatcaaacttgacgctgcccatccagagcaacctcagtttcccaaaccaaccatctcaaaacgaagaaagaagaagctttttcgaaccacccgtgatggcaaacaaaatcgcccaaacatctcaagttcttgggtttggacaacttggaccgtcagctatcagtggtcataatttcaacaataacatgacgagtagatatggaagtttgattccgagccaaccgggacctagccacttctcctatgggatgcaatcgttcttaaacaatgagaacgtaacatataaccctcagccacctgccaatgcaactacacagccaaatcttgatgaacttcctcaactggagaatctcaacttatacaatgatttcggcaacactagtgagcttccttacaacataagtaactttcaattcgatgacaacaagcatcaacaaggagaagcggatcccaccaaatttgagctcccagctgcaaaattttcgactgaactgaatcatgaagacgatggtgactggaccttcgtgaacataaaccagggtcaatctaatggagaaacatcgaacactattgcttctccggagactaatactccaattttgaacattaaccataatcagaatcagggacaagatgttccagagtttaacgattggtcgtttttggatccacaggaattggttgatgacgacttcatgaactctctgttcaacaatgacatgaattga

SEQ ID NO: 444 - protein, 621 aa, Arabidopsis thaliana
MASAQSFYNQSSVLKINVMVVDDDHVFLDIMSRMLQHSKYRDPSVMEIAVIAVDDPKKALSTLKIQRDNIDLIITDYYMPGMNGLQLKKQITQEFGNLPVLVMSSDTNKEEESLSCGAMGFIPKPIHPTDLTKIYQFALSNKRNGKSTLSTEQNHKDADVSVPQQITLVPEQADVLKTKRKNCSFKSDSRTVNSTNGSCVSTDGSRKNRKRKPNGGPSDDGESMSQPAKKKKIQWTDSLHDLFLQAIRHIGLDKAVPKKILAFMSVPYLTRENVASHLQKYRIFLRRVAEQGLYSMLSDRGIDSMFRQTHIKEPYFNYYTPSTSWYDTRLNNRSFYSKPVHGFGQSKLLSTTREPVCFNQMPYNYMNRSSTYEPHRIGSGSNLTLPIQSNLSFPNQPSQNEERRSFFEPPVMANKIAQTSQVLGFGQLGPSAISGHNFNNNMTSRYGSLIPSQPGPSHFSYGMQSFLNNENVTYNPQPPANATTQPNLDELPQLENLNLYNDFGNTSELPYNISNFQFDDNKHQQGEADPTKFELPAAKFSTELNHEDDGDWTFVNINQGQSNGETSNTIASPETNTPILNINHNQNQGQDVPEFNDWSFLDPQELVDDDFMNSLFNNDMN

SEQ ID NO: 445 - DNA, 1193 bp, Arabidopsis thaliana
attaaatagatctttaaacaaaaaaaccaaattctacttttctttcaaaaacaatctctcattatctcaatcttactcttgttcaatctcttttgaacttgaaaaaccatcattctatcaaatcaaacacaattgttagggtttctttttatcttatactccacgaaacgtctggttgagaaaaaatggaagaaagcaatgatatttttcagaacaatttcagtcctaaaatctcagaaatcagagcatctctgtctcagatcatattagcaggaggaccaaacacactcgactcaatcttctcacttctcactccctcctccgtagaatccgccacaacatcattcaacactcacaatcctccgccaccgccgcagctcgggtcctccgtctatctccgccaacgagatatcatcgagaagttccaccttcagaacagagcaatctccactcctcatcctcctctgttttcctcaacgtacgatcatcatcaaacttccgagctaatgctccaagcggcggccgggtctccagccgccgctttcgccgctgcgttagcggctgggagggtgacgaaaaagaagaaactttacagaggagtgaggcagagacattggggaaaatgggttgcggagataagattgccgcaaaacagaatgagggtttggttaggtacttacgacacggcggaagccgccgcttacgcttacgatcgcgccgcctataagctccgtggagaatacgctcgtctcaattttcctaatctcaaagacccgagtgagctactcggactcggagattcctctaagctaatagctctcaagaacgccgtcgacgggaagatccaatccatttgccagagagtcagaaaagagagagcaaaaaagagcgtaaaagtgagcaaaaactcgtcggccacggcggattcttcgtgtttgtcatcgccggagattctgtcgtcgtctccggtgacgacaactactactgcggttacttcagaggatagttattgggtttcacctatgggtttgtgtaacagtgaaaatagttctccggtatcagtttcggtccctagtgaagtaccggcgacggcggaggaagaggcaatgatgggagtggacactgatgggtttttattagcgaggatgccatcgttcgatccagagctgatttgggaagttcttgccaattaa

SEQ ID NO: 446 - protein, 335 aa, Arabidopsis thaliana
MEESNDIFQNNFSPKISEIRASLSQIILAGGPNTLDSIFSLLTPSSVESATTSFNTHNPPPPPQLGSSVYLRQRDIIEKFHLQNRAISTPHPPLFSSTYDHHQTSELMLQAAAGSPAAAFAAALAAGRVTKKKKLYRGVRQRHWGKWVAEIRLPQNRMRVWLGTYDTAEAAAYAYDRAAYKLRGEYARLNFPNLKDPSELLGLGDSSKLIALKNAVDGKIQSICQRVRKERAKKSVKVSKNSSATADSSCLSSPEILSSSPVTTTTTAVTSEDSYWVSPMGLCNSENSSPVSVSVPSEVPATAEEEAMMGVDTDGFLLARMPSFDPELIWEVLAN

SEQ ID NO: 447 - DNA, 1647 bp, Arabidopsis thaliana
atggaggttcttttgaaattaccctcttcagagtctcctcttaaggataaatttggatctgttcaaatccatgaagctaataagggtgatggtgatcatcaagaacttgaatctgccaaggcagagatgagcgaggtgaaggaagagaacgagaagcttaaaggaatgctcgaacgaattgaaagtgattacaaatctctcaagctcagattcttcgacataattcaacaagaaccttcaaacaccgcaactaaaaatcaaaacatggttgatcatcccaagccaacgacgacggatttgagttcttttgaccaagaacgcgagcttgtatcgctttcactagggagaagaagttcttccccaagtgatagcgtccccaaaaaggaagagaaaacggacgcaatcagcgcagaagtcaacgctgacgaagagttgactaaggccggcttgaccttagggatcaataatggcaacggaggtgaaccgaaagagggtttatctatggagaatcgtgcaaattctggctcggaagaagcttgggcgccaggtaaagttacggggaagagaagctctccagcaccagcctccggtggcgatgctgacggtgaggccggtcaacaaaaccatgttaagagagctagagtttgtgttagagcaagatgtgacacaccaacgatgaatgatggttgtcaatggagaaaatatggacaaaagattgcgaaaggaaatccatgtccacgagcatattatcgctgcacggttgcacctggatgtcccgttagaaaacaggtccaaagatgtgcagatgacatgtctatactaatcacaacctatgaaggaacacacagccactctcttccactctcagccaccaccatggcttccaccacatcagccgctgcctccatgctcctctctggctcctcctcctcaccagccgctgaaatgatcggaaataacctctacgacaattcaagattcaacaacaacaacaaatccttctattcacccacccttcactccccattacatcccaccgtcactctagacctcactgctccacaacactcttcctcgtcttcttcttcattgctttctttaaatttcaacaaattctcgaactctttccaaagattcccatctacaagcctaaatttctcttctacttcatcaacatcatcaaacccgtctactctcaacctacccgcgatttggggtaatgggtattcttcttatactccatatccttacaacaacgtccaatttgggacgtccaacctaggaaaaacagtccaaaatagccagtccttaaccgaaaccctaacaaaagcgcttacttccgacccaagtttccactcggtgatcgctgctgccatctcaactatggtcggatcaaatggagaacaacagattgtcggtccacggcattcgattagcaataacattcaacaaaccaacacgacgaataataacaaaggatgtggaggctattttagcagcttattgatgtctaacattatggcgagtaatcaaacgggtgcttctttggatcaaccatcgtcgcaacttcctcccttctctatgttcaagaattcttcttcttcgtcttctacgactaatttcgtgaacaaggaagagaaaagctag

SEQ ID NO: 448 - protein, 548 aa, Arabidopsis thaliana [sequence omitted]

SEQ ID NO: 449 - DNA, 849 bp, Arabidopsis thaliana
atggatgatcatgttgagcacaattataacacatctttagaagaagtacacttcaagagcttaagtgattgcttacaaagctcattagtaatggattataactcactagagaaggtcttcaaattctcaccttatagttccccttttcaatcggtttcaccgtcagtaaacaacccttacttaaatctcacttcgaattctccggtggtctcatcttcctccaatgaaggcgagcctaaagagaacaccaacgataagagtgaccaaatggaggataacgaaggcgacctacatggtgttggtgaaagctccaagcaactgacaaaacaaggtaaaaagaaaggagagaagaaagagagagaagttagggttgcatttatgaccaaaagcgagattgatcatcttgaagatggttatagatggcgaaaatatggacaaaaagcagtgaagaacagcccttatccaaggagttactataggtgcacaacacagaagtgtaacgtgaagaaacgtgtagagagatcgtttcaagatccgtcgatcgtaattacaacctacgaaggaaaacacaaccatccgatcccatcgacgttgagaggaaccgtggcagctgaacatctactagtccaccgtggtggtggaggcagtttactccatagcttccctcgtcaccatcaagattttctcatgatgaaacattctccggccaattatcaatcggtgggatctctgtcgtacgaacatggccatgggacctctagttacaattttaataataatcaaccagttgttgactatggtcttcttcaggacattgttccttcaatgttctccaagaacgagtcttga

SEQ ID NO: 450 - protein, 282 aa, Arabidopsis thaliana
MDDHVEHNYNTSLEEVHFKSLSDCLQSSLVMDYNSLEKVFKFSPYSSPFQSVSPSVNNPYLNLTSNSPVVSSSSNEGEPKENTNDKSDQMEDNEGDLHGVGESSKQLTKQGKKKGEKKEREVRVAFMTKSEIDHLEDGYRWRKYGQKAVKNSPYPRSYYRCTTQKCNVKKRVERSFQDPSIVITTYEGKHNHPIPSTLRGTVAAEHLLVHRGGGGSLLHSFPRHHQDFLMMKHSPANYQSVGSLSYEHGHGTSSYNFNNNQPVVDYGLLQDIVPSMFSKNES

SEQ ID NO: 451 - DNA, 1276 bp, Arabidopsis thaliana
ccaaaaaaaaacttactcatcataagatatctttaaccaaaaccctaaaagaaacctcctttcaaaaaaaccatttcttcatcatcatgtcaacctccaaaaccctagaccataataaaccatttgaaacatcccaaacgcaaatgggttttgctctgatccaccaaaacacatccgccaacacaaccaccaccaccacaaccggcgagagacgaggccggagatcaaagcaagcggagccagggaggttcctaggagtccggagacgtccatggggtcgttacgcagccgagataagagatccaaccaccaaagaacgtcactggctaggcactttcgacacagctcacgaagctgctcttgcctacgatagagctgctctttcaatgagaggtactcaagctcgaaccaacttcgtctacactccaactgatgtccacaccatcctcacaaaccctaatctccactctctcattgtctctccttacaataacaaccaatctttcttaccaaactcttctccacagtttgtcatcgatcatcatcctcattatcaaaactatcatcaaccacaacaacctaaacacactctcccccaaactgtcttacccgcggcttctttcaaaacgccagttcgtcatcaaagcgtggatattcaagcgtttggtaatagtcctcaaaactcatcttctaacggctcgttatcttcttcactagacgaagaaaacaacttcttcttctctttaacaagcgaagaacataataagtccaataacaactcgggttacttggattgcattgtcccaaaccactgccttaaaccacctccggaggccaccaccacccaaaatcaagccggagctagtttcacaactccggtagcaagcaaagcctctgaaccatatggagggtttagtaatagctacttcgaagatggtgagatgatgatgatgaatcatcatgagtttggttcgtgtgatctctctgccatgatcacgaactatggtgctgctgccgcttcaatgtcaatggaagattacgggatgatggagccgcaagatttatcttcttcttctatcgctgcttttggagatgtcgttgcagacactacaggcttctactcagtcttttagaacattctatattatatatgttttttatatatgcaataatattattagtatttacgttattcgatggtcgtttgattgttgttgttaactatatgttatcgactttattatataaatcctgcttattgtttcatgcatcataa

SEQ ID NO: 452 - protein, 348 aa, Arabidopsis thaliana
MSTSKTLDHNKPFETSQTQMGFALIHQNTSANTTTTTTTGERRGRRSKQAEPGRFLGVRRRPWGRYAAEIRDPTTKERHWLGTFDTAHEAALAYDRAALSMRGTQARTNFVYTPTDVHTILTNPNLHSLIVSPYNNNQSFLPNSSPQFVIDHHPHYQNYHQPQQPKHTLPQTVLPAASFKTPVRHQSVDIQAFGNSPQNSSSNGSLSSSLDEENNFFFSLTSEEHNKSNNNSGYLDCIVPNHCLKPPPEATTTQNQAGASFTTPVASKASEPYGGFSNSYFEDGEMMMMNHHEFGSCDLSAMITNYGAAAASMSMEDYGMMEPQDLSSSSIAAFGDVVADTTGFYSVF

SEQ ID NO: 453 - DNA, 792 bp, Arabidopsis thaliana
atgaactcttgccaacaaaaggctatggagaagttgcttcacgggcatgggtgcgccaaccagctgctcatcatggaccagaccgagtcagactcgtccatggaaagggaggatttggccaagtccgtcctccattgtttctcagatgcgctctccatcttgatcgatactaatgaccaccaagacgatcaatccaataactcatctcctcaggactcttctcctgtgcttgagagctccaggaaaccacttcacaagaggggaagaaagacatctatggcagagagctcagactaccatagacacgaatcttcaaccccgatctaccacgacggcttcctctggaggaaatacggacaaaagcagatcaaagaatctgagtaccaaaggagttactacaagtgtgcctacaccaaggaccagaactgtgaagcaaagaagcaggttcaaaagatccaacacaatcctccattgtactcaaccacttacttcggccagcacatatgccagcttcatcaagcttatgcaactttccccattgacacatctgacttcgaagagcacgagggatcccacatgatccgattcggtcaccccaatatcagcttctcctcctccacctctaacctccgccaacatcagaatcatcaggatcgcatcaaagatgaatacatgaaaccggtgatagcagaagattggtctccatcccagtggatgtcgtccgaggttgccctcgccgtggaggctttcgagtttaatcctttctggacatctcacgacttatcatcatga

SEQ ID NO: 454 - protein, 263 aa, Arabidopsis thaliana
MNSCQQKAMEKLLHGHGCANQLLIMDQTESDSSMEREDLAKSVLHCFSDALSILIDTNDHQDDQSNNSSPQDSSPVLESSRKPLHKRGRKTSMAESSDYHRHESSTPIYHDGFLWRKYGQKQIKESEYQRSYYKCAYTKDQNCEAKKQVQKIQHNPPLYSTTYFGQHICQLHQAYATFPIDTSDFEEHEGSHMIRFGHPNISFSSSTSNLRQHQNHQDRIKDEYMKPVIAEDWSPSQWMSSEVALAVEAFEFNPFWTSHDLSS

SEQ ID NO: 455 - DNA, 765 bp, Arabidopsis thaliana
atggtttccaacattgatcacaaggctatggaagcactcctccgtggccaaggatgcgctaacaacctcaagattctccttgaaaacggcgaaataagctcagtttcaacagaaccactcatccacaccattctcgattctttctcacttgctctgtcttttatggattctcctaatcatccaccataccatgaatcctcttctcataacatggcaagtcatatgtcccggagatcatctaagcaagtacaacatcgcagaaaactttgtgtagcagaaggtttagtgaattacaatcacgattcccggactatgtgccccaatgatggcttcacctggaggaaatatggacaaaaaaccattaaagcctcagcgcacaaaaggtgttactatcggtgtacctatgcaaaagaccaaaactgcaatgctacaaagcgggtgcagaagatcaaagacaaccctccagtgtacagaaccacttacttgggaaaacatgtgtgtaaagcttttgcagttcatgatgatacatatagttccacgatgattcgattcgaccaagttgttcctgaaccgattatgccgcagctcacaacaattgaccaccaagtaattaccgtggaggaaaactccgcagaacatatcatgaaccaagaatgtgatattaatgattatttggtggatgatgacccattttgggctagtcaatttcccccgtttccatcgagtgacacaatgttcttggaaaacatttctgcttttgattag

SEQ ID NO: 456 - protein, 254 aa, Arabidopsis thaliana
MVSNIDHKAMEALLRGQGCANNLKILLENGEISSVSTEPLIHTILDSFSLALSFMDSPNHPPYHESSSHNMASHMSRRSSKQVQHRRKLCVAEGLVNYNHDSRTMCPNDGFTWRKYGQKTIKASAHKRCYYRCTYAKDQNCNATKRVQKIKDNPPVYRTTYLGKHVCKAFAVHDDTYSSTMIRFDQVVPEPIMPQLTTIDHQVITVEENSAEHIMNQECDINDYLVDDDPFWASQFPPFPSSDTMFLENISAFD

SEQ ID NO: 457 - DNA, 1567 bp, Arabidopsis thaliana
gagaaaaaacagcaaagaaaatcagagagatcaaaaaaaagaaaaaaaagaacagagattcttttgaactaacgaagacatatcgtttctctaaagtagaatctttggtattcggaaaaatgtcgtttctgagtattgttcgtgatgttagagatactgtaggaagcttttcgagacgtagtttcgacgtgagagtatctaatgggacgactcatcagaggagtaaatctcacggtgttgaggcacatattgaagatcttattgtaatcaagaacactcgttgggctaatttaccggctgcgctattacgagatgtgatgaaaaagttggatgaaagcgagagtacttggcctgcacgtaaacaagtcgttgcttgtgctggtgtctgcaagacatggagactaatgtgcaaagatattgtgaaaagtcctgagttctcaggcaaactcacatttccagtttcgttgaaacagcccgggcctagggatggaatcatacaatgttatatcaaaagagacaagtctaacatgacttaccacctttacctttctcttagtcctgccatacttgttgaaagtgggaagtttcttctctcggcaaagcgctcacggagagctacatacacagagtatgtaatatcaatggatgcagacaacatttcaagatcaagcagcacttacattggcaaactgaagtctaactttctagggacaaaatttatagtatatgatacggctcctgcgtacaacagtagccagatattgtccccaccaaaccggagtcgtagtttcaactccaagaaagtgtctcccaaagtcccttctggaagttacaacattgctcaagttacatacgagctgaacttgcttggaacccgtggacctcgtagaatgaactgcattatgcactctatcccctccttagctctagaacccggaggtactgtccctagccaacctgagtttctacaacgttcccttgatgaatctttccgcagcatcggttcctcaaagatagtcaaccactcgggagatttcacccgaccgaaagaggaagaaggaaaggtgcgacctttggtactgaaaactaaaccgccaaggtggctccaaccgttgcgatgttggtgccttaacttcaaagggagagtgactgtagcttctgtcaagaacttccagttgatgtccgctgcaacggttcagcccggtagtggtagtgatggtggagcattggctacgaggccatcgttatcaccacagcagccagagcaatcaaaccatgataagataatactacactttgggaaagtgggtaaggatatgttcactatggactatcgttatcctctctctgcctttcaagcgtttgccatttccctgagcacctttgatactaaattggcatgtgaataaaagtagaaagatcataagagggacttaaaactaataggaaccgtttacgatatgcgagggtttgtttgtttttgtttatctgtctgatctggtgtgttagtgaatgtgaacttttgtggttgtttatcttcgaaaagaaaaaataagtgttggtgacc

SEQ ID NO: 458 - protein, 429 aa, Arabidopsis thaliana
MSFLSIVRDVRDTVGSFSRRSFDVRVSNGTTHQRSKSHGVEAHIEDLIVIKNTRWANLPAALLRDVMKKLDESESTWPARKQVVACAGVCKTWRLMCKDIVKSPEFSGKLTFPVSLKQPGPRDGIIQCYIKRDKSNMTYHLYLSLSPAILVESGKFLLSAKRSRRATYTEYVISMDADNISRSSSTYIGKLKSNFLGTKFIVYDTAPAYNSSQILSPPNRSRSFNSKKVSPKVPSGSYNIAQVTYELNLLGTRGPRRMNCIMHSIPSLALEPGGTVPSQPEFLQRSLDESFRSIGSSKIVNHSGDFTRPKEEEGKVRPLVLKTKPPRWLQPLRCWCLNFKGRVTVASVKNFQLMSAATVQPGSGSDGGALATRPSLSPQQPEQSNHDKIILHFGKVGKDMFTMDYRYPLSAFQAFAISLSTFDTKLACE

SEQ ID NO: 459 - DNA, 629 bp, Arabidopsis thaliana
atgcctcctgagcttctgagagatgttctgatgaggatagagcgatccgaagacacttggccttctaggaagaatgttgtttcttgtgtaggtgtgtgtaagaactggcgacaaatattcaaagagatcgttaacgttcctgaggtttctagcaaattcacttttccaatctccttgaaacagcctggtccaggaggatcacttgttcaatgctatgttaagagaaaccgtagcaatcaaactttctatctataccttggaggtgaagcaaaaatattttgtcagtctgaaccaagtgagcctaataagtcaatctggaaactatccttaaaacctggaggaacagctacaactcagacagaactcgataatttcgtgtcattcaggtctccttctggtcaaaaggaaggagtgcttgttcttaagagcaaagtgcctagattggaagaacagagctggtgtctcgacttcaatgggtggagagacattgtgtcttccggaaaaaaatttcagctagtagctctcctgagaacgaacctgagaatgaaaacgacattttccagtttgcgaaagtcggaaacttgcacaaactcttcagtttagttagaaaacttgtgaaatgtgtttaa

SEQ ID NO: 460 - protein, 200 aa, Arabidopsis thaliana
MPPELLRDVLMRIERSEDTWPSRKNVVSCVGVCKNWRQIFKEIVNVPEVSSKFTFPISLKQPGPGGSLVQCYVKRNRSNQTFYLYLGGEAKIFCQSEPSEPNKSIWKLSLKPGGTATTQTELDNFVSFRSPSGQKEGVLVLKSKVPRLEEQSWCLDFNGWRDIVSSGKKFQLVALLRTNLRMKTTFSSLRKSETCTNSSV

SEQ ID NO: 461 - DNA, 1419 bp, Arabidopsis thaliana
cctttttccacctaaactcgttatatctttaaaagactcagcctttaagtatccccagaagtcgtatgaccttacgtagcttaatccttgagatgcgttcgagaccgcatcgtgtggtccacgaccttgccgccgccgcagctgccgattccacttctgtgtcatcgcaagattatcgctggtcagagattcctgaagagcttcttagggagattctgattcgtgttgaagcggcggacggtggcggatggccgtcacgacgcagcgtggtggcttgtgccggcgtttgtcgtggctggcggctacttatgaacgaaaccgtcgttgtccctgagatctcttctaagttgactttccccatctctctcaagcagcctggtccaagggattcactggttcaatgctttatcaaacgtaatcgaattacgcaatcatatcatctctatctcggattaaccaactctttaacggatgatgggaagtttttgcttgctgcgtgtaagttgaagcacacaacttgtacggattacattatctctttacgttctgatgatatgtcgagaagaagccaagcttatgttggcaaagtgagatcgaacttcctaggaacgaaattcactgtctttgatggaaatctgctgccttcaacgggagccgcaaagttgagaaagagccgatcttataatcccgcaaaagtttcagcaaaagttcctcttggaagttatcctgtcgctcatatcacatatgagctgaatgtcttaggatcccggggaccaagaaagatgcaatgtcttatggacacaatacctacaagcacaatggagcctcaaggagtagcttcagaaccatcagagtttcccttactcggtactcggtcaaccttatccaggtctcagtcaaaaccattacgcagtagctcaagccacctgaaagaaacaccattagtgctgagcaacaagacaccacggtggcacgagcagctacgctgctggtgcttgaatttccatggccgtgtcacagtagcgtcagtgaagaactttcagctcgtggcagcaggagctagctgtggcagtggcacgggaatgtcaccggagaggcagagcgagcggattatattgcagtttgggaaagtcgggaaagatatgttcacgatggattatggatacccgatctcagctttccaggcttttgccatttgcttgagcagctttgagactagaatcgcttgtgaatgatttacaagactttgttaagatatcgctatatctatcttgtaaagagcaatttgtagccttttgtaaattgtgttctttttaaaaacaacgagtcgttgtcttgtgtttgataatgttacagttccttttgttttgtagcttttttgtacattgtgatcttgcaagaaaatcaactctattgcta

SEQ ID NO: 462 - protein, 389 aa, Arabidopsis thaliana
MTLRSLILEMRSRPHRVVHDLAAAAAADSTSVSSQDYRWSEIPEELLREILIRVEAADGGGWPSRRSVVACAGVCRGWRLLMNETVVVPEISSKLTFPISLKQPGPRDSLVQCFIKRNRITQSYHLYLGLTNSLTDDGKFLLAACKLKHTTCTDYIISLRSDDMSRRSQAYVGKVRSNFLGTKFTVFDGNLLPSTGAAKLRKSRSYNPAKVSAKVPLGSYPVAHITYELNVLGSRGPRKMQCLMDTIPTSTMEPQGVASEPSEFPLLGTRSTLSRSQSKPLRSSSSHLKETPLVLSNKTPRWHEQLRCWCLNFHGRVTVASVKNFQLVAAGASCGSGTGMSPERQSERIILQFGKVGKDMFTMDYGYPISAFQAFAICLSSFETRIACE

SEQ ID NO: 463 - DNA, 549 bp, Arabidopsis thaliana
tcgacgagattgagagaagagatttatccaaaaaaatattgcaattcttcttggagtgaataatgccagtccctcttgcaccatatccaacacctccggcaccggcactggctccgtcgtacaacactcctccggcaaatggaagtacaagtgggcagagccagttagtgtgttcaggttgcagaaaccttctgatgtatcccgtcggagcaacctccgtctgttgcgccgtctgtaacgccgtcacggccgttcctccgcccggaacggagatggcacagttggtatgtggaggatgtcatacactcttaatgtacattcgtggagctacaagtgttcaatgttcttgttgtcacactgttaatctcgccctcgaagcaaaccaagtagcgcatgtgaattgcggaaactgcatgatgctactaatgtatcaatatggagcaagatcagtgaaatgtgccgtttgtaactttgtcacatctgttgggggttcaacgagcacgactgattcgaagtttaacaattaaaacttggatctatctacctatc

SEQ ID NO: 464 - protein, 154 aa, Arabidopsis thaliana
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSTTDSKFNN

SEQ ID NO: 465 - DNA, 795 bp, Arabidopsis thaliana
tcacttccacattgtcttcttcatatggtaaaaaggagagaggagaaggcaaagtggtgaaagaggagatggagcaagagagcctaaacggtaggtatggtagtagagtaatgacggatgaacaaatggagactcttcgtaagcaaatcgccatttacgccgttctttgcgaccagctcgtcttcctccacaactctctctcttctgtccctcttctttcatcaggaatgaatccaatgagaggtgagtattttgatccaatggtggcatcgtcaagcgctcatggaatgtcgactcggcctcgatggactcctacgacaacgcaacttcagattcttgagaacatttacaaggaaggcagtggaacaccaaatccgcggaggattaaagagatcacgatggaactgtctgaacatggacaaatcatggagaaaaatgtataccattggtttcaaaaccgacgagctcggtccaaacgaaagcaacctccgacaacgacaattacctcgagtcaggcggatgatgcggccgtgacaacaactgaggagagagggaggtgtggagatgattctggagggtttgagtcttatgagcatatactgttcccgagtcctgatttagggattgagcatttgttgaatagggacaagtttatagactgagtgaaacaaagatgatgaactctccaacctctctgtttttatttggttttctcaataaattgatatcatcgtatatgattgtgtgagggagaccttgaacaagtttttttttactgtagaatttgtttttccg

SEQ ID NO: 466 - protein, 197 aa, Arabidopsis thaliana
MEQESLNGRYGSRVMTDEQMETLRKQIAIYAVLCDQLVFLHNSLSSVPLLSSGMNPMRGEYFDPMVASSSAHGMSTRPRWTPTTTQLQILENIYKEGSGTPNPRRIKEITMELSEHGQIMEKNVYHWFQNRRARSKRKQPPTTTITSSQADDAAVTTTEERGRCGDDSGGFESYEHILFPSPDLGIEHLLNRDKFID

SEQ ID NO: 467 - DNA, 678 bp, Arabidopsis thaliana
atggatagaggagaatgcttgatgtcgatgaagcttagaccgatggtgacgaggccatcttcggatgggactttattttggccgtttagggaagagagagcgtttgcgtcagctgaggagtatggcggcggaggtggttgcatgtggccaccgaggtcttactcatgcagcttttgcgggagagagttcaagtcggcgcaagcactaggcggtcatatgaacgttcatcgaagagaccgagctcgactcaaacaacaatcattatcaccttcatcaactgaccaagccacacctcctgaatgtgatcgtcaacaacaagttcttgatgtgggatcaaaggttcttgttcaagaagaaacaagaaagcctaacggaaccaagagggagataagtgatgtttgtaataacaacgttttagaaagttctatgaaaagatatgaacatgacaatggtgaagtcaagactgacttatcggtcggtctactgagtactgagtttgatcctcggaagaagcaactaatcaacggatcatcttcgtcatggaagagggcaaagacggatgtgtcaagatttccaatgatgttagggttggtcattggaatttccgagatcaacggccatcatgaggagttggatcttgagctaaggctaggagctgatccgcctaaggttaactag

SEQ ID NO: 468 - protein, 225 aa, Arabidopsis thaliana
MDRGECLMSMKLRPMVTRPSSDGTLFWPFREERAFASAEEYGGGGGCMWPPRSYSCSFCGREFKSAQALGGHMNVHRRDRARLKQQSLSPSSTDQATPPECDRQQQVLDVGSKVLVQEETRKPNGTKREISDVCNNNVLESSMKRYEHDNGEVKTDLSVGLLSTEFDPRKKQLINGSSSSWKRAKTDVSRFPMMLGLVIGISEINGHHEELDLELRLGADPPKVN

SEQ ID NO: 469 - DNA, 696 bp, Arabidopsis thaliana
gtgtgatatcgaaatccaaaaatctccctcttcctttctctatttctttcttaaattccatcatctagaaatttcaaagcctcataatttcaatcttttagaagggactccatcgcgtaacaataatttcaactcaatgttccaacaaaacttacatgatgaagacgacgtccatgttcaagaccatgtctacaatcatgaccagtaccatcatcaacaaccgaatgttgtgacggatgaagagaagaggttaaggagaatggcgtctaatcgagaatcagcaagaagaacgcggatgcgtgagcggatgatgaaagaggggttgcaaatgcaagtaaaacaactcatggcgtacaatcaattcttgtataacaaatatattagcttgttggagtacaatcaccagatcttgcaagagaattcacagctcaaagagacagtttcatcctttcatgatcaatatactatatcttatggaaaccatgaaggtatacttggaaacaccaatgatttcgatttaaaccaactatcttcgtatcaaccatcttaactggtaagtcgaaaaatattatttttagtggaaaatggttctaatgtaattagcttcttttattatttatctctctactggattctatctatatagaataataattgtcaatacatttgcttcatgatttctcaatatatttctag

SEQ ID NO: 470 - protein, 137 aa, Arabidopsis thaliana
MFQQNLHDEDDVHVQDHVYNHDQYHHQQPNVVTDEEKRLRRMASNRESARRTRMRERMMKEGLQMQVKQLMAYNQFLYNKYISLLEYNHQILQENSQLKETVSSFHDQYTISYGNHEGILGNTNDFDLNQLSSYQPS

SEQ ID NO: 471 - DNA, 912 bp, Arabidopsis thaliana
atgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagtcacaacgtctccacaatcagctggagattatagtgataaaaaccaagaatctctgcatcatggcatcacacaacctcctcctcaccctcaacttgttggccacacagttggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagagctagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttataagagaagggaagaaggagagtgttcagggcagcaatggaacagcctttcctcaaaccatccttctcaagctcgtctagccattaaatga

SEQ ID NO: 472 - protein, 303 aa, Arabidopsis thaliana [sequence omitted]

SEQ ID NO: 473 - DNA, 1473 bp, Arabidopsis thaliana
atgtacaagcagcctagacaagagcttgaggcttattattttgagcctaactctgttgagaagcttaggtacttaccggttaacaactctcgtaaacggttttgtacgctcgagccatttcctgactctcctccttataatgctctatctactgctacatatgatgatacatgtggctcttgtgtaacggatgagttgaatgacttcaaacacaagattagggaaatcgaaacggtgatgatggggccggactcgttggacttacttgtcgattgcacggactcatttgattccacggcgagtcaagagattaatggttggagatcaactctagaggctatctcgaggcgggatttaagagctgatcttgtttcatgtgccaaagctatgtcggaaaatgatcttatgatggctcattcaatgatggagaagttgcggcagatggtttcggtttctggtgagcctattcaacggttgggagcttacttattggaaggtctagtggcgcagctagcttcgtcgggcagttctatatacaaagcacttaataggtgtcctgaaccggctagcacagagcttctctcttacatgcacattctctatgaggtttgtccttacttcaagtttggatacatgtcagcaaatggtgctattgctgaggcaatgaaggaagaaaacagagttcacattattgatttccaaatcggtcaagggagtcaatgggtcactcttatccaggcttttgcagctaggcctggtgggcctccgcggattcggataacgggtatcgatgatatgacttcagcgtatgctcgtggaggtggcctaagcattgttggaaatagactcgctaagcttgctaagcagttcaacgttccattcgagtttaactcggtatcggtgtcagtttccgaggttaaacctaaaaacctcggggttcgacctggggaagctctagccgtaaactttgcctttgtgcttcatcatatgccagacgaaagcgtgagcaccgagaatcaccgcgaccggttattgagaatggtgaagagcttatctcccaaggtggtgactcttgtggaacaagagtcaaacacaaacacagccgctttcttcccgaggttcatggagacaatgaactactatgccgcgatgtttgagtcaattgatgtgactctaccaagagatcacaaacagaggattaatgtggagcaacattgtctagcaagagatgtcgtgaacatcatcgcatgtgaaggagctgatcgggtggagcgacacgagctcctaggaaaatggaggtcacggtttgggatggcgggtttcactccttacccgttgagtcccttggtgaattcaaccattaaaagtctgcttaggaactactcagacaagtacaggctagaagaaagagatggagctttgtatcttggttggatgcatcgagatttggttgcctcgtgtgcttggaaatga

SEQ ID NO: 474 - protein, 490 aa, Arabidopsis thaliana
MYKQPRQELEAYYFEPNSVEKLRYLPVNNSRKRFCTLEPFPDSPPYNALSTATYDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWK

SEQ ID NO: 475 - DNA, 961 bp, Arabidopsis thaliana
tcttcttgtgccgacaatggatgttgatgtgtttaacggttgggggaggccaagatttgaagatgaatcccttatgccacctgggtttaggtttcatccaactgatgaagagctgatcacttactatctcctcaagaaggttcttgactctaatttctcttgtgccgccatttctcaagttgatctcaacaagtctgagccttgggagcttcctgagaaagcgaaaatgggggagaaggagtggtacttcttcacactaagagaccgtaaatacccaacgggactgagaacgaacagagcaacagaagctggttactggaaagccactggtaaagacagagagatcaaaagctcaaagacaaaatcacttctcgggatgaagaaaactcttgtcttttacaaaggcagagctcctaaaggagagaagagttgttgggtcatgcatgagtatcgccttgacggcaaattctcttaccattacatttcctcctccgctaaggatgaatgggttctctgtaaagtttgtctgaaaagcggcgtagttagtagagagacgaacttgatctcttcttcttcttcttctgccgtcaccggagagttctcctctgccggttctgcaattgctccgatcatcaatacctttgcgacggagcacgtgtcctgtttctccaataactctgctgctcataccgatgcgagctttcatacattccttcccgctccaccgccgtcactgcccccacgtcagccacgtcacgtcggtgatggcgtggcgtttggtcagtttctggatttgggatcatcgggacagattgatttcgatgcagcagcagcagcgttctttccgaatctaccttctctgcctcccacggttcttcctcctcctccgtcatttgcaatgtacggtggaggctcccccgccgtgagtgtgtggccgtttactctctgatcgccatgcggt

SEQ ID NO: 476 - protein, 310 aa, Arabidopsis thaliana
MDVDVFNGWGRPRFEDESLMPPGFRFHPTDEELITYYLLKKVLDSNFSCAAISQVDLNKSEPWELPEKAKMGEKEWYFFTLRDRKYPTGLRTNRATEAGYWKATGKDREIKSSKTKSLLGMKKTLVFYKGRAPKGEKSCWVMHEYRLDGKFSYHYISSSAKDEWVLCKVCLKSGVVSRETNLISSSSSSAVTGEFSSAGSAIAPIINTFATEHVSCFSNNSAAHTDASFHTFLPAPPPSLPPRQPRHVGDGVAFGQFLDLGSSGQIDFDAAAAAFFPNLPSLPPTVLPPPPSFAMYGGGSPAVSVWPFTL

SEQ ID NO: 477 - DNA, 996 bp, Arabidopsis thaliana
atggcaggatttttctcgttaggacacggcggaggaggaaacactccagacaaccacagaacaaacactaataatccttcttcatcgggaacagaatcttggctttggtgcagaaaccctaactctaacgctgacggtggagaagctggtccttcttacaaaggaacccttgagctatggcaacacccaaacaatcaagaaatcattttccagcagcagcagcaacagcaacaaaggctggatctttacacttccgctgcgggtttaggtgttggaccgagcaaccggagcttaattgaaacttccggcggtgcgttgatgatgatgagaagcggtagcggtagcggcggaccaagctgccaggattgtgggaatcaatctaagaaagactgctctcacatgagatgtaggacttgctgcaagagccgtggccttgactgtcccactcacgtgaagagcacgtgggttcctgccgctaaacgccgagaacgccagcagcagctttctaccggtcagcaaccgcagcaactgggagggagcgtccctaaacgacagagagagcgtatcccggcgagatcgacttccatggcctacactcgtataccttctaacaacacttcagggttggaggttgggaattttccgccggaagttagctcgtcggcagtttttcggtgcgtgcgtgtgagttccgtagatgatgaagaagaagagtatgcatataaaacagctgtgagtataggcggtcacgtcttcaaaggtgttctctacgatcaaggcccggccgagagaagctcctcgggcggtggatctcagccgttgaatctcataaccgcaggcccatcggcctcatcatcaagcccaaacgtgagctgcaacaatggagtcgttggctccacttcagatcattatatcgatcctgcctcacttaattatcctactcccattaacactttcatgactggtacgcacttcttctccaactcaagatcttga

SEQ ID NO: 478 - protein, 331 aa, Arabidopsis thaliana
MAGFFSLGHGGGGNTPDNHRTNTNNPSSSGTESWLWCRNPNSNADGGEAGPSYKGTLELWQHPNNQEIIFQQQQQQQQRLDLYTSAAGLGVGPSNRSLIETSGGALMMMRSGSGSGGPSCQDCGNQSKKDCSHMRCRTCCKSRGLDCPTHVKSTWVPAAKRRERQQQLSTGQQPQQLGGSVPKRQRERIPARSTSMAYTRIPSNNTSGLEVGNFPPEVSSSAVFRCVRVSSVDDEEEEYAYKTAVSIGGHVFKGVLYDQGPAERSSSGGGSQPLNLITAGPSASSSSPNVSCNNGVVGSTSDHYIDPASLNYPTPINTFMTGTHFFSNSRS

SEQ ID NO: 479 - DNA, 1113 bp, Arabidopsis thaliana
atggcggggtttttctcgctagacggtggtggaggaggaggcggaggtggaggtaacaaccaagaagatcaccggagcaacacaaatcctcctccgcctgtatcagaagcttggctctggtatagaaaccctaacgttaacgcaaacgcaaacacaaacgttaacgcaaacgctccttcttcgtcaaacgctgctttaggaacacttgagttatggcaaaaccacaatcagcaagagatcatgtttcagcatcagcaacatcagcaaaggttggatctttactcttccgccgcaggtttaggtgttggaccaagtaatcataaccaattcgatatctccggcgaaacttcaaccgccggcgccggaagagctgcggcgatgatgatgattcgtagtggtggtagcggaggaggaagtggtggtgtgagctgtcaagactgtgggaatcaagcgaagaaagattgttctcacatgaggtgtagaacttgttgtaaaagccgtggcttcgagtgttctactcacgtgagaagcacgtgggtccctgctgctaaacgccgtgagagacaacagcaattagctacggtccagcctcaaactcagctgcctcgcggtgagagcgttcctaaacgccaccgtgaaaatttaccggcaacttcatcgtctcttgtctgcactcgcataccttctcattcagggctagaagttggcaatttcccggcggaggtgagttcatcggcggtgtttaggtgcgtgcgtgtgagctcagtagaagatggagaagaagagtttgcttaccaaacagctgtaagcattggtggtcacattttcaaaggcattttatacgacctcggtcctggaagtagtggtggcggaggctacaacgttgttgccgccggtgagagctcctctggtggtggtggagctcaacagctgaatctcataacagctggctctgtaaccgttgctaccgcttcttcctctactccaaacctcggtggtattggcagctcatcagccgcggcagccacgtacattgatccagccgctctttatccaactccgatcaatacattcatggccggtacacaattctttcccaacccaagatcatga

SEQ ID NO: 480 - protein, 370 aa, Arabidopsis thaliana
MAGFFSLDGGGGGGGGGGNNQEDHRSNTNPPPPVSEAWLWYRNPNVNANANTNVNANAPSSSNAALGTLELWQNHNQQEIMFQHQQHQQRLDLYSSAAGLGVGPSNHNQFDISGETSTAGAGRAAAMMMIRSGGSGGGSGGVSCQDCGNQAKKDCSHMRCRTCCKSRGFECSTHVRSTWVPAAKRRERQQQLATVQPQTQLPRGESVPKRHRENLPATSSSLVCTRIPSHSGLEVGNFPAEVSSSAVFRCVRVSSVEDGEEEFAYQTAVSIGGHIFKGILYDLGPGSSGGGGYNVVAAGESSSGGGGAQQLNLITAGSVTVATASSSTPNLGGIGSSSAAAATYIDPAALYPTPINTFMAGTQFFPNPRS

SEQ ID NO: 481 - DNA, 963 bp, Arabidopsis thaliana
atgggcatggttggtctaagagatgtattccttgttgctccggcttatcaccaccagaacgccggagtgatatctggatccgatcatatgaacagtaatgcagctgcggcggcggcgctcggtgtcggagtgattcctctactcacggcgggtacaccgcagcaaaacgtggaagactccgacattaacttcctcggaaacaaccggagatggcagaataacaacaacaaccacgaaacgcagtatcttcacttcaagagtactaaccagacaacggtcggaacgagctcgaacaactcggggtctggctcaggcgcatcaggaaccgccacgtgtcaagactgtggaaatcaggcgaagaaagagtgtaagcagaggcggtgtaggacttgctgcaagagccgtggctttgattgttctactcacgtgaagagcacgtgggtctctgctgctcggcggagagagaggcaggtcatgcctaccggcgctaatccaacggctggctcgtctctttcgacctcctccgggacgaagaagccgaggatcgtagggtctcaacaacaacaacaacaacaagccacttctcatacttcaacttctaacacaccacctcaaagtttcgagaccagctccagccgacaagacggaggagggtcaagggaagcatggccagggcaggttagggcagcggcggtgttcaagtgtgttagagtaacggcagtggaggacggggatgatgagtacgcgtaccaagcggtggtgaaaatcggcggccatgtctttaaaggattcttgtacgatcaagggcttgaaccaaaagaaggttttcctagtatgtcggatttgcatttaggtggttcagccaataaccataacggagtttctgcctcggcgcctattctcgacccgcctaatgttgtttatggtggtggtggaggttcaggcggtgggttttacagttaa

SEQ ID NO: 482 - protein, 320 aa, Arabidopsis thaliana
MGMVGLRDVFLVAPAYHHQNAGVISGSDHMNSNAAAAAALGVGVIPLLTAGTPQQNVEDSDINFLGNNRRWQNNNNNHETQYLHFKSTNQTTVGTSSNNSGSGSGASGTATCQDCGNQAKKECKQRRCRTCCKSRGFDCSTHVKSTWVSAARRRERQVMPTGANPTAGSSLSTSSGTKKPRIVGSQQQQQQQATSHTSTSNTPPQSFETSSSRQDGGGSREAWPGQVRAAAVFKCVRVTAVEDGDDEYAYQAVVKIGGHVFKGFLYDQGLEPKEGFPSMSDLHLGGSANNHNGVSASAPILDPPNVVYGGGGGSGGGFYS

SEQ ID NO: 483 - DNA, 822 bp, Arabidopsis thaliana
tcaagcttaccagtttttctgtatcgacagaggacatgggaataaaaaaagaagatcagaaaagttccttgtccttgttgacgcaacgatggaataatccgaggatcgtgcgagtctcccgagcatttggaggcaaagatagacacagcaaagtgtgcacagttcgtggtctccgagacaggaggataaggttgtcggtgatgacagcgatccaagtctacgaccttcaagaacgattagggctgagtcagcctagcaaagtcattgattggctcttagaagttgccaaaaacgacgtcgatttgcttcctcctttgcaattcccacctggttttcaccaacttaaccctaatctcaccggccttggagaatcttttcccggggtcttcgatcttggaagaacacagagagaagctttggatcttgagaaaaggaaatgggttaatcttgatcatgtgtttgatcacatcgatcatcacaaccatttctcgaattcaatccagagcaacaagctttatttccctacaattacttcgtctagcagctcttatcactacaaccttggacatctccaacagtcactactagaccaatctggtaacgtcactgtcgcattttctaataactataataataataatctcaatcctccggcggcggaaactatgagttctctattcccaacaaggtacccttcgtttctcggtggtggtcaacttcaactctttagtagcacaagctcacaaccagaccatatcgagtagttccagctgcagattatttttagacgatctttaacaagttgaagaattcaagtcatgt

SEQ ID NO: 484 - protein, 242 aa, Arabidopsis thaliana
MGIKKEDQKSSLSLLTQRWNNPRIVRVSRAFGGKDRHSKVCTVRGLRDRRIRLSVMTAIQVYDLQERLGLSQPSKVIDWLLEVAKNDVDLLPPLQFPPGFHQLNPNLTGLGESFPGVFDLGRTQREALDLEKRKWVNLDHVFDHIDHHNHFSNSIQSNKLYFPTITSSSSSYHYNLGHLQQSLLDQSGNVTVAFSNNYNNNNLNPPAAETMSSLFPTRYPSFLGGGQLQLFSSTSSQPDHIE

SEQ ID NO: 485 - DNA, 1413 bp, Arabidopsis thaliana
atcaaaccacaactttgtttgacctttttttgagtacttctcttgtcttttcttcttcaagtttacttagttctttgagaacaaatttctgttgattttttttctttcttgtagagggataattacaagtttaatttccctagagtgtctttaccttttgccttgtctccctctcgagacaaaaagagaaagagaaacactttctgtcctctttttttttcctctctttttctctctcgctggaaaccttttcatattcaagtgtaattttaatatttcaagcaattttctagctaattatggccttggaggctgtagtttacccgcaagatccgttctcctacatctcttgcaaagattttccgttttacgacttatactttcaagaagaagaagatcaagatccacaagatactaagaacaacattaagctagggcaaggacaaggacatggttttgcgagtaataattacaacggtagaaccggagattatagtgatgattataattacaacgaagaggatctccaatggccacgagaccttccttatggatctgccgtcgacaccgagagccagcctccaccgtcggatgtggcggcgggaggagggaggaggaaaaggaggaggacgaggagtagcaagaacaaagaagagatcgagaaccagaggatgactcacatcgccgttgaaagaaatcgccggaaacagatgaacgagtacctcgccgttctccggtctctcatgccaccttattatgctcaaaggggagatcaagcatcgatagtaggcggagccattaactacttaaaggagcttgagcatcatttacaatcaatggaacctccggttaagaccgccacagaagacaccggagccggccacgaccagaccaaaacaacctcggctagttcgtcgggaccattctcggatttctttgcatttcctcagtactcgaaccggcctacctctgcggcggcggctgaggggatggcggagatagaggtaacgatggtagagagccatgcgagtctgaaaatacttgcgaaaaagagaccgagacagcttcttaaactggtctcatcgatacagagcctaaggctcactcttctccatctaaacgtcacaactcgagacgactccgtcctctattccatcagcgtcaaggttgaagaagggagccaattgaatacagtagaagatattgcagcagctgtgaatcaaatcctaaggaggatcgaagaagagtcatcctttagctagtattgttgaattttagttatggcacatttagaggagctctaatttttcatgtgtgatcttttgctctctctttttcatatattaaataatataaatttcctttttctttttgttaacgttaattctaatgcattatatattggagtttttg

SEQ ID NO: 486 - protein, 320 aa, Arabidopsis thaliana
MALEAVVYPQDPFSYISCKDFPFYDLYFQEEEDQDPQDTKNNIKLGQGQGHGFASNNYNGRTGDYSDDYNYNEEDLQWPRDLPYGSAVDTESQPPPSDVAAGGGRRKRRRTRSSKNKEEIENQRMTHIAVERNRRKQMNEYLAVLRSLMPPYYAQRGDQASIVGGAINYLKELEHHLQSMEPPVKTATEDTGAGHDQTKTTSASSSGPFSDFFAFPQYSNRPTSAAAAEGMAEIEVTMVESHASLKILAKKRPRQLLKLVSSIQSLRLTLLHLNVTTRDDSVLYSISVKVEEGSQLNTVEDIAAAVNQILRRIEEESSFS

SEQ ID NO: 487 - DNA, 819 bp, Arabidopsis thaliana
accatatcatgtaacagttataaaccacgacaatcacaatggatgatttcaatcttcgtagcgaaaaccctaattcatcatccaccacttcctcatcctcttcctctttccaccgtcacaagagcgaaaccggaaacacaaaacggtcaaggtcaacgtccacgttatcgacggaccctcagagcgtggcggctcgcgacagacggcaccgaattagcgaccgtttcaagattttacaaagcatggtccctggtggtgcgaagatggacactgtatctatgcttgacgaagccattagctacgtcaagttcttgaaggctcagatctggtatcaccaaaacatgcttctcttcataaacgaccacgaaactacatcatcttgtacttactctcccggcgctggagaatttggaccgaaactctttggttatgatgacgattatgcccctataatggacacatattcacaaggcgtgccacttacggttgcggactcgaagtatacgccgtggtttggttcggttgatgatgagcaagaacgtgactcgtcctagtcgttgccatatatgcaacattatgtgatttacatatccagaatctaccgtcttccttattctcgcaatacttagtaactatagtttaaggattatattatatgcgtctactatatatatctgagtgtatctaatttagagattgtaatatacatgagtatgagactaattaacctatagtatttgtattgacgtatggataatcacttggaaacacgaaaaagagagtatacaatactgtatattaattatggactttaaaaaa

SEQ ID NO: 488 - protein, 171 aa, Arabidopsis thaliana
MDDFNLRSENPNSSSTTSSSSSSFHRHKSETGNTKRSRSTSTLSTDPQSVAARDRRHRISDRFKILQSMVPGGAKMDTVSMLDEAISYVKFLKAQIWYHQNMLLFINDHETTSSCTYSPGAGEFGPKLFGYDDDYAPIMDTYSQGVPLTVADSKYTPWFGSVDDEQERDSS

SEQ ID NO: 489 - DNA, 1568 bp, Arabidopsis thaliana
aagatctcaaagagacgacgacgaagcaaaagaagaagaagaagaagagagagctattcaagcttaaagcataaaacaatctctgctccttatatagttcttcactatggaagatttgagtaatcagaatctcctcccgcgtcaatcagatatctccatccctgcggagaagatggattcgtttcaaaagtcgctagaacctccgccgtgttctccggtgaaatcttctcaacaatcagaaacggaagtcacaccgcctcagaaaccaccgcttcaccaatttggtcacaaccaagttcagaagaatcgagtgagcaatcaagatccatcgacctcacgaagacataatgaagttgaatcgaaagagaatactccaaataaacaacaaaaacattgcaattgcaaaaactcaaagtgtttgaaactgtattgtgaatgctttgcttctggatcttattgtaatggttgtaactgtgtgaattgtcacaacaaattggagaatgagtcttcgagacaagtagctatctcggggatcttagagcgtaaccctgatgcgtttaagcccaagattgctggtagtcctcatggaatgaaagatttgcaggagaatgtgcagcaagtgttgcttattggaaagcacagcaaaggatgccactgcaggaaatcaggatgtctcaagaagtactgtgagtgttaccaggcgaatattctatgttcggagaattgtagatgtcaagactgcaagaactttgaaggaagcgaagaaagaaaagctcttcttcatggatctcaggtctcggatacctacatacaacagatgaccaatgcggctgttaaccgtgccatcgacatgtctgcttatctgtaccctcctgaatcaagaaagagaaagagcaaggacatttcagattctgtagtttcatcatacggtgtccaataccagagggcaaaccacgttagaagaaatggtgaaaattctctattttcactccctaacaacaaggccgtgtccggatctaccacaagtgcttacaggtcttcttggtcaaatacattccaaccacatcatgtcagagagctatgttcacttttggtctcaaactcggttgatgtagcaaataaattgtcagacaaagggaggaagaacgacaaaggcccttcttcacttgatggagcccaaagagttgctaatgagatcaatgactcaccagattgtgtccttgatgctaatagaatggacgagaagcctatatctcccgcaacacgtgcattgatgtgtgacgaagaacatgagatcgggtcagagaaagagacatcggcccgagtgaaaacaagccaagagaaagaagacacagacacaagctcggggatttacttagagcaagaaagacagatattgtcaatcttcagggactatctcattcagctctcaaaccgtgcgaggataaatggtaaaaatatcaaaagcaacacaaatccaagttgaaagaaaccagaagatgaagaacaaagccatcgagactcaaattagggacattgcttagggaatttttttgatttttttttta

SEQ ID NO: 490 - protein, 459 aa, Arabidopsis thaliana
MEDLSNQNLLPRQSDISIPAEKMDSFQKSLEPPPCSPVKSSQQSETEVTPPQKPPLHQFGHNQVQKNRVSNQDPSTSRRHNEVESKENTPNKQQKHCNCKNSKCLKLYCECFASGSYCNGCNCVNCHNKLENESSRQVAISGILERNPDAFKPKIAGSPHGMKDLQENVQQVLLIGKHSKGCHCRKSGCLKKYCECYQANILCSENCRCQDCKNFEGSEERKALLHGSQVSDTYIQQMTNAAVNRAIDMSAYLYPPESRKRKSKDISDSVVSSYGVQYQRANHVRRNGENSLFSLPNNKAVSGSTTSAYRSSWSNTFQPHHVRELCSLLVSNSVDVANKLSDKGRKNDKGPSSLDGAQRVANEINDSPDCVLDANRMDEKPISPATRALMCDEEHEIGSEKETSARVKTSQEKEDTDTSSGIYLEQERQILSIFRDYLIQLSNRARINGKNIKSNTNPS

SEQ ID NO: 491 - DNA, 1083 bp, Arabidopsis thaliana
atgacaggaaacgcagattccggcaaaatcgcgacagagaaagaccctaggaagctcgttttcaccaaattggaggtatctcccgtcttccgagaatctcctgttaaagaacttcctctttttcctccgatttctcgcagagagcattcagaagcaaaggataagacagatgaagaaggcattacttcgaggaaacacaaaggatgtcgatgcaagcagtccaaatgtttaaagttgtactgtgactgttttgcatcaggagtggtatgtacagactgtgattgtgttgattgtcataacaactctgagaaatgtgatgctagagaagcagctatggtgaatgtactaggtcgcaacccaaatgccttcagtgaaaaggctttaggtagcctaactgataatcaggctgcacctgatactaaacctggactgctttcgagaggctgcaaatgtaaaagaaccaggtgtttgaagaagtactgtgagtgctttcaggctaatcttctgtgctcagacaactgtaaatgcatcaactgcaagaatgttagtgaagcgttccagcctcctgcattttctgctcacaattccccacaagtataccggaggagaagagaccgagagctaactgaggcaactccgttattttcgatacctgacaattccattcaaaatgctctgggttcccctatgtcttgctctcctaaacttccttacaggtccctcatgggatacacctctacacttcttccggacttgggagatttatgctcacttctcgttgcagcgtcagaatctgctacaacaactgcagaggaccagaacaggatatttacaaagcctgatgataaggaagccattgagctgtcaagtgagtctgagagtcgtaatgtggaagaagaaatacaatcacgtggaagattgatcgaactgatagatgttcaatacaatggagaagaggattcccaatgtaagaccaagacaagtgtcaatgaaacagatatatacatggagcaggaaagggcagtgcttgaaactttcagagactgtctccaaaagttcatcaaatcgagactggaatcataa

SEQ ID NO: 492 - protein, 360 aa, Arabidopsis thaliana
MTGNADSGKIATEKDPRKLVFTKLEVSPVFRESPVKELPLFPPISRREHSEAKDKTDEEGITSRKHKGCRCKQSKCLKLYCDCFASGVVCTDCDCVDCHNNSEKCDAREAAMVNVLGRNPNAFSEKALGSLTDNQAAPDTKPGLLSRGCKCKRTRCLKKYCECFQANLLCSDNCKCINCKNVSEAFQPPAFSAHNSPQVYRRRRDRELTEATPLFSIPDNSIQNALGSPMSCSPKLPYRSLMGYTSTLLPDLGDLCSLLVAASESATTTAEDQNRIFTKPDDKEAIELSSESESRNVEEEIQSRGRLIELIDVQYNGEEDSQCKTKTSVNETDIYMEQERAVLETFRDCLQKFIKSRLES

SEQ ID NO: 493 - DNA, 726 bp, Arabidopsis thaliana
atgttttcaaacatcgatcacaaggctgtggcagcactccttcatggccagggatgcgctaacatcctcaagacggtcctcgacaactgtaaagttagctctgtttcaacagaacctctcattaacaccattcttgattccttttcactagctctatcttctgtgaattctcctaatcgtcaaccacaccatgagtcttcttctcgagacatggcaggtcttgtgcctcaaagatcatcaaagaagaagatttgcggagtaaaaggtttagagatttacagagatgattcccccaatccccgccttgatgacggcttcacctggaggaaatatggacaaaaaaccatcaaaacctctttgtaccaaaggtgttactatcgttgtgcctatgcaaaagaccaaaactgctatgctacaaagcgggtgcagatgatccaagacagtcctccagtttacagaaccacttatttgggacaacatacatgtaaagcctttggggtgcatgataatacgtatggctctgaaatgataaacttcgaccaagttgtatctgaatcggttatgcgtcaacttgcaacaattggtgaacaagctgttctcatggaggacgaagctaaccatatcatgaaccaagaatatgatattaatgattatttggtggatgatgaagtcttttgggggaatgaatttcctctattttcatcggaagacctgatgttgttttga

SEQ ID NO: 494 - protein, 241 aa, Arabidopsis thaliana
MFSNIDHKAVAALLHGQGCANILKTVLDNCKVSSVSTEPLINTILDSFSLALSSVNSPNRQPHHESSSRDMAGLVPQRSSKKKICGVKGLEIYRDDSPNPRLDDGFTWRKYGQKTIKTSLYQRCYYRCAYAKDQNCYATKRVQMIQDSPPVYRTTYLGQHTCKAFGVHDNTYGSEMINFDQVVSESVMRQLATIGEQAVLMEDEANHIMNQEYDINDYLVDDEVFWGNEFPLFSSEDLMLF

SEQ ID NO: 495 - DNA, 1065 bp, Arabidopsis thaliana
atggatatggacgagatgagcaatgtagccaagacaacgacagagacttcaggcttaactgactctgtcttgagcctcacgaaacgcatgaaacctactgaggttacgaccaccacaaaacctgccttgtccaacacgacgaaattcaaaggagttgttcagcaacagaacggtcattggggtgctcagatttacgcagaccatcgaaggatttggcttggaactttcaaatccgctcatgaagccgctgctgcttacgatagcgcatcgattaagcttcgaagctttgatgctaactcgcaccggaacttcccttggtctgattttaccctccatgaaccggactttcaagagtgctacacgacagaagctgtgttgaacatgatcagagacggttcttatcaacacaagttcagagattttctcagaatccggtctcagattgttgcgaatatcaacatcgtgggatcaaaacaagtcttaggaggaggagaaggtggtcaagaatcgaacaagtgtttctcgtgcacgcagctttttcagaaagaactgacaccgagcgatgtagggaaactgaataggcttgtgatacctaagaagtatgcagtgaagtatatgcctttcataagcgatgatcaaagcgagaaagagacgagtgaaggagtagaagatgtggaggttgtcttttacgacagagcaatgagacaatggaagtttaggtattgttactggagaagtagccagagctttgtcttcaccagaggatggaatggtttcgtgaaggagaagaatctcaaggagaaagatattattgtcttttacacttgcgatgtccccaacaatgtgaagacattagaaggccaaagcaagaccttcttgatgattgatgttcatcacttttcaggcaacggtttcgtggttcccgaggaagtaaacaagacggttcatgagatttctgatgaagagatgaaaacagaaaccctctttacctcgaaggtagaagaagaaaccaaatcagaggagaagaaaggagggtttatgctgtttggtgttaggatccaatag

SEQ ID NO: 496 - protein, 354 aa, Arabidopsis thaliana
MDMDEMSNVAKTTTETSGLTDSVLSLTKRMKPTEVTTTTKPALSNTTKFKGVVQQQNGHWGAQIYADHRRIWLGTFKSAHEAAAAYDSASIKLRSFDANSHRNFPWSDFTLHEPDFQECYTTEAVLNMIRDGSYQHKFRDFLRIRSQIVANINIVGSKQVLGGGEGGQESNKCFSCTQLFQKELTPSDVGKLNRLVIPKKYAVKYMPFISDDQSEKETSEGVEDVEVVFYDRAMRQWKFRYCYWRSSQSFVFTRGWNGFVKEKNLKEKDIIVFYTCDVPNNVKTLEGQSKTFLMIDVHHFSGNGFVVPEEVNKTVHEISDEEMKTETLFTSKVEEETKSEEKKGGFMLFGVRIQ

SEQ ID NO: 497 - DNA, 1531 bp, Arabidopsis thaliana
gcgatttcgtctctgtttctaatctcctttgcaattcaatcgtcttcttcttcttcctcgtctgtcttgttctttggtctgagtctgacggctgttcttaacgctcttcgcttctgctccgaacagaggcttattcttgaggttccttccatttccatgggcttaagacttaaaaggacttgttctggtgttgaagtatttgggggttttcacgaaaagcaaaaaataccctttttcatagttcgctgaaacagagaaatctttttcctgaaaaaaacctcatccgatttagcagtttttgatcagagatttttgagtggggtttttttggtgtgttcttggtgtgtttgagaagatatgaagtcctttgtgaaacctgagagagactctttgttgagaacagttcgtattgttttcactgatcctgatgctactgatgattcctcttcctctagcgatgaatggttacctaaacctcgaaaggtaaagcgttttgttcatgagattactttcctccctcaggtctccgagagttctcaggatcgtagcaatgctgtcaaaacccctagaaggaaatctactaggcagtttaagtatcctgtgggagttaggccgaggccatcaggcaaatttgctgctgagattttgaacccattcactaaaactaagaaatggttgggtacttatgaaactcctgcagaagctgagaaggcttatgttgacaagaaggttgagtatgatgcactggcttcttcaggttctgctgtttcctcatcggttgtaacagtgactagccagtgcttgcgttcccctacttctgcttctgtttcttgtgtaagtgctgatgatttgtctaaagaaaagacgtctctgaacaaagatgttgctgcgtctggtgattcaaccaccaaagaagtgttcactactttcgacttttcggatgtgaaaatacctgatctgagattcttagcagcagaagaggattctatggtttctaatgcaaatggtgcagagctagactttgattgtttccttactgactctaacattctgctggatgattactcattgctcgaaaatgatatcaacttcagcaggtttgaaaacagtcttccaagtgagctacctgactgtgatttcactgaaatggaattccagcttgatgatttcaaatttgcctatacagatcatctgacaacaccgcctctcggtttggtttaagagttgttagcttcggtttctgtttcacaggaacatgatgaagaaagctagaaagtatgatccttgcggtctgatctctatggatttttcatgtgcttttagaacagtccaaaggagtgatttgcacaacattttttcataaatgttggttttactttctttcatctttatgttttaatctatttccttatgcattgttcttcgtatctcttttgtctcttggtgttgtacctttctcttttaatgtttgtctaatcaggacagaaaatctaaaccgagaatttaataagtcatgggttgatattaatag

SEQ ID NO: 498 - protein, 287 aa, Arabidopsis thaliana
MKSFVKPERDSLLRTVRIVFTDPDATDDSSSSSDEWLPKPRKVKRFVHEITFLPQVSESSQDRSNAVKTPRRKSTRQFKYPVGVRPRPSGKFAAEILNPFTKTKKWLGTYETPAEAEKAYVDKKVEYDALASSGSAVSSSVVTVTSQCLRSPTSASVSCVSADDLSKEKTSLNKDVAASGDSTTKEVFTTFDFSDVKIPDLRFLAAEEDSMVSNANGAELDFDCFLTDSNILLDDYSLLENDINFSRFENSLPSELPDCDFTEMEFQLDDFKFAYTDHLTTPPLGLV

SEQ ID NO: 499 - DNA, 1341 bp, Arabidopsis thaliana
atgtctacctcctcctcttcttccgacaacggagccggtggaagcggcggcgttttcgaggccccatctccatcccgccctcgccgcggagccaacgatgtttggccggagccttttcttgaatctctcgccgttcaagttgccgttaacgcttccacatccgccggcctcctcgccgcagctccggctcttgccaacgtttttcgggtttgcaccacgtggcacgctgtctctcgctccgaccatctatggcaactactatctcgccaagtttgggcaagaacacatttgatgcacgacacgtggcgggacgagttcatctaccgtcatcggacggctagaaacttccggacgcgtactcacacctacttcactctccaatttgacccgtctgatgtggacgagcctgatagtctctcttgccgttgtctcaccctctcagacctctacttagccgcagggttcgccgacggaaccgtccggctttttcttttaaacaaccgactccacgtcaggaccttacggccacctctacgtgaccgctttggtagattctcacgagccgtctcaggcattgttatctccgactcaaggctcacgttcgctacgatggacggagacatccacgtggcggaaatagacggtgttggtcacacacgcacggcttacgcaggagatatagttaacgacggtgcgttggtagatttcactggctgtggacgttggtgggtcggtcttttcgcgggtgtgccaggtcgtgcctttcacatatgggactgtaacagcgaagagacaacattcgtcggtggtacactcaccgaccctgaagctgtcatgggatggcacacgttaacagagctaacaacgtcccttggccgtctcagaatctccggtaacgagacggcggtagcatgcacgagatggagaatcatggtgatcgatctaagaaaccaaggagtgatcatcggagaagacgaagagcaacgtagaggactaatagtgacaggcttcgatgccaacgacgaagcgtacgttagattggacagtagaggaaacgctagcgtgcgaagggtgaacacgcaacaaacggtgtgtgagttccgtgttagtggagcggcgcagagaagagtaatgggttgtgttaatagactgcacgcgctaatgtgcgcaggtggtataatgcgcgtgtgggaggtagagagaggagagtatctgtacagtattagggagagagtaggagaagttgacgccattgttgccgatgatagacatgtggcggttgcgtcagcttcatcaacggctcagagtattatacatctatgggatttcggtgcactgtag

SEQ ID NO: 500 - protein, 446 aa, Arabidopsis thaliana
MSTSSSSSDNGAGGSGGVFEAPSPSRPRRGANDVWPEPFLESLAVQVAVNASTSAGLLAAAPALANVFRVCTTWHAVSRSDHLWQLLSRQVWARTHLMHDTWRDEFIYRHRTARNFRTRTHTYFTLQFDPSDVDEPDSLSCRCLTLSDLYLAAGFADGTVRLFLLNNRLHVRTLRPPLRDRFGRFSRAVSGIVISDSRLTFATMDGDIHVAEIDGVGHTRTAYAGDIVNDGALVDFTGCGRWWVGLFAGVPGRAFHIWDCNSEETTFVGGTLTDPEAVMGWHTLTELTTSLGRLRISGNETAVACTRWRIMVIDLRNQGVIIGEDEEQRRGLIVTGFDANDEAYVRLDSRGNASVRRVNTQQTVCEFRVSGAAQRRVMGCVNRLHALMCAGGIMRVWEVERGEYLYSIRERVGEVDAIVADDRHVAVASASSTAQSIIHLWDFGAL

SEQ ID NO: 501 - DNA, 1233 bp, Arabidopsis thaliana
atgaccaaaacccggattctcaacccgacccgattcccttctcccaaacccttacgtggctgcggcgacgctaacttcatggaacagctcctccttcactgcgccaccgccatagactccaacgacgctgcattaactcaccaaatcctctgggtcctcaacaacatcgctccaccagacggtgactccacccaacgtcttacatccgcattcctccgcgcgttgctctcacgcgccgtctccaaaacccctacactatcatccaccattagcttcctacctcaggccgatgaactccatcgtttctcagtcgtggagttagccgctttcgtagacctcactccgtggcaccggttcggattcattgcagccaacgccgcgatcttaaccgccgttgaaggttactcaacggttcacatcgttgacttaagtttgactcattgtatgcaaatccctactcttatagacgccatggcaagccgactcaacaaacctcctccgcttcttaaactcaccgtcgtctcttcctccgaccacttcccaccattcatcaacatctcctacgaagaactcggatctaaactagtcaacttcgccaccacacgaaacattacaatggagttcacaatcgtaccttctacttactccgatggcttctcctccctcttacaacagttacggatttatccttcttcattcaacgaagctctcgtcgttaactgtcacatgatgctccgttacatccctgaagaacccctaacttcatcatcatcatcgctccgaacagttttcttgaaacaactccgatctttgaatccaagaatcgtaaccctaatcgaagaagacgtagatctcacatcggagaacttggttaaccggttaaaatcggcgtttaactacttctggattccgttcgatacgacggacacgtttatgagtgagcagagacggtggtacgaggcggagataagttggaagatagaaaacgtggtggcgaaggaaggtgcggagagagtggagaggacggagacgaagagacggtggatagagagaatgagagaggctgagttcggtggagttagggttaaagaagatgcggtggcggatgtgaaggcgatgctggaggagcacgctgtcgggtggggaatgaagaaggaagacgacgacgagagtctcgtgctgacgtggaaaggtcatagtgttgtgtttgctaccgtttgggttcccatttaa

SEQ ID NO: 502 - protein, 410 aa, Arabidopsis thaliana
MTKTRILNPTRFPSPKPLRGCGDANFMEQLLLHCATAIDSNDAALTHQILWVLNNIAPPDGDSTQRLTSAFLRALLSRAVSKTPTLSSTISFLPQADELHRFSVVELAAFVDLTPWHRFGFIAANAAILTAVEGYSTVHIVDLSLTHCMQIPTLIDAMASRLNKPPPLLKLTVVSSSDHFPPFINISYEELGSKLVNFATTRNITMEFTIVPSTYSDGFSSLLQQLRIYPSSFNEALVVNCHMMLRYIPEEPLTSSSSSLRTVFLKQLRSLNPRIVTLIEEDVDLTSENLVNRLKSAFNYFWIPFDTTDTFMSEQRRWYEAEISWKIENVVAKEGAERVERTETKRRWIERMREAEFGGVRVKEDAVADVKAMLEEHAVGWGMKKEDDDESLVLTWKGHSVVFATVWVPI

SEQ ID NO: 503 - DNA, 1032 bp, Arabidopsis thaliana
atgatgatgaggaaaccggacattactacgatcagagacaaaggcaagccaaatcatgcatgtggtggtaataacaacaaaccgaagctaagaaaaggactttggtcgcctgatgaagatgagaagctgataagatacatgttgactaatggacaaggatgttggagtgacatcgctagaaatgctggtcttttacgttgtggtaaaagttgtcgccttcgctggatcaattacttgaggcctgatcttaaacgtggatccttctctcctcaggaggaggatctcatcttccatttgcattccattcttggtaacaggtggtctcaaatagctactcggcttccaggtagaacagacaacgagatcaaaaacttttggaactcgacattgaagaagcggcttaagaacaacagcaacaacaatacttcatcaggatcatcacctaacaatagtaatagtaattccttggacccaagagatcaacatgtggatatgggaggcaactcaacttcattgatggatgactatcatcatgatgaaaacatgatgacagtggggaacaccatgcgcatggactcttcctccccattcaatgttggaccaatggttaatagtgtgggcttaaaccaactttatgatcccttgatgatatcagtgccggataacggatatcaccaaatgggaaacacagtgaatgtgttcagcgttaatggtttaggagattatggaaacacaattcttgatccaattagcaagagagtatcagtagaaggtgatgattggttcattcccccctcggagaataccaacgtcattgcttgtagtacaagcaacaacctaaacttacaggcccttgatccttgcttcaatagcaaaaatctttgtcattcagaaagcttcaaggtagggaatgtgttggggatagagaatggttcttgggaaatagaaaaccctaaaatcggagattgggatttggatggtctcatcgataacaactcttcttttcccttccttgatttccaagtcgattga

SEQ ID NO: 504 - protein, 343 aa, Arabidopsis thaliana
MMMRKPDITTIRDKGKPNHACGGNNNKPKLRKGLWSPDEDEKLIRYMLTNGQGCWSDIARNAGLLRCGKSCRLRWINYLRPDLKRGSFSPQEEDLIFHLHSILGNRWSQIATRLPGRTDNEIKNFWNSTLKKRLKNNSNNNTSSGSSPNNSNSNSLDPRDQHVDMGGNSTSLMDDYHHDENMMTVGNTMRMDSSSPFNVGPMVNSVGLNQLYDPLMISVPDNGYHQMGNTVNVFSVNGLGDYGNTILDPISKRVSVEGDDWFIPPSENTNVIACSTSNNLNLQALDPCFNSKNLCHSESFKVGNVLGIENGSWEIENPKIGDWDLDGLIDNNSSFPFLDFQVD

SEQ ID NO: 505 - DNA, 903 bp, Arabidopsis thaliana
atgggtgctcctaagcagaaatggactcaagaagaagagtcagctttaaagtctggagttataaagcatggacctggtaaatggcgcacaattctcaaagatcctgaatttagcggagtcttgtacctgcgttccaatgttgatcttaaggacaaatggagaaacatgagtgtcatggcaaatggctggggatcgcgcgaaaagtctaggttagctgttaaaaggacgttctcccttcctaaacaggaagagaactcactagccctaaccaattctttgcaaagtgatgaagaaaatgtggatgcgacctctggactccaagtttcttctaatcctcctccaaggagacctaatgtaaggttggatagccttataatggaagcaatagctaccctgaaagaacctggtggctgtaacaaaacaacaattggtgcctacattgaggatcaatatcatgctccaccagacttcaaacgcttgttgtctaccaagctaaagtacttgacatcttgcgggaaacttgtgaaggttaaacgtaagtacagaattccaaactccactcccttgtcttcccacaggagaaaaggtctgggggtgtttggaggaaaacagaggacttcttctttgccttcacctaaaacagacatagatgaagtgaattttcagacaaggtcacagattgatacagagatagccagaatgaagagtatgaacgtacatgaggcggcagcagttgcagcacaggcagtagcagaggcagaagctgccatggcagaggctgaggaagctgcaaaggaagcggaggcagcagaagccgaagcagaagcagctcaagctttcgctgaggaagcttcaaagacattgaaaggaagaaacatctgcaaaatgatgatccgtgcctga

SEQ ID NO: 506 - protein, 300 aa, Arabidopsis thaliana
MGAPKQKWTQEEESALKSGVIKHGPGKWRTILKDPEFSGVLYLRSNVDLKDKWRNMSVMANGWGSREKSRLAVKRTFSLPKQEENSLALTNSLQSDEENVDATSGLQVSSNPPPRRPNVRLDSLIMEAIATLKEPGGCNKTTIGAYIEDQYHAPPDFKRLLSTKLKYLTSCGKLVKVKRKYRIPNSTPLSSHRRKGLGVFGGKQRTSSLPSPKTDIDEVNFQTRSQIDTEIARMKSMNVHEAAAVAAQAVAEAEAAMAEAEEAAKEAEAAEAEAEAAQAFAEEASKTLKGRNICKMMIRA

SEQ ID NO: 507 - DNA, 252 bp, Arabidopsis thaliana
atgaatacgcagcgtaagtcgaagcatcttaagaccaatccaaccattgttgcctcttcttctgaagaagtgagcagtcttgagtgggaagaaatagcaatggctcaggaagaagaggatttgatttgcaggatgtataagcttgtcggtgaaaggtgggatttaatagctgggaggattccaggaagaacagcagaagagattgagaggttttgggtgatgaagaatcatcgaagatctcaattacgttga

SEQ ID NO: 508 - protein, 83 aa, Arabidopsis thaliana
MNTQRKSKHLKTNPTIVASSSEEVSSLEWEEIAMAQEEEDLICRMYKLVGERWDLIAGRIPGRTAEEIERFWVMKNHRRSQLR

SEQ ID NO: 509 - DNA, 279 bp, Arabidopsis thaliana
atggcctctagttctatgagctcgagctcttcttggacgtctaagcaaaacaagatgttcgagagggctttagccgtttacgataaagacactcccgaccgttggcaaaacgtggctaaagcagttggaagtaaatctgcagaggaagttaaacgtcactacgacatcctcgttgaagatctcatgaacatcgaacaagacttagtacctttgcctaaatacaaaaccgtcgatgttggaagtaaatctagaggcatcgatgattttgatttgaggtga

SEQ ID NO: 510 - protein, 92 aa, Arabidopsis thaliana
MASSSMSSSSSWTSKQNKMFERALAVYDKDTPDRWQNVAKAVGSKSAEEVKRHYDILVEDLMNIEQDLVPLPKYKTVDVGSKSRGIDDFDLR

SEQ ID NO: 511 - DNA, 1456 bp, Arabidopsis thaliana
gaaaaaaaaaaaaaaaaaaattgtttgctcatcatcttcacaaaccaaacttctcttcttctccgatctcagatttgaatttttatcgattttgagcttcgaagagctcaatctctaactgaatttcgagaaattagagagtttgaaatgggagaggaagtacaaatgagcgattacgatgtttccggcgacggagatagggtttctgaatgggagatgggattaccaagcgacgaagatctagcatctctttcttactctctgattccaccgaatttggcgatggcgtttagtatcacaccggagagaagccgtacgattcaggatgtgaatcgtgcatcggagacgacgctctcgtcgctacgtggtggatcttcaggtccaaatacctcgtcgtcgaataataacgtggaggaggaagatcgagttggatctagcagtcctggatcggattcgaagaagcaaaagacatcaaacggtgatggagatgacggtggcggtgtggatccggattcggcgatggcggcggaagaaggagattcaggaactgaagatctatctgggaaaacacttaaacgaccgcgtttagtgtggacaccgcagctacacaagagattcgttgacgttgtagctcacttagggatcaaaaacgctgttccgaagacgattatgcagctgatgaacgttgaaggattaactcgtgagaacgttgcgtctcatcttcaaaagtataggctttacctcaaaaggatgcagggattgactaatgaaggtccctctgcttcggataagctcttctcttcaacacctgttcctccacagagcttccaagatatcggtggcggtggcggtagcagcggtaatgttggagtgccgattccgggggcgtatggaacgcaacagatgatgcagatgccagtttatgcacatcatatgggtatgcaaggatatcatcatcaaaatcataatcatgatccttatcatcagaatcatcgtcatcatcatggagctggtggaaatggtgcgtttgagtcaaatccttatatgatgcagcagaataagtttggatccatggcttcttatccttctgttggaggtggaagcgcaaatgagaattaaaaagagtctatagatggattcaatgggggaggaagagataggtgagcttgttattgctcgtggaactgataattattgtcaagtttctgtttttttaagtacagtacagttataattcttactcgatttgatcgaaattttcatcaagtttctgtcttttactataaatggtatacaataaagtcttaataatcacttgtgaggtgagtgccctcagatttatttgtctgcagacttcttaaagtggtaatcaagagagtgaattgtttatttctgtgagagatggcgtcagacacaaactttattttaaaaatttataaaccaatcaaatgtttca

SEQ ID NO: 512 - protein, 323 aa, Arabidopsis thaliana
MGEEVQMSDYDVSGDGDRVSEWEMGLPSDEDLASLSYSLIPPNLAMAFSITPERSRTIQDVNRASETTLSSLRGGSSGPNTSSSNNNVEEEDRVGSSSPGSDSKKQKTSNGDGDDGGGVDPDSAMAAEEGDSGTEDLSGKTLKRPRLVWTPQLHKRFVDVVAHLGIKNAVPKTIMQLMNVEGLTRENVASHLQKYRLYLKRMQGLTNEGPSASDKLFSSTPVPPQSFQDIGGGGGSSGNVGVPIPGAYGTQQMMQMPVYAHHMGMQGYHHQNHNHDPYHQNHRHHHGAGGNGAFESNPYMMQQNKFGSMASYPSVGGGSANEN

SEQ ID NO: 513 - DNA, 1265 bp, Arabidopsis thaliana
ctaactttatagttaaagttatcaattattcgaaaacaaagctggttttttgttttgtcccttaaaccagcatgatcaagaacttaagtaatatgaagaatgacaatcagaaacgtgaaaaatgttgcgagtacatcgaagctctcgaagaagaacgtcgcaagatcaatgttttccaacgcgagcttcctctttgcgtagagctcgtgactcaagcgattgaggcgtataagagggagatatcagggacgtcgacggataacttatacggacagtcggagtgctcagagcagaccaccggagaatgtgggcgcatcttggatctgttcataccaatcaaacactcttcgacctccatagaagaagaggttgatgacaaagatgatgatgatgaagaacaccagtctcatgaaaccgacatagattttgatgacaagaacatgaaatctgaatggctcaagtctgttcagctctggaaccaatccgacgcagttgtttctaataatagacaggatcgctcacaagaaaagacagagacgctggtagagttgataaaaataaacgatgaagcagcgaagaaaaacaacaacataaaatcaccggtgactactagcgatggtggcagtggcggtggcggtggcagaagagggcagagaaagaataggcggtgttggtcgcaagagttacacagacgcttcttgaacgctcttaaacaacttggtggccctcatgtagctacgccgaaacagataagagatataatgaaggttgatgggttaacaaatgatgaagtcaaaagtcatttacagaaatataggctgcatgcaagacggccaagccaaacaacaccgaacaacagaaactctcaaacgcaacatttcgtggtggttggtggaatatgggtcccacagactaaccattcaacggccaacgcagtcaacgccgtcgcatcgggtgagaccaccgggatttatgggcctatggtcagttcgttgccgtccgagtggccgaggcattccaattttggtaggaagatttcggaagatagatcaagatgctctaacaacggattttttcggtgtagctcaccagctatgtcttgttctactcgtacaaagacgaaagatgcaaaaataatatcataaatttaatttttgattatttattaagagaaaaaagttatagacattaatattgtgaagagtgtatatatatagatgttggagcgtgcctctatgttatttttaaaaaaaaaaaaaaaaaaa

SEQ ID NO: 514 - protein, 357 aa, Arabidopsis thaliana
MIKNLSNMKNDNQKREKCCEYIEALEEERRKINVFQRELPLCVELVTQAIEAYKREISGTSTDNLYGQSECSEQTTGECGRILDLFIPIKHSSTSIEEEVDDKDDDDEEHQSHETDIDFDDKNMKSEWLKSVQLWNQSDAVVSNNRQDRSQEKTETLVELIKINDEAAKKNNNIKSPVTTSDGGSGGGGGRRGQRKNRRCWSQELHRRFLNALKQLGGPHVATPKQIRDIMKVDGLTNDEVKSHLQKYRLHARRPSQTTPNNRNSQTQHFVVVGGIWVPQTNHSTANAVNAVASGETTGIYGPMVSSLPSEWPRHSNFGRKISEDRSRCSNNGFFRCSSPAMSCSTRTKTKDAKIIS

SEQ ID NO: 515 - DNA, 970 bp, Arabidopsis thaliana
ggtgaggaagtcaaaatcttgagagatctgagattgtaagaagatgaatcaagaagataaagagaagcctattgaagaagcttcttcatcaatggagagagaacacatgttcgacaaagtagtaacaccaagcgacgttggcaaactaaaccgactcgtgatccctaagcaacacgcagagagatacttcccattagataactccacaacaaacgacagcaacaaaggtttgcttctaaacttcgaagatcgaagtggaaactcatggaggttccgttactcttactggaacagtagtcaaagctatgtcatgactaaaggttggagccgttttgtcaaagacaagaagcttgatgctggagacatcgtttcttttcagagagattcttgtaataaagacaagctttacatcgattggaggagacgacctaagattcccgatcatcatcatcagcaattcgccggagctatgttccctaggttttacacttttcctcatcctcagatgccgacaaattacgaaactcacaacctttatcatcgatttcatcaacgagatctaggaattggatactatgtgaggtcaatggagaggagtcatccaacggctgtgattgaatctgtgccggtgatgatgcaaaggagagcacaagtggcttcaatggcttcgagaggagagaagcggttaaggctgtttggtgtagatatggagtgcggaggaggaggagggagtgtgaatagtacggaggaagagtcgtcgtcttccggtggtagtataccacgtggcagagtttctatggttggtgctggttctctcctccagttgaggttagtgagcagtgatgatgagtctttagtagcaatggaagctgcaagtcttgaggatcatcacttctttacaaagaaaggaaaaccttctttgtcttttgatttggataggtgatgattatgcatgagattaatcactatt

SEQ ID NO: 516 - protein, 299 aa, Arabidopsis thaliana
MNQEDKEKPIEEASSSMEREHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQRDSCNKDKLYIDWRRRPKIPDHHHQQFAGAMFPRFYTFPHPQMPTNYETHNLYHRFHQRDLGIGYYVRSMERSHPTAVIESVPVMMQRRAQVASMASRGEKRLRLFGVDMECGGGGGSVNSTEEESSSSGGSIPRGRVSMVGAGSLLQLRLVSSDDESLVAMEAASLEDHHFFTKKGKPSLSFDLDR

SEQ ID NO: 517 - DNA, 2435 bp, Arabidopsis thaliana
caatataccctcggttttgaatttgctctcaaaagcgacggagacgactgtttggctcggtgatttctcccgccgtttgggtttttcttaccggaatttccttctccttcgatggttagtctgcgctccagaaaagttattccggcttcggaaatggtcagcgacgggaaaacggagaaagatgcgtctggtgattcacccacttctgttctcaacgaagaggaaaactgtgaggagaaaagtgttactgttgtagaggaagagatacttctagccaaaaatggagattcttctcttatttctgaagccatggctcaggaggaagagcagctgctcaaacttcgggaagatgaagagaaagctaacaatgctggatctgctgttgctcctaatctgaatgaaactcagtttactaaacttgatgagctcttgacgcaaactcagctctactctgagtttctccttgagaaaatggaggatatcacaattaatgggatagaaagtgagagccaaaaagctgagcccgagaagactggtcgtggacgcaaaagaaaggctgcttctcagtacaacaatactaaggctaagagagcggttgctgctatgatttcaagatctaaagaagatggtgagaccatcaactcagatctgacagaggaagaaacagtcatcaaactgcagaatgaactttgtcctcttctcactggtggacagttaaagtcttatcagcttaaaggtgtcaaatggctaatatcattgtggcagaatggtttgaatggaatattagctgatcaaatgggacttggaaagacgattcaaacgatcggtttcttatcacatctgaaagggaatgggttggatggtccatatctagtcattgctccactgtctacactttcaaattggttcaatgagattgctaggttcacgccttccatcaatgcaatcatctaccatggggataaaaatcaaagggatgagctcaggaggaagcacatgcctaaaactgttggtcccaagttccctatagttattacttcttatgaggttgccatgaatgatgctaaaagaattctgcggcactatccatggaaatatgttgtgattgatgagggccacaggttgaaaaaccacaagtgtaaattgttgagggaactaaaacacttgaagatggataacaaacttctgctgacaggaacacctctgcaaaataatctttctgagctttggtctttgttaaattttattctgcctgacatctttacatcacatgatgaatttgaatcatggtttgatttttctgaaaagaacaaaaacgaagcaaccaaggaagaagaagagaaaagaagagctcaagttgtttccaaacttcatggtatactacgaccattcatccttcgaagaatgaaatgtgatgttgagctctcacttccacggaaaaaggagattataatgtatgctacaatgactgatcatcagaaaaagttccaggaacatctggtgaataacacgttggaagcacatcttggagagaatgccatccgaggtcaaggctggaagggaaagcttaacaacctggtcattcaacttcgaaagaactgcaaccatcctgaccttctccaggggcaaatagatggttcatatctctaccctcctgttgaagagattgttggacagtgtggtaaattccgcttattggagagattacttgttcggttatttgccaataatcacaaagtccttatcttctcccaatggacgaaacttttggacattatggattactacttcagtgagaaggggtttgaggtttgcagaatcgatggcagtgtgaagctggatgaaaggagaagacagattaaagatttcagtgatgagaagagcagctgtagtatatttctcctgagtaccagagctggaggactcggaatcaatcttactgctgctgatacatgcatcctctatgacagcgactggaaccctcaaatggacttgcaagccatggacagatgccacagaatcgggcagacgaaacctgttcatgtttataggctttccacggctcagtcgatagagacccgggttctgaaacgagcgtacagtaagctcaagctggaacatgtggttattggccaagggcagtttcatcaagaacgtgccaagtcttcaacacctttagaggaagaggacatactggcgttgcttaaggaagatgaaactgctgaagataagttgatacaaaccgatataagcgatgcggatcttgacaggttacttgaccggagtgacctgacaattactgcaccgggagagacacaagctgctgaagcttttccagtgaagggtccaggttgggaagtggtcctgcctagttcgggaggaatgctgtcttccctgaacagttaggacacattaataagccaggccttgaaacc

SEQ ID NO: 518 - protein, 764 aa, Arabidopsis thaliana
MVSLRSRKVIPASEMVSDGKTEKDASGDSPTSVLNEEENCEEKSVTVVEEEILLAKNGDSSLISEAMAQEEEQLLKLREDEEKANNAGSAVAPNLNETQFTKLDELLTQTQLYSEFLLEKMEDITINGIESESQKAEPEKTGRGRKRKAASQYNNTKAKRAVAAMISRSKEDGETINSDLTEEETVIKLQNELCPLLTGGQLKSYQLKGVKWLISLWQNGLNGILADQMGLGKTIQTIGFLSHLKGNGLDGPYLVIAPLSTLSNWFNEIARFTPSINAIIYHGDKNQRDELRRKHMPKTVGPKFPIVITSYEVAMNDAKRILRHYPWKYVVIDEGHRLKNHKCKLLRELKHLKMDNKLLLTGTPLQNNLSELWSLLNFILPDIFTSHDEFESWFDFSEKNKNEATKEEEEKRRAQVVSKLHGILRPFILRRMKCDVELSLPRKKEIIMYATMTDHQKKFQEHLVNNTLEAHLGENAIRGQGWKGKLNNLVIQLRKNCNHPDLLQGQIDGSYLYPPVEEIVGQCGKFRLLERLLVRLFANNHKVLIFSQWTKLLDIMDYYFSEKGFEVCRIDGSVKLDERRRQIKDFSDEKSSCSIFLLSTRAGGLGINLTAADTCILYDSDWNPQMDLQAMDRCHRIGQTKPVHVYRLSTAQSIETRVLKRAYSKLKLEHVVIGQGQFHQERAKSSTPLEEEDILALLKEDETAEDKLIQTDISDADLDRLLDRSDLTITAPGETQAAEAFPVKGPGWEVVLPSSGGMLSSLNS

SEQ ID NO: 519 - DNA, 1702 bp, Arabidopsis thaliana
gcgcgtattcagcggcggtggagaaggttgcgtcgggtgcgcacacgtcacccaccactccgcggtgcactttagcacaattctcaaccggccacctccttctcggcccaatccatcattaacctaacttttctttctaacgtgcgcctctcctctcctccgcctctttattatcccttacccaccgctctttctactttcactaatttattcttcgccgccgcaatgacaatacccgatgatggatctcccgtcgccatggccatcgattcttccaccgccgtaaccgtcgccaccaccaccactcgaagagttcctcctccgtgctggaccgacgaggaaaccgctgcgcttgtcaatgcctacaaggataaatggttcgccctccgccgcgggaacctccgtgcggctgattgggatgacgtcgccgcggctgtttcgtcctcgtccaccgttggaggtccgccgaaatcagcaatccaatgtcgacacaagatcgagaagcttcggaaacgttatcgcggcgaaaaacaacgagctcttaatcgaccaggcaagttctcttcctcttgggatttgttccctatcttggatgctatgggattcgctccggtgactccggcagccgtagaaacttacgatcccgatgtggatcatgatgatgagagtaacggtttggatggatttagggttagatcgaagaggtctgggaagtttagcggtggttactctgattcacctcgagaagtaggagatggatatggggttagatctagggcaaggagtaacatgaaaatgtatggtggtttcaagtctgagtttgattcagatcacgattcaggaagtggatttggattgaaaaggaaatacaatgggaatccaaaggttagtgctgatttcgatgctgattctgatgatgagattgtgttagtccccaaggcaactaggcttaggactcatggcaagccttcctctggtgattttagccatggcagtggtggtgggtttccgttgaagtcgtttggtgatcggaattttgcttctcatgggtttaaacctaagaatttcagtaagcctgaacccaatttctctcaggatctggattatgatgatgagtttgatgatgatagagcagagagggaaggattcaacccgaggattcaaagttctaggagctcttcgcgggtgaatggctacagcaggaaggatgggagctatcctcgaaacactggtgcttccaatggctatggatcgtcttctaggttcaagcatgagcaaatgaatgcagcagcagaagttgagtctgacccgatcgatgaagttgtttcttctgttaagatgttgacagaaatgtttgtgagggtggagaattcgaagatggagatgatgagagagatggagaagtcgagaatggagatggagctgaagcattgccagatgatgcttgagtcacagcagcagatcataggcgcgtttgctgaagcgttgagcgagaaaaagagcacaaatgcaaggaggccggtttcgtagtagcaaagtcgcttattaaagaggaatgaaacggttcataatatggattttcatatggtataatgatcaaatagctttcgagtgtagtacgaagtgtcttcttcgagttactaggaaacaaaacggcagtgaaatttgatgcgagtaatgcaggttaagtttttcaattatt

SEQ ID NO: 520 - protein, 434 aa, Arabidopsis thaliana
MTIPDDGSPVAMAIDSSTAVTVATTTTRRVPPPCWTDEETAALVNAYKDKWFALRRGNLRAADWDDVAAAVSSSSTVGGPPKSAIQCRHKIEKLRKRYRGEKQRALNRPGKFSSSWDLFPILDAMGFAPVTPAAVETYDPDVDHDDESNGLDGFRVRSKRSGKFSGGYSDSPREVGDGYGVRSRARSNMKMYGGFKSEFDSDHDSGSGFGLKRKYNGNPKVSADFDADSDDEIVLVPKATRLRTHGKPSSGDFSHGSGGGFPLKSFGDRNFASHGFKPKNFSKPEPNFSQDLDYDDEFDDDRAEREGFNPRIQSSRSSSRVNGYSRKDGSYPRNTGASNGYGSSSRFKHEQMNAAAEVESDPIDEVVSSVKMLTEMFVRVENSKMEMMREMEKSRMEMELKHCQMMLESQQQIIGAFAEALSEKKSTNARRPVS

SEQ ID NO: 521 - DNA, 1025 bp, Arabidopsis thaliana
aaaggaagaagaagaagaagaaaggattcgtcttccttcttccacaccctttctgacacctcatctcccctcccaccttctccgtcccgttccgtttctccatcagatcctcgattccgatccaacagttcgaattcagtttccgattctgatctgatcgaaccaatactcactgagatttgatcggcgattatggagtctatatctccggtatcgaatcagcttcttcagccgacgacgacgagctctaattccgatcgctctcgtcgtaagcgtaagaagaaatcatcgccatcatcggttgagaaatctccatctccgtcaatatcgttggagaaatggagatcggagaagcagcaacagatctactcaacgaagctagttcatgctttaagagagctacgaatcagccaacaaccatcttcatcatcatcttcttcgattccacgtggaggtagagccgtacgtgaagtcgccgatagagctttagcagttgcggcgagaggtaaaacgttatggagtcgagcgatactttcaaaagctgtaaaactcaaattcaggaaacacaaacgccagagaatctctaatccgacgacgacgacgttaaccaccgggagtatcaggtcaaagaaacagagagcgacggttttgaggcttaaggctaaaggtttgccagctgtacagaggaaagtgaaagtactgagccggttagttcccggttgccgtaaacaatcattaccggtggttttagaagaaaccactgattatatagctgcgatggagatgcagattcgtactatgactgcgattctctccgccgttagttcttctcctccgccgccaacgccaggtcacgaagggggacaaacacacatgcttggttagttggccaaactgtccttttatttttttccaattttaaaaaccaaaaaaaaaactgtttttttttatcatattattattcttctcactgtattgtttgttgtttgaatattttactattcaactttatttaccatttcgtc

SEQ ID NO: 522 - protein, 230 aa, Arabidopsis thaliana
MESISPVSNQLLQPTTTSSNSDRSRRKRKKKSSPSSVEKSPSPSISLEKWRSEKQQQIYSTKLVHALRELRISQQPSSSSSSSIPRGGRAVREVADRALAVAARGKTLWSRAILSKAVKLKFRKHKRQRISNPTTTTLTTGSIRSKKQRATVLRLKAKGLPAVQRKVKVLSRLVPGCRKQSLPVVLEETTDYIAAMEMQIRTMTAILSAVSSSPPPPTPGHEGGQTHMLG

SEQ ID NO: 523 - DNA, 1402 bp, Arabidopsis thaliana
gggatgtttgtgaccttttgtctcttcttctctaaaattctctttctcccaaaaactaaaaaaccaaaaaaaccaaaaaatgtacgcaatgaaagaagaagactgtcttcaaacatttcacaacttacaagactatcaagaccagtttcatcttcatcatcatccacaaattctcccctggtcgtcgacatctttaccttcttttgacccactccatttcccatctaacccgacccgttattctgacccggttcactacttcaacagaagagcttcttcttcctcttcttcttttgactataacgacggttttgtctctcctcctccttccatggatcatcctcagaaccatctaaggattttatccgaagctcttggacccatcatgcgtcgtggctcgtcctttgggttcgatggtgagatcatgggaaaattgagtgcacaagaagtcatggatgctaaggctttagctgcttcaaagagtcatagtgaagctgagagaagaagacgagagagaatcaacactcatcttgctaagctgcgtagtatattaccaaacacaaccaaaacggacaaagcttctttgctagcggaagtgatccaacacatgaaggagctaaaacgacaaacatcacagatcaccgacacgtatcaagtcccaacagagtgcgatgatctgaccgtagattcgtcttacaacgacgaggaaggaaacttggtgataagagcatccttttgctgccaagacaggactgacctcatgcatgacgtcatcaatgccttaaagtctcttcgtcttcgaactctcaaagctgagatcgcaaccgtaggtggtagagtcaagaacatcttgttcttgagccgagaatacgatgatgaagaagatcatgattcatatcgtagaaacttcgatggtgatgacgtggaggattatgatgaagagaggatgatgaataatcgtgtgagttcgatagaagaagcgttaaaggcggttatagagaagtgtgttcataataatgatgaaagtaacgataacaataacttggagaaatcatcttcagggggtattaagaggcaaaggactagtaagatggtgaatcgatgttataattagttaattaagtcaagtctttattaactagggttagttaattagacttgcaaaatgggatttgattatgggttggtgatattagtattattttcggtgtttttagtagttgggattgggtttcttcttctatgtttttttaatctatgaagaaccctttgtttagggttttatagtgatgagtttggtttatatatggtagttaagacattttatcgtcttaattaatataggaaatgtatagagcttgggtttgtattaatttatcaagaagttttatttatcatattc

SEQ ID NO: 524 - protein, 344 aa, Arabidopsis thaliana
MYAMKEEDCLQTFHNLQDYQDQFHLHHHPQILPWSSTSLPSFDPLHFPSNPTRYSDPVHYFNRRASSSSSSFDYNDGFVSPPPSMDHPQNHLRILSEALGPIMRRGSSFGFDGEIMGKLSAQEVMDAKALAASKSHSEAERRRRERINTHLAKLRSILPNTTKTDKASLLAEVIQHMKELKRQTSQITDTYQVPTECDDLTVDSSYNDEEGNLVIRASFCCQDRTDLMHDVINALKSLRLRTLKAEIATVGGRVKNILFLSREYDDEEDHDSYRRNFDGDDVEDYDEERMMNNRVSSIEEALKAVIEKCVHNNDESNDNNNLEKSSSGGIKRQRTSKMVNRCYN

SEQ ID NO: 525 - DNA, 3300 bp, Arabidopsis thaliana
ataaacacggatacgagagaaagagagctcttgtgtccaaaccctagatttcaagatcgatctatcttctttctcgtgaagacaccgctctctactcgattcctatgattactctctagatccttttcaatttccccccgaaaggtttctcgattttgatcccccaaatcggagcttggagctaccggatcttatggagtgaagcccgatcatccgtttctttgttacaagttgtcgttttgtagctgcgaagattcctcggagaaggagatttggagacatcaccggcgccattctcagctcggcgatcacacggacgttctcgttccttgaatctgcaggaacttttccaggattcgttgatttggattgattttgctacacgcgtggagtttccttctgtgaagtcgaatcagcgaaatacaaattttcaatggcaatttattacaagtttaagagtgcaagggattatgataccattgccatggatggtccttttatatccgtcggtattctcaaagacaaaattttcgaaactaagcatttgggcactggtaaagaccttgatattgtcgtctccaatgcccaaactaacgaagagtatctggatgaagcaatgttaatcccaaagaatacatctgtccttattcgtcgggttcctggacgtcctcgcatcacagttattaccacacaagagcctagaatccagaataaagtggaagacgttcaggctgaaaccaccaattttcctgttgctgatccatctgctgctgaatttcctgaagatgagtatgacgagtttgggactgatctttattccattcctgatacccaagatgcccagcatattattccacgtcctcatcttgcaaccgcagacgacaaagtagatgaagaaagcaaaattcaggcgctgattgacactccagcacttgactggcaacaacgacaaggtcaagatacttttggagctggtagaggttatgggaggggtatgcctggaaggatgaatggacgtggttttggaatggaaaggaaaacgccacctccaggttatgtgtgccatcgttgcaatatccctggacattttattcagcattgccccacaaatggagaccctaactatgatgttaagagagttaagccacctactggtatccccaagtccatgttgatggcgaccccagatggttcttattccttgccaagtggcgcagttgcagttctgaaaccaaatgaggatgcttttgagaaggaaatggagggattgccatcaacaacacgttctgtaggagaacttccacctgagctaaaatgcccattatgcaaagaagtgatgaaagatgctgcgcttacaagcaaatgttgttacaagagcttctgtgacaagtgtatcagagatcacattatttcaaagtcaatgtgtgtttgtggaagatcagatgtacttgctgacgaccttctaccaaacaagaccctcagggataccataaaccgtattttggaagctggaaacgatagcactgagaatgtgggcagcgttggccatatcccagatttggagtctgcacgctgtccacctcccaaggctctatctcctactacatctgttgcatctaaaggcgagaagaaaccagtacttagtaacaataatgatgcttcaactttaaaggcgccaatggaagttgcagagatcacaagtgcccctcgtgcatctgcagaagtgaatgtagaaaagccagttgatgcatgtgaaagcactcaagggtccgtgattgtgaaagaagcaacagtgtcaaagttgaatacgcaagcccccaaggaagaaatgcagcagcaggttgctgctggagagccaggaaaaaagaagaaaaagaaaccaagagtgcctgggaatgacatgcaatggaatcctgtgccagatctagcaggccctgactatatgatgcaaatgggaccaggtccgcagtacttcaacggcatgcaacctggcttcaatggcgtacaaccaggcttcaacggtgttcaacctggcttcaatggctttcaccctggcttcaatggatttggaggcccgtttccaggcgcaatgcctccatttatgggttacggattaaacccaatggacatgggatttggtgggggtatgaatatgatgcatccagatccattcatggcacaaggatttgggttccctaatataccaccaccccatagggacctagctgaaatgggaaaccgaatgaatctccaacgtgctatgatgggcagagatgaagccgaagcccgaaacgctgagatgttaagaaaacgtgaaaacgagagacgacctgaaggggggaagatgtttagggatggagagaatagcagaatgatgatgaacaacggtacttcagcctctgcatcatccatcaaccctaataaatctagacaagcacctccaccaccaatccacgattacgatcgccggagacgaccggagaagagactatccccagagcatccgcctacgcgtaaaaacatttccccgtctcgcgactccaagagaaaatccgagcgttatcctgatgaacgagatcggcaacgcgaccgtgagaggtcacgtcaccaagacgtagatcgtgaacacgaccgtactcgcgaccgtcgcgatgaagacagaagccgagatcatcgccaccaccgtggtgaaaccgaacgcagccaacatcaccaccgcaagagatcggaaccgccttcatcggagccaccagtccctgctactaaagcagagatcgagaataatcttaagtctagcgtattcgctcggataagttttccggaggaagaaacatcttctggtaaacgaagaaaggtgccttcctcttcttctacttctgttacggatccatctgcttccgcctctgccgcagccgccgtgggaacatcagttcaccgacacagtagtcggaaggaaatagaagtagcagattatgaatctagtgatgaagataggcatttcaagaggaagccgtcaaggtacgcgcgatcaccaccggtggtggttagtgatgtgagtgaagataaactccgatactcaaaacgtggaaagggggagagatctcgagcttgacatggattttcaaacatgtttttttttttttttgtataatcaaaaacagagaatgagaatcttcttgttttgctgtaacgaacaaagagagagagttcttttgtcatcgaattcttttttaatttttgtagtggaattcgatttcgtaactactttattcttaatctatgagaccagcgaatttacag

SEQ ID NO: 526 - protein, 892 aa, Arabidopsis thaliana
MAIYYKFKSARDYDTIAMDGPFISVGILKDKIFETKHLGTGKDLDIVVSNAQTNEEYLDEAMLIPKNTSVLIRRVPGRPRITVITTQEPRIQNKVEDVQAETTNFPVADPSAAEFPEDEYDEFGTDLYSIPDTQDAQHIIPRPHLATADDKVDEESKIQALIDTPALDWQQRQGQDTFGAGRGYGRGMPGRMNGRGFGMERKTPPPGYVCHRCNIPGHFIQHCPTNGDPNYDVKRVKPPTGIPKSMLMATPDGSYSLPSGAVAVLKPNEDAFEKEMEGLPSTTRSVGELPPELKCPLCKEVMKDAALTSKCCYKSFCDKCIRDHIISKSMCVCGRSDVLADDLLPNKTLRDTINRILEAGNDSTENVGSVGHIPDLESARCPPPKALSPTTSVASKGEKKPVLSNNNDASTLKAPMEVAEITSAPRASAEVNVEKPVDACESTQGSVIVKEATVSKLNTQAPKEEMQQQVAAGEPGKKKKKKPRVPGNDMQWNPVPDLAGPDYMMQMGPGPQYFNGMQPGFNGVQPGFNGVQPGFNGFHPGFNGFGGPFPGAMPPFMGYGLNPMDMGFGGGMNMMHPDPFMAQGFGFPNIPPPHRDLAEMGNRMNLQRAMMGRDEAEARNAEMLRKRENERRPEGGKMFRDGENSRMMMNNGTSASASSINPNKSRQAPPPPIHDYDRRRRPEKRLSPEHPPTRKNISPSRDSKRKSERYPDERDRQRDRERSRHQDVDREHDRTRDRRDEDRSRDHRHHRGETERSQHHHRKRSEPPSSEPPVPATKAEIENNLKSSVFARISFPEEETSSGKRRKVPSSSSTSVTDPSASASAAAAVGTSVHRHSSRKEIEVADYESSDEDRHFKRKPSRYARSPPVVVSDVSEDKLRYSKRGKGERSRA

SEQ ID NO: 527 - DNA, 1968 bp, Arabidopsis thaliana
gttctcttctcttctcaaaattttttgtttctttttgtctcaagctatgaacttccatactttgaatcttctacttctctttcttcctcttacttgatcttcctatagcatacttccatcatgggtgaagatgatatagtggagctcttatggaacggccaagtcgttcgaaccagccaaccacaaagaccttcctcgggtaaaccttctcctactccacccattctgcgtggtagcggaagcggcagcggagaagaaaatgctccccttccacttccacttctacaacctccacgtcccctgcatcatcagaatctcttcattcgggaagaagaaatgtcttcttggcttcactattcttacactggtgtcacgtccacaccggctactcatccgcaaagttctgtttccctgccaccaccaccacccattgctccgtacatttccggtttggattttggtttgaaattaggagtgaagatgatgtggtggaactcttatggaaaagcggccaagtcgttcaaagcatccagacacagagacccattcctcctcccattttccgcggcagcggaagtgggggaggaagacgaaatggcctcttggctttaccatcccctccgtcaagattatttttcctctggcgtcgcctctacttcagctactcgcccgcaaagttccgcctctctagcaccaacaccaccaccacccagtgttccctacggtcagattcccgttgagagaaggacagagaattttatgaacttcttgaggctaagagggaacatattttccggcggtagagttgaagctggtccggtggttatagaatcgacgcagataggctcaagcgcgaccccgtcgtcttcagccgctgaatcctgtgtaataccagcgactcacggcaccgagagtagagcggcggccattaccggagtatcccgtacttttgcagttcctggtcttggtcggaggggaaaggaggtggcaaccgagacggccggaacatcatattcaggggtaaacaaggccgaaacagagcgggttcaaatacaaccggagagggagacgaaaattaccgaagataagaagagagaagaaaccattgcagaaatccaaggaactgaagaagctcatggttcaacgtctaggaagaggtcacgagctgcagatatgcataacctctccgaaaggagacggagggaaaggatcaacgagaggatgaaaactctgcaagaactccttcctcgctgcagaaagactgataaagtttcaatgcttgaagatgttatcgagtacgtgaaatcgctacagctgcaaatacagatgatgtcgatgggacatggtatgatgccaccgatgatgcatgaggggaatacgcaacagttcatgccccacatggccatggggatgaagggtatgaaccggcctcctcctttcgtaccgttccccggcaaaacttttcctaggccgggtcatatggcaggtgtaggtccatcatacccagcattgcgctacccttttccagacacacaagcctctgacctatccagagtccatgtaccaagtctgcactctaacccggtgccaaaccagcctcggtttccggcttacataaatccctatagccagtttgttggtctccaccagatgcaacaacctcctcttccattgcagggtcaaccaacatcacagcctagtttcagccacgcaagtactagcaagtaacttggggatcaggacaaccaaccaacaagttagtaggaatcaggaacagccagaggcttttcttgccggatacattaatggtcaagattctgacagatggatctccattgtgttattgcaagttgatgttgaagagttaaaaaaaaaggatctgttctctaagaaaagcacaattttgaaggtgctaacatgcaaatgtttttcagaaaatgaaaatctatttcttcccggaaaaaaaaa

SEQ ID NO: 528 - protein, 535 aa, Arabidopsis thaliana
MGEDDIVELLWNGQVVRTSQPQRPSSGKPSPTPPILRGSGSGSGEENAPLPLPLLQPPRPLHHQNLFIREEEMSSWLHYSYTGVTSTPATHPQSSVSLPPPPPIAPYISGLDFGLKLGVKMMWWNSYGKAAKSFKASRHRDPFLLPFSAAAEVGEEDEMASWLYHPLRQDYFSSGVASTSATRPQSSASLAPTPPPPSVPYGQIPVERRTENFMNFLRLRGNIFSGGRVEAGPVVIESTQIGSSATPSSSAAESCVIPATHGTESRAAAITGVSRTFAVPGLGRRGKEVATETAGTSYSGVNKAETERVQIQPERETKITEDKKREETIAEIQGTEEAHGSTSRKRSRAADMHNLSERRRRERINERMKTLQELLPRCRKTDKVSMLEDVIEYVKSLQLQIQMMSMGHGMMPPMMHEGNTQQFMPHMAMGMKGMNRPPPFVPFPGKTFPRPGHMAGVGPSYPALRYPFPDTQASDLSRVHVPSLHSNPVPNQPRFPAYINPYSQFVGLHQMQQPPLPLQGQPTSQPSFSHASTSK

SEQ ID NO: 529 - DNA, 1144 bp, Arabidopsis thaliana
actagttctccacaaatctctcttctctctctctcttctcctagaagctgattttcagaggcaacagcaatgagtatcttatccacaagatggttttctgagcaggaaatagaagaaaatagcataattcaacagtttcacatgaactcaatagtgggagaggtccaagaagctcaatacatttttccacactctttcacgaccaacaatgatccctcttatgatgatttgatcgaaatgaaaccaccaaagatccttgagacaacttacatatcaccttcttctcatcttcctccaaattcaaagccccatcatattcaccgtcattcttcctcaagaattctctctttcgaagattatggttcaaatgatatggaacacgagtactctcccacctacctaaactcaatctttagcccaaaattagaggctcaagtgcaaccacaccagaagagtgatgagtttaatcgaaaagggaccaagagggctcaaccgttttcaagaaaccaatccaatgctcaggatcacataatagccgaaagaaaacgtagagagaagcttactcaaagattcgtagctctttccgctctagttcctggccttaaaaagatggacaaggcttctgtgttgggagatgcattaaagcatataaagtatctccaagaaagagtgggagagttggaggaacagaagaaagaaagaagattggaatcaatggttcttgtgaagaagtctaagctgatcttggacgataataatcaatcattctcttcttcttgtgaagatggcttctcggacttggatcttcccgagatcgaggtaagattctcggatgaagatgttctaatcaagatcctttgcgagaagcaaaagggtcatcttgccaagattatggccgagattgagaaacttcatatcttgataactaattcaagtgtattgaattttggaccaactcttgatatcaccattatagctaagaaggagagtgatttcgacatgacactcatggatgttgtaaagagcttaaggtctgctttgtcgaatttcatatgattgtattaactttcatgcttctcgtcaatttctactgtgggagatcttgttgaacacatggacgaaacataagtggtttgccatgaaa

SEQ ID NO: 530 - protein, 328 aa, Arabidopsis thaliana
MSILSTRWFSEQEIEENSIIQQFHMNSIVGEVQEAQYIFPHSFTTNNDPSYDDLIEMKPPKILETTYISPSSHLPPNSKPHHIHRHSSSRILSFEDYGSNDMEHEYSPTYLNSIFSPKLEAQVQPHQKSDEFNRKGTKRAQPFSRNQSNAQDHIIAERKRREKLTQRFVALSALVPGLKKMDKASVLGDALKHIKYLQERVGELEEQKKERRLESMVLVKKSKLILDDNNQSFSSSCEDGFSDLDLPEIEVRFSDEDVLIKILCEKQKGHLAKIMAEIEKLHILITNSSVLNFGPTLDITIIAKKESDFDMTLMDVVKSLRSALSNFI

SEQ ID NO: 531 - DNA, 2493 bp, Arabidopsis thaliana
tggctgatcttttttttttccgatcagatcgaagagtttttatctcgtaattcgaactttttatttggtttctctgacttagagatctccaagcttcacgtaatttgctgtcgaagaagatctatcgattccacgaatttggtgacttctgccgattctcccgtttgaattctgtggaattcgctgagaaaagttgcggcggaggctgatttaggttaaatcgagcagaatttgaccaaattcgaggatttttatcggtaaaaagatacagagaaagcataattcagcaacttcagagctcaattccgcttcttcaaccatcgaaaaccacaatatctcttgaatcagctgctacaagtcgcagatctgagctgctagccaatttttgcgataattcccgcgcacagattagtaatagaataatttaaaaagaattcaaaaaccgtcgaagctctgtcgttcatggagcttcctcaacctcgtcccttcaaaacccaagggagaaaaccaacacatgattttttatcgctctgcagtcattcaaccgtccacccagatccaaagccaacaccaccaccttcttctcaaggtagtcacttgaaaacccatgattttcttcaaccgttagaatgtgttggtgctaaagaagacgtaagtaggattaactctaccactacagcgtccgagaagccaccgccccctgctccacctccaccgttgcagcacgtgcttcccggtggtatagggacttatacgattagccccattccttacttccatcatcatcatcagagaattcctaagccggagttgtcaccaccaatgatgttcaatgctaatgagagaaacgttttggatgagaattctaactctaattgcagctcgtacgccgctgcatcaagcgggttcactctgtgggatgaatctgcttctgggaagaagggacagacaaggaaggagaatagtgttggggagagagtaaacatgagagctgatgttgcagcaactgtgggacaatggccagtggcggagagacggtcccagtctttgacaaacaaccatatgagcggtttcagttctctctcttcctctcaagggtctgtgcttaagagccagagcttcatggacatgataaggtcagcaaaaggaagttcacaggaagatgatttagatgatgaagaagattttatcatgaagaaagaaagctcctcgactagccagagccatagagtggatttgagggtaaaagcagatgtgagaggctctcctaacgatcaaaagctgaacacacctaggtctaaacattctgctacagagcaacggagaaggagcaagatcaatgatagatttcagatgttgagacaactaatacctaacagcgaccaaaagcgggataaggcctccttcttactagaggttatcgagtatattcaattcttacaagagaaagcagacaagtatgtgacctcttaccaaggatggaatcacgaacctgcgaagctattgaattggcagagtaacaacaaccaacagctagtacctgaaggagttgcttttgctccaaaattggaagaagagaaaaacaacattccggtttcggtccttgcaactgcacaaggtgttgttattgatcatccaacaaccgcgacgacctctccatttccattgtcgattcaaagcaacagttttttctctcctgtgattgcgggtaatcccgtaccccagttccacgcaagagtcgcatcatcagaggctgtagagccaagtccgagttcccggagtcaaaaagaagaagaagatgaggaagttcttgagggtaacatcagaatttcaagtgtttactcacaaggattagtgaaaacactgagagaagcattggagaattcaggagtggacttaacgaaagcaagcatctccgttgaaatcgagctcgctaaacaatcctcgtcttcttccttcaaggatcatgaagttcgtgaaccggtttctcgaaccagaaacgacaatgtcaagcaaactcggaaaccaaaacggctcaagacgggacagtagaagttataaaaacaaaacccaaacacacaatccggtaaaagttaaacaccaaaattgattcctctgtttttttctttaaatcattttatctcaaaaagggattataatttattattatagttatatctttgatttttttcttttgtacatccgaaatcctgttatatatatctcgtgggtccataatcgtatgagacctaagaagactagggcgacccggttatgctaaccgcattttagaacatactcttttgaggaatatatcgttaaggaaggctttcaaagttttctggaagcgtccagtgttaagtgaaaacatttttcactctcttatatacttgatcatctcacactttttatatttgtttcttcctcttactttgttctatggttttcaatgtaattccctggaaaaaaaaaaaaaaaaaaaaaaaaaaaaaa

SEQ ID NO: 532 - protein, 529 aa, Arabidopsis thaliana
MELPQPRPFKTQGRKPTHDFLSLCSHSTVHPDPKPTPPPSSQGSHLKTHDFLQPLECVGAKEDVSRINSTTTASEKPPPPAPPPPLQHVLPGGIGTYTISPIPYFHHHHQRIPKPELSPPMMFNANERNVLDENSNSNCSSYAAASSGFTLWDESASGKKGQTRKENSVGERVNMRADVAATVGQWPVAERRSQSLTNNHMSGFSSLSSSQGSVLKSQSFMDMIRSAKGSSQEDDLDDEEDFIMKKESSSTSQSHRVDLRVKADVRGSPNDQKLNTPRSKHSATEQRRRSKINDRFQMLRQLIPNSDQKRDKASFLLEVIEYIQFLQEKADKYVTSYQGWNHEPAKLLNWQSNNNQQLVPEGVAFAPKLEEEKNNIPVSVLATAQGVVIDHPTTATTSPFPLSIQSNSFFSPVIAGNPVPQFHARVASSEAVEPSPSSRSQKEEEDEEVLEGNIRISSVYSQGLVKTLREALENSGVDLTKASISVEIELAKQSSSSSFKDHEVREPVSRTRNDNVKQTRKPKRLKTGQ

SEQ ID NO: 533 - DNA, 1016 bp, Arabidopsis thaliana
aaagaagttgtcagaaaaaaaaaaaaaaaaaagtgtcaagaagatcatatctcaattcattatattatggcaaatttcgagaatctttcttctgattttcagacaatagccatggatatatattcttccataactcaagctgcagatctaaacaacaacaacagtaaccttcattttcaaacatttcatccttcctctacttctctcgaatcgctcttccttcatcatcatcaacaacaattacttcactttcccggaaactctccagacagtagtaacaatttctcttcaacttcaagtttcctccatagtgatcacaacatcgtcgatgagaccaagaagagaaaagctttgttacctactttgtcttcatcagagactagcggcgtctccgataatacgaatgttattgccactgaaacaggttctttgagaagaggtaagaggttgaagaagaagaaggaagaagaagacgagaaagagagagaagttgttcatgtgagagccagaagaggccaagccactgatagccacagcttagcagaacgggttcggcgagggaaaataaacgagagattaagatgcttgcaagatatggtgcccggatgttataaggctatgggaatggctacgatgcttgacgagataattaattatgtccagtctctacagaatcaagtcgagttcctctcgatgaaactcactgcagcaagttcgttttatgactttaactcagagacagatgcagttgattccatgcagagagcaaaggcacgtgagacagtggagatggggagacaaacaagagatgggagtcctgtcttccatttatcaacatggtccctttgacttttgttttctcttttctcttttccttcttttttattgttttcgaaattattcttctatttatttggatgcgatatgtcatatatacgacccaacttgggataatatttgtaatctgtatacttgtaatttcgacgatataaatttattggtgacttataattgtc

SEQ ID NO: 534 - protein, 260 aa, Arabidopsis thaliana
MANFENLSSDFQTIAMDIYSSITQAADLNNNNSNLHFQTFHPSSTSLESLFLHHHQQQLLHFPGNSPDSSNNFSSTSSFLHSDHNIVDETKKRKALLPTLSSSETSGVSDNTNVIATETGSLRRGKRLKKKKEEEDEKEREVVHVRARRGQATDSHSLAERVRRGKINERLRCLQDMVPGCYKAMGMATMLDEIINYVQSLQNQVEFLSMKLTAASSFYDFNSETDAVDSMQRAKARETVEMGRQTRDGSPVFHLSTWSL

SEQ ID NO: 535 - DNA, 1531 bp, Arabidopsis thaliana
atcaacaatctctcatctttagcattgttttgttatcttcttcttcatcacaatttttctacggtcagagattcaaaagagttctttctctctatcttattctccgatcatcatgatgcagcagccaccacccggaggtatccttccacatcacgctcctcctccttctgcgcaacaacagtacggttaccaacaaccttacgggattgctggagctgctccaccaccaccacagatgtggaatcctcaagcggcggcgccgccatcagttcagcctacgaccgctgacgagatccggactctttggatcggggacttacagtattggatggatgagaatttcctctacggttgctttgctcataccggagagatggtttctgctaaagtgattcgtaacaagcaaaccggtcaagttgaaggatacggtttcattgaattcgcatctcatgctgctgctgaaagagttctacaaacattcaacaacgctcctatcccgagctttcctgatcagctctttagactgaactgggcatcattgagttcaggagataaacgagacgattcaccggactacacgatatttgtcggtgatctggctgctgatgttacggattatatcttacttgagacgttcagagcctcttatccgtcagtgaagggtgcaaaggttgttattgacagagtcactggacgtacaaaaggatatgggtttgttaggttttctgatgaaagtgaacagatccgtgctatgacggagatgaatggcgttccttgttctactagacctatgagaattggtcccgctgctagcaagaaaggtgtaactggtcaaagagattcataccagagctctgctgcaggggtaacaactgataatgatccaaataacacaactgtttttgttggtggattagatgcatctgtcacggatgatcatctgaagaatgtctttagccaatatggtgagattgtgcatgtgaaaatacccgctggaaagcgctgtggattcgttcagttttccgagaagagctgtgcagaggaagctcttagaatgctgaatggagtgcaattaggcggaacaaccgtcaggctctcatggggccgaagtccttcgaacaaacagtcgggggatccgagccagttttactacggtgggtatggacaaggacaggagcagtatgggtacacgatgcctcaagaccctaatgcatattacggaggctactctggtggaggatacagcggtggttaccagcagacaccacaggcaggacagcaaccaccacaacagccaccacagcagcaacaagtcgggtttagctactaaccccgagagtattgcttgagttaatgtcactctgcttgttgtttgcgtactttgttatgaacttgtttctgcgtgccttgttatgaatattttcccaaacacagtttatttgtctttgcttttctctaggtgtgtgttgagtttttaactcttaataatgtttctgcgatgcttctgtttttaatgttttcatcacctttt

SEQ ID NO: 536 - protein, 405 aa, Arabidopsis thaliana
MMQQPPPGGILPHHAPPPSAQQQYGYQQPYGIAGAAPPPPQMWNPQAAAPPSVQPTTADEIRTLWIGDLQYWMDENFLYGCFAHTGEMVSAKVIRNKQTGQVEGYGFIEFASHAAAERVLQTFNNAPIPSFPDQLFRLNWASLSSGDKRDDSPDYTIFVGDLAADVTDYILLETFRASYPSVKGAKVVIDRVTGRTKGYGFVRFSDESEQIRAMTEMNGVPCSTRPMRIGPAASKKGVTGQRDSYQSSAAGVTTDNDPNNTTVFVGGLDASVTDDHLKNVFSQYGEIVHVKIPAGKRCGFVQFSEKSCAEEALRMLNGVQLGGTTVRLSWGRSPSNKQSGDPSQFYYGGYGQGQEQYGYTMPQDPNAYYGGYSGGGYSGGYQQTPQAGQQPPQQPPQQQQVGFSY

SEQ ID NO: 537 - DNA, 1366 bp, Arabidopsis thaliana
caaaaacaaaaaaaaacaatggaactatcattagcattaacatcaacagaccataatccatcgccttcagaggcacatccagatactatggactttctgtctcgagaatggtgtaatttcgctgttcaatcacttcatccagaccctatcctctacgatcgttccattgttcccgtcgagacatcgatcgccaagtttcaaggcgactcaagtcctgtttcttgtgctatgatggatacgagcatgaagatggacgatccagattttaagccctcgatgccttcatggaaaaccaatgatgtgaagtcatggatatggatgcaacaagcaatgcacccggaattgagctacgaaggctttttccgcaagaaacttaaacttccatggaaaattacgccgtcgataaagaaatggtggaaagagataaaggcgaaacgaaaggaagaagtgaggctacagagagctgaagtccacgccgccgtgtcattggctggtcttgccgctgctctcgccgccgtggcttcagagaacgctggaaaagatggtggaaacggtcgacctagcacgagggagactgctgtggcttctgctgcggctgtggtggcggcacaatgtgcgcaaatggcagagacaatgggagcaaacagagaccagctcagcacgatgattggttcagccatgaccgggacaagtgttagtgagatactcactctcactgcctcagctacaacttcgttgagaggtgccgcgacgctgaaagcaagaagaggttgcaagattaatagattgaatggctctgcacctgtgttgcctattgaagactcttcttatttgcctcctgaattcgataagaacacatctgttcttgctaagggaacagatctcttcgtcgagacaccagatggggatttcaaggctaggacggtttctatggtcttaaacaaagatggaaaggtgattcttaaaatgaagaaacataatctactcaggactaagaaagaaagtattgtgacgaatgttcatgtggaactttacaaagattcagatagcgaagacaacaacatagaggacacttgttatctcattgtcctgaggacgaacagaggagctatcaagttagacatggccgacgattacaatcgttacaagacatgggtcacaacgatccaacacatgctcactctctcttcttcctccttaagtacaaattacgctctcactttctacaacaaaaactaaaaaaattcatcgccttgttcatcgtttttctctgtgtaattttactttatcccctcctctgttttcttatgtctctctcgcttgatcttataatgtaatgcataaacaacttgagaacttacgttct

SEQ ID NO: 538 - protein, 406 aa, Arabidopsis thaliana
MELSLALTSTDHNPSPSEAHPDTMDFLSREWCNFAVQSLHPDPILYDRSIVPVETSIAKFQGDSSPVSCAMMDTSMKMDDPDFKPSMPSWKTNDVKSWIWMQQAMHPELSYEGFFRKKLKLPWKITPSIKKWWKEIKAKRKEEVRLQRAEVHAAVSLAGLAAALAAVASENAGKDGGNGRPSTRETAVASAAAVVAAQCAQMAETMGANRDQLSTMIGSAMTGTSVSEILTLTASATTSLRGAATLKARRGCKINRLNGSAPVLPIEDSSYLPPEFDKNTSVLAKGTDLFVETPDGDFKARTVSMVLNKDGKVILKMKKHNLLRTKKESIVTNVHVELYKDSDSEDNNIEDTCYLIVLRTNRGAIKLDMADDYNRYKTWVTTIQHMLTLSSSSLSTNYALTFYNKN

SEQ ID NO: 539 - DNA, 1128 bp, Arabidopsis thaliana
actttctctttgttttctttctaacctctttccacgaaaagtcacgatgggagataccgcagaggatcaggacgaccgagctatgatggaagctgaaggagtaacgagcttctccgaacttcttatgttctctgacggcgttctcagctcctcttccgaccaccaacctgagggtaatgtcggcgatggtggagaagacagtttaggttttgtattctccggcaaaactggctcaagaatgctctgttttagtggaggctatcaaaacgacgacgagtcactcttcctagaaccttctgttccaacctccggagtctctgatcttgacccttcatgcattaagattgattgcaggaactcaaacgacgcgtgtacggtcgataaatctactaaatcatcaaccaagaagagaaccggaacgggtaatgggcaagagtcggatcaaaatcgaaaaccgggcaagaaagggaaacgaaatcaagagaaatcatcagttggaattgcaaaggtcaggaaagaaaggttaggggaaagaattgcagcgttgcagcagttggtttctccatacggcaagacagatgcagcttctgtgttgcatgaagcgatgggttacatcaaattcttacaagatcagattcaagtcctttgctctccttatctaatcaaccattctcttgacggtggagttgtcaccggagatgtaatggcggcgatgaaagcgaaagacttgagaagcagaggattatgtctagtacctgtctcatccaccgtacacgtggaaaattccaacggtgctgatttctggtcacctgctactatgggtcacactacgtcaccgtcgttacctcaaggattttaattaaacggtcgtaggctgatatatattagtagtattttagtagccttttttcttgggttttgtttttggctgaagaactattactagtaaatgttacacccagacatttttttgggattatctgggtggtataaaaaggttggaatcttttgtgtttgtaaaattagattgtctaagttttcttaaagtttctttgatgtcactgtcacagttgcgacgagtagtgatggtacttactgaaaggctaagcttattcacgctcttaaagt

SEQ ID NO: 540 - protein, 270 aa, Arabidopsis thaliana
MGDTAEDQDDRAMMEAEGVTSFSELLMFSDGVLSSSSDHQPEGNVGDGGEDSLGFVFSGKTGSRMLCFSGGYQNDDESLFLEPSVPTSGVSDLDPSCIKIDCRNSNDACTVDKSTKSSTKKRTGTGNGQESDQNRKPGKKGKRNQEKSSVGIAKVRKERLGERIAALQQLVSPYGKTDAASVLHEAMGYIKFLQDQIQVLCSPYLINHSLDGGVVTGDVMAAMKAKDLRSRGLCLVPVSSTVHVENSNGADFWSPATMGHTTSPSLPQGF

SEQ ID NO: 541 - DNA, 1497 bp, Arabidopsis thaliana
atgaacaagagtaatcctgctggttcggtgactggttcggatataatagacgccaagatcgaagaacatcaactttgtggatccaagaagtgtcctagctgcggccacaagctcgaaggcaaaccacaggattgggttggtttaccagcaggagtgaaatttgacccaacggatcaagaattgatagaacatttagaagcgaaagtgttagctaaagacttcaaatctcaccctctcattgacgaattcatcccaaccattgaaggcgaagacggcatttgctacactcatcccgagaaacttcctggagtgactagagatggtttaagccgacacttctttcatagaccatcaaaggcgtacacgacgggaacaagaaagcgaagaaagattcaaacagaatgtgacaataatttgcaaggaagtagtagctccggtgagacgaggtggcataagaccggtaagacaagaccggttatggtaaacggtaagcaaaaaggttgtaagaagattttggttttgtataccaattttggtaagaatcgaaaaccggagaaaaccaattgggtaatgcatcaatatcatttggggacacatgaggaagagaaagaaggagaacttgttgtgtctaagatcttttatcaaactcagcctaggcaatgcaactggtcgtcttctacatcgagcttgaacgctataggtggtggcggcggtgaagcgagtagcggcggaggcggcggagagtatcatatgaggagagatagtgggactactagtggtgggagttgttcttcgtctagagaaattattaatgttaatcctccgaatcgatccgatgaaataggcggcgttggtggtggcgttatggccgtagcagctgcggctgcggcggttgcagctgggcttccgagttatgcaatggatcagctcagctttgttccgtttatgaaaagctttgatgaggtggcgaggagggaaactcctcagactgggcacgctacatgtgaggatgtaatggcagaacaacatcgtcatcgtcatcaaccatcatcatcaacatcacatcatatggctcatgatcatcaccatcatcatcatcaacaacaacaacaacggcatcatgcattcaacataagccagcctacacatccgatatcaaccattatttctccatctacttcgcttcaccatgcctccattaatattcttgacgataatccttatcatgttcatagaatcttgctccccaatgaaaattaccagacacaacagcaactacgtcaagaaggagaagaagaacataatgatgggaagatgggaggaaggtcagcttccggattggaagaactcataatgggctgcacttcttctaccactcatcatgatgtaaaagatgggtcatcatcaatggggaaccaacaagaagcagaatggttgaagtactcaacgttttggccagcccctgactcttctgacaaccaagatcatcatgggtaa

SEQ ID NO: 542 - protein, 498 aa, Arabidopsis thaliana
MNKSNPAGSVTGSDIIDAKIEEHQLCGSKKCPSCGHKLEGKPQDWVGLPAGVKFDPTDQELIEHLEAKVLAKDFKSHPLIDEFIPTIEGEDGICYTHPEKLPGVTRDGLSRHFFHRPSKAYTTGTRKRRKIQTECDNNLQGSSSSGETRWHKTGKTRPVMVNGKQKGCKKILVLYTNFGKNRKPEKTNWVMHQYHLGTHEEEKEGELVVSKIFYQTQPRQCNWSSSTSSLNAIGGGGGEASSGGGGGEYHMRRDSGTTSGGSCSSSREIINVNPPNRSDEIGGVGGGVMAVAAAAAAVAAGLPSYAMDQLSFVPFMKSFDEVARRETPQTGHATCEDVMAEQHRHRHQPSSSTSHHMAHDHHHHHHQQQQQRHHAFNISQPTHPISTIISPSTSLHHASINILDDNPYHVHRILLPNENYQTQQQLRQEGEEEHNDGKMGGRSASGLEELIMGCTSSTTHHDVKDGSSSMGNQQEAEWLKYSTFWPAPDSSDNQDHHG

SEQ ID NO: 543 - DNA, 528 bp, Arabidopsis thaliana
atgatgaagtcaagacgtgaacaatcaatcgaagaagcaatcgtcgcaaattatttgaagatgatgatcgataacgtaaacgtttggcctcgccacttcctccgaagcgaagacgtgtactgcaagaatccgtggacgcttttcgttactagagatcctataatcctacacttcggacgatacttcttcgttaatcggagtgtgaattcaggtttaaccgatggatgtgaatacggttgttggagaatcatcggtcgtgatagagtgatcaagtcggtgacgaccgggaagattctagggttaaagaaggtttataagttctgtgaaactgatcggaaaccgaaatcggtttttaagttcttggaaaaggagaagagaagagtaagagatagacgaatctgggcgatggaagagtataggtttgcaagtacgtggaaacaagattacgtgatctgcaagattcgacgtctgtatccacaaccatttgactacatgttggcccagcacattcgaggttactataaatga

SEQ ID NO: 544 - protein, 175 aa, Arabidopsis thaliana
MMKSRREQSIEEAIVANYLKMMIDNVNVWPRHFLRSEDVYCKNPWTLFVTRDPIILHFGRYFFVNRSVNSGLTDGCEYGCWRIIGRDRVIKSVTTGKILGLKKVYKFCETDRKPKSVFKFLEKEKRRVRDRRIWAMEEYRFASTWKQDYVICKIRRLYPQPFDYMLAQHIRGYYK

SEQ ID NO: 545 - DNA, 735 bp, Arabidopsis thaliana
atggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattga

SEQ ID NO: 546 - protein, 244 aa, Arabidopsis thaliana
MEELDFSSKTTTSRLKLFGFSVDGEEDFSDQSVKTNLSSVSPERGEFPAGSSGRSGGGVRSRGGGGGGGERKYECQYCCREFGNSQALGGHQNAHKKERQQLKRAQLQATRNAAANFSNAGSASQFLRNPIVSAFAPPPHLLSSSAVPQPMGGPWMYLPRVSPSQLHVSHGCVIQDGSGGAGAGGFSYEYGARDSGFGVVGAQMRHVQAHGPRPSVNGFSREVGTTFDDGLGLDLHLSLAPAGH

SEQ ID NO: 547 - DNA, 1111 bp, Arabidopsis thaliana
gccaggatttgaaattaactaaataacaaatatattgactttgaattcatgaatttcaatatattaccttttttgcacttcaaaaatatataaaaggatacatagggaaataatttagatacacttagagctacaaaatgtcttccatcccaaataggttcaatatttatggtggtgataccacaaaccatcgtgaatcgcttcccatcgaaatgaatcacaactctcgaatggttcgatccatgttcattacatctgatcgcatgaatcatagagatttgttttcttctcctccttctttctcttcttatcaaaattcacatatctcttcatcttctgttgggtttaataattcacatatgacttatcatatgctgaaaagaaattatgattctgtttcccgtgctgattatttctctactaaagatcattctcattttactcaagtatctttcactcaaaccatcacaaataagtatactactattgttccttccaatatatttgacactgttcactatgatattggtcgtgtcaaacgtgccatagattttagaaatatttggaatcctaaatctcatcttccaaaaaaatttaataggcaatgcgagattttgaatcctacccctcttaatatcgtctttccgcaccaggattcagctgatcgtcaacatttagacattattttctcgtcatcaaagcacaaccatgttttccaagatggtcgatccttgaagaaaatttccgaaccaaccaatctgtttgaaaaatctaattcttatgattctcaagaagatgagaaaatcgatgcttatcaatatgatggtcgtacacatagtctaccgtatacgaaatacggtccatatacatgtcccaggtgtaacggtgtgtttgatacttctcaaaaatttgctgcacatatgttatctcactacaataatgagacggacaaagaaagagaccaaagatttcgtgcaagaaataaaaaacgatatcgtaagtttatggacagtcttaaaatatcaaaacagaagatatgatccgtcgcgatgggacgatccgcggccgccggtggtgaggcagatttcagcgtgctggggcgatcgcggcc

SEQ ID NO: 548 - protein, 300 aa, Arabidopsis thaliana
MSSIPNRFNIYGGDTTNHRESLPIEMNHNSRMVRSMFITSDRMNHRDLFSSPPSFSSYQNSHISSSSVGFNNSHMTYHMLKRNYDSVSRADYFSTKDHSHFTQVSFTQTITNKYTTIVPSNIFDTVHYDIGRVKRAIDFRNIWNPKSHLPKKFNRQCEILNPTPLNIVFPHQDSADRQHLDIIFSSSKHNHVFQDGRSLKKISEPTNLFEKSNSYDSQEDEKIDAYQYDGRTHSLPYTKYGPYTCPRCNGVFDTSQKFAAHMLSHYNNETDKERDQRFRARNKKRYRKFMDSLKISKQKI

SEQ ID NO: 549 - DNA, 1367 bp, Arabidopsis thaliana
ttttgtcggtttatgcagcactcgtcttcattcatagattttgatttgaggtaaactaaactcatcagatattaaaaatgggttctttacttctttcgatttcgtgtgtaaaggagaaacctttattgattctttcttgcttgtttgctgtttgatcatttgtctaagagaagaaggtcaaattttcaaatggaggaagggaaagagaattcgtttttgtgcaagtactgttacaagacgtttccttctgggaaagcactcggtggtcacattagaattcatacgaacgagaattcagttggttacaatggcaataagaagaagaggttggtggatcagagaaagatgatggctcagaaacataagcaacaacaacaagttggttgcagagaatgtggtagagtgttcgtttctttgaaagctcttagaggtcacatggcttgtcacggtgaggtaaagaagatgttgatggatgataatagccaatctgatactgaaagtgagacttcctcagctcctatgaggaaaagatccaagagggtggtcatgaaacaatcaaattctgaatctttgagtaatgggagctcgtcttttggttctgagattgaccaagaacgtagggatggggcttataatttgatgatgttgtcgagtgattctagtagtttcaagaaaagacgtaacatggtgatgaattctcttggtgagtcatctgacaacaactctgcgattgttgagaataagtcatcttcaggggatgagtttaagatcatgaatgtgaagaatgcagtagatgaccaatggagatctgctgatgatgatggagttagtctctgtgattcagatggctctgattctgattacttcatgaatggtccaagtaagtcggagtcagacatttctgttgacaggaacactggatttggatctggattcaacaactcattgatcaggttcaggaatagtaatgagggaggaacaaagtatgagctgagcaaaagcaagagagccttgttttcttatgaaactgattcatgtgcagacacaaacagcaagattcatcataggttcaaagatagcaaatcctcaatggttaagaaagaaggtggtgagaaggtgaagagcaaaggtcatgagtgcccaatttgcttcaggatgttcaaatcaggccaagctttaggtggtcacaagagatcacattccattgcaaaccacgcagctgaaatgcgtaaccaaatcgatctctatcttcctgtttcggatactgatgaatgaatcagaacctgagaactatagttctctctgatagtatttcatccccactttttgtttgttttctttgctccacattttagaactagatgaaa

SEQ ID NO: 550 - protein, 361 aa, Arabidopsis thaliana
MEEGKENSFLCKYCYKTFPSGKALGGHIRIHTNENSVGYNGNKKKRLVDQRKMMAQKHKQQQQVGCRECGRVFVSLKALRGHMACHGEVKKMLMDDNSQSDTESETSSAPMRKRSKRVVMKQSNSESLSNGSSSFGSEIDQERRDGAYNLMMLSSDSSSFKKRRNMVMNSLGESSDNNSAIVENKSSSGDEFKIMNVKNAVDDQWRSADDDGVSLCDSDGSDSDYFMNGPSKSESDISVDRNTGFGSGFNNSLIRFRNSNEGGTKYELSKSKRALFSYETDSCADTNSKIHHRFKDSKSSMVKKEGGEKVKSKGHECPICFRMFKSGQALGGHKRSHSIANHAAEMRNQIDLYLPVSDTDE

SEQ ID NO: 551 - DNA, 1986 bp, Arabidopsis thaliana
ccattggtgctctccaagttccatctcaagcttttcttcttgtgggtgattcaatctctctctttctattttttttttcatttctgttgatttagtgatctttgatttgtgaaactttgtttttatcgtgtttgtttttgatttagggttttattttgttgtcggcgagttttgatttgatgattttgatgatttttttttgtttgaccgtttggtttttggatcttaagagttatgtgtgaagatttttttttgtttgtttgggtgaagaatttgtgttgatttcgataattttgagtttgattttgaatcttagtaatgaaatttgattctgtgaagtgtgtatgatgaactttgagctggtcctaattctgattctgataaagatttgatttttatggtttcttttgtaggttttgttgttctcttaattgaaaaacaagatcttgaactaaaaaatggaaactgaagacgatttgtgcaacaccaattggggaagctcttcttcgaaatcgcgagagccgggttcatcagactgtgggaattcgacattcgcaggttttacgtcccagcagaagtgggaagatgcttcaatcttggattatgagatgggtgtggagcctggattgcaagagagcattcaagcaaatgttgatttcttacaaggtgttagggctcaagcgtgggatccaaggacgatgttgagtaacctttcttttatggagcagaagattcaccagctgcaggatcttgttcatcttcttgttggtcgtggtgggcagcttcaaggtcgtcaagacgagctcgcggctcagcagcagcagcttataacgacggatcttacttccattatcatacagcttatttcaactgcaggtagtcttcttccatctgttaagcataatatgtcaacagctccgggtccattcactgggcagcccggttcagccgtgttcccttatgtaagggaggctaataacgttgcttcacagagtcagaacaataacaactgtggtgctcgagagttcgatttgcctaagccggttcttgttgatgagagggaaggtcatgttgtggaggaacatgagatgaaagatgaagatgatgtggaagaaggagagaaccttcctcccggttcgtatgagatattgcagcttgagaaagaagagattctcgcaccgcatactcacttctgcacgatatgtggcaagggtttcaagagagacgcgaatttgaggatgcatatgagagggcatggagatgagtacaaaacagcagctgctctggcgaaaccgaacaaagaatccgtacccgggtctgagccgatgctgatcaagaggtactcgtgcccattccttggttgcaaacgtaacaaggagcacaaaaagttccagcctttgaaaacgattctatgcgtgaagaatcactataaacgcacccactgcgataaaagcttcacttgcagccggtgccataccaagaaattctctgtcattgcagatcttaaaacccacgagaagcactgcgggaaaaacaagtggctttgttcctgtggtacaacattttcaaggaaagacaagttgtttggtcacatagctctgttccagggacacacgcctgcaatccctcttgaagagacaaaaccatcagccagtacatctactcagagagggagctctgaaggcgggaacaacaaccaaggaatggttggcttcaatcttggttctgcatcaaatgctaaccaagaaaccacacagcctggaatgactgatgggaggatatgttttgaggagtcgttctcaccaatgaactttgatacatgtaattttggagggttccacgagtttccgcgactgatgtttgatgattcagagagttcttttcaaatgcttattgcgaatgcctgtggtttctcgcccaggaatgttggtgagtctgtttcagatactagtctctaaggcattgccatatatatgataagttatg

SEQ ID NO: 552 - protein, 499 aa, Arabidopsis thaliana
METEDDLCNTNWGSSSSKSREPGSSDCGNSTFAGFTSQQKWEDASILDYEMGVEPGLQESIQANVDFLQGVRAQAWDPRTMLSNLSFMEQKIHQLQDLVHLLVGRGGQLQGRQDELAAQQQQLITTDLTSIIIQLISTAGSLLPSVKHNMSTAPGPFTGQPGSAVFPYVREANNVASQSQNNNNCGAREFDLPKPVLVDEREGHVVEEHEMKDEDDVEEGENLPPGSYEILQLEKEEILAPHTHFCTICGKGFKRDANLRMHMRGHGDEYKTAAALAKPNKESVPGSEPMLIKRYSCPFLGCKRNKEHKKFQPLKTILCVKNHYKRTHCDKSFTCSRCHTKKFSVIADLKTHEKHCGKNKWLCSCGTTFSRKDKLFGHIALFQGHTPAIPLEETKPSASTSTQRGSSEGGNNNQGMVGFNLGSASNANQETTQPGMTDGRICFEESFSPMNFDTCNFGGFHEFPRLMFDDSESSFQMLIANACGFSPRNVGESVSDTSL

SEQ ID NO: 553 - DNA, 1000 bp, Arabidopsis thaliana
catggttcagagaaaactttatataagggctaattcaatgtcgttttgaaacatcaatccctagactaaagtgcgaaaatagtatgagtaatccgaacccagagaaaacgaaagtggatgttactgaggaagagaaagaggaatctgatgagcaatggagcgatgaagaaaccaatatgagagaaattgttctcggcctccctgctttgaatatcagcagtagaatatttggagagagtagtagtgtcgttgaggaagatgcagaaaaagcgcgtttgaatgagcaagcggttcttgcggcggggttgattttggctgcggcagaggaagcggttatgaaaggaatgaatgagggaagtgggagtggtgggaagaaaaagagtagaccaaggatatctacgcaaaccgatgacgaaggggatggtttgggtgaaggagaagcgaaaaagccgaagaagaaagcaaaggaattgactcatccaccgaaaggaccaccggtttgtcatatctgtggaagaggtttcggttcgtggaaggcagtgtttgggcatatgagggctcatagagatagaaactatcaagggtttcttcctcctcctacattctctgcgggggctgaaaggtttgtgattcccgggctaagatctgcttttactattgccactgtcggaggaggaagttctggtggtgtagcggtaggaggaagaagttccggtgatttttctggcagtggtggtggtgatgcgccaggatctgaaggtgggagaggttcaggtattgatttgaatgtggaacctgtggagcaagtagaggaagcgactgaatctggatgtattgccaagttcgatcttaataaatctccaccaaaagatgaagaggaagaggacaaacccaagtgaaagattttttcatactatttaataatttactataacacatagtatagttattattttcatatttcatatttgatatatttatctaacacattatgttgatt

SEQ ID NO: 554 - protein, 271 aa, Arabidopsis thaliana
MSNPNPEKTKVDVTEEEKEESDEQWSDEETNMREIVLGLPALNISSRIFGESSSVVEEDAEKARLNEQAVLAAGLILAAAEEAVMKGMNEGSGSGGKKKSRPRISTQTDDEGDGLGEGEAKKPKKKAKELTHPPKGPPVCHICGRGFGSWKAVFGHMRAHRDRNYQGFLPPPTFSAGAERFVIPGLRSAFTIATVGGGSSGGVAVGGRSSGDFSGSGGGDAPGSEGGRGSGIDLNVEPVEQVEEATESGCIAKFDLNKSPPKDEEEEDKPK

SEQ ID NO: 555 - DNA, 998 bp, Arabidopsis thaliana
cgggaattaaatgcaagaaacatagaggagaccgtacttcgaagttgcaaatttaacactaagttgaagaatctagaaatagaaagccaaaatcttcctttacttcaactctacaatttcaatcttttctctgtacttagccatccagagtcataaccaccactatattaaaatgaagacttatgatttcatgaacgtcaactctttctctcctaaggaaagacccattcgcctctttggcttcgagtttggagcttctcatgaagaatctgagtccaaagacaattacaacgagaacaatgaaagcatcaaagacgataacaaagaaaaaagattcaagtgccactattgtttccggaacttccctacttcacaagccctaggcggccatcaaaacgctcacaagagagaacgtcaacaaactaaacgcttcaacctccattcaaacgcagccgctttcttccaccgccaacaaaaccacattgctgcttctaggctctacgaggatcgctatagccttgaagctgttcaaatcaacgacgcgagattagggttatgtcgtatgtataactcatctgcgagttttaatcgtgaccgttcatcttattataatagatatattccttggttcatcggtgatcaccagactagaccaacgtatgtcggtggtggtagcagcagccatggtctgttttacgagtccaagaagaatgtaccggaccacgtgagtttggatctacgcctctagttccattcttttagtatctctctctagctagttcttaaaaaaaaaaaaagagagactagttttttttccttctttcaaatactttttattttattttagtctacttgattaattatgaatttatgatagtgtatccccgtagatatcatgttatattaacagttaaacaattttatggagatgaactttaacttcagatagtttctttctgagatttaaagtcttaaatattatcgacgcattccaatct

SEQ ID NO: 556 - protein, 191 aa, Arabidopsis thaliana
MKTYDFMNVNSFSPKERPIRLFGFEFGASHEESESKDNYNENNESIKDDNKEKRFKCHYCFRNFPTSQALGGHQNAHKRERQQTKRFNLHSNAAAFFHRQQNHIAASRLYEDRYSLEAVQINDARLGLCRMYNSSASFNRDRSSYYNRYIPWFIGDHQTRPTYVGGGSSSHGLFYESKKNVPDHVSLDLRL

SEQ ID NO: 557 - DNA, 495 bp, Arabidopsis thaliana
atggttgcgagaagtgaggaagttgagatagtggaagatacggcggcgaaatgtttgatgttgttatcaagagttggagaatgcggcggaggaggagagaaacgagttttccgatgcaagacttgtcttaaagagttttcgtcgtttcaagctttgggaggtcatcgtgcaagccacaagaaactcattaacagtagcgatccatcacttcttggatccttgtctaacaagaaaactaaaacggcgacgtctcatccttgtccgatatgtggcgtggagtttccgatggggcaagctcttggtggtcacatgaggagacataggagtgagaaagcctcaccaggcacgttggttacacgttcttttttaccggagacgacgacggtgacgactttgaaaaaatcgagtagtgggaagagagtggcttgtttggacttagattcgatggagagtttagtcaattggaagttggagttgggaagaacgatttcttga

SEQ ID NO: 558 - protein, 164 aa, Arabidopsis thaliana
MVARSEEVEIVEDTAAKCLMLLSRVGECGGGGEKRVFRCKTCLKEFSSFQALGGHRASHKKLINSSDPSLLGSLSNKKTKTATSHPCPICGVEFPMGQALGGHMRRHRSEKASPGTLVTRSFLPETTTVTTLKKSSSGKRVACLDLDSMESLVNWKLELGRTIS

SEQ ID NO: 559 - DNA, 1274 bp, Arabidopsis thaliana
tcgacccttcgtatagcaacgatctagtagaaagcttatactaaaactttctgattctcttaatatggcggaggagtttaaagctacggcatcgatttgtggtggcggaggtggcgcgtggtggaactcgccaaggagcgttatgtctccttcggatcatttcttgtcaccatgcttcggagcggctatcacttccaatgattttagctcgcaagagaatcatctcaaatctaggatgacttgtacggacaacaacaacatcgttttcgggcagcgagaggcggattctgacagtggaggaagtaccgtgacgatggactcgacgttgcagatgatgggtctagggttttcctcaaattgttcttcagattggaaccaaaccattttacaagaagacttaaactcaagcttcataaggagctcacaagatcaagatcatggccaaggattcttatccacaactacttcaccttatatacttaatccagcttgttcttcatctccatcaacttcttcgtcctcaagcttgatacgaaccttttacgatcccgaaccaagtccatacaactttgtctccaccacaagtggttcaatcaacgatcctcaactttcttgggctaataagacaaatcctcatcatcaagtagcttatggactaattaacagcttctctaacaacgcaaactctcgacccttttggaattcttcatcaaccactaacttaaacaacacgacgccgagcaattttgtaaccactccgcagataatatctactcgtttggaggacaaaaccaagaatctgaagacaagagctcagagtgagtctttgaagagagcaaaggataatgaatctgcggcgaagaaaccgagagtcaccacgccttcaccgttgccaactttcaaggtgagaaaagagaatctaagggaccagataacttcattacaacaactagtttcacctttcggaaagacagatactgcatctgttctccaagaagctatagagtacatcaagttccttcacgaccaagtcactgttctaagcactccatacatgaaacaaggtgcctcgaaccaacaacaacagcagatatctggtaaatcgaagagtcaagatgaaaatgagaatcacgaactaagaggacatggtctatgtctcgtcccaatatcaagcacgtttccggtggctaacgaaacaacagccgatttttggacaccaacgtttgggggcaacaatttcaggtgattaaagagagagggttgtggttgtcaag

SEQ ID NO: 560 - protein, 393 aa, Arabidopsis thaliana
MAEEFKATASICGGGGGAWWNSPRSVMSPSDHFLSPCFGAAITSNDFSSQENHLKSRMTCTDNNNIVFGQREADSDSGGSTVTMDSTLQMMGLGFSSNCSSDWNQTILQEDLNSSFIRSSQDQDHGQGFLSTTTSPYILNPACSSSPSTSSSSSLIRTFYDPEPSPYNFVSTTSGSINDPQLSWANKTNPHHQVAYGLINSFSNNANSRPFWNSSSTTNLNNTTPSNFVTTPQIISTRLEDKTKNLKTRAQSESLKRAKDNESAAKKPRVTTPSPLPTFKVRKENLRDQITSLQQLVSPFGKTDTASVLQEAIEYIKFLHDQVTVLSTPYMKQGASNQQQQQISGKSKSQDENENHELRGHGLCLVPISSTFPVANETTADFWTPTFGGNNFR

SEQ ID NO: 561 - DNA, 1541 bp, Arabidopsis thaliana
agcagtggtaacaacgcagagtacgcggggatcgattgctcaatttgtttgtctctctcttcttctttccttttctccaaaaactagagcctaaactaaagcatcgagaaacaacaaatcttaaaatcttttcatattctcggttagtagaaactaggaaaagagatgaatagaggagtgttggagagttcgccggttcaacatctcacggcggctggaaaccctaattggtggaataatgtcagccgcggcttgaggccaccaacgccgttgatgagtcacgagccgccgtctaccaccgcttttattccaagtctcttgccaaacttcttctcttctccgacttcctcttcatcttcttcaccttctttccctcctcctaatagtaaccctaacttctcttcttggcttgaaatgagtgatctgcctcttgatcagccatggagccttagtcaactcctcttgggtggattgatgatgggagaggaagagaaaatggagatgatgaaccatcatcatcatcaaaatcaacaccaaagttaccaagcgaagaggatacaaaattgggaagaacaagttttgaggcaccaagcttccatgaaacaagagagtagtaataataatagttatggaataatgtcctcaccaaactcacctccaaacaaatcttgtgctacaattatcaacaccaatgaagacaacaacaataacattcacagtggtcttaacttgtccgagtgtaatagctcagagatgattgggtcttcttttgctaataagaaaccaaaacttcaagttccttcatcacaatcaactctcaaggtgagaaaggagaaacttggaggcagaatagcatctcttcaccagctagtatctccctttggcaagactgacacagcctctgtcttgtcggaggctattggatacattagattcctccacagtcaaattgaggctttaagtctaccatactttggtactccctcgaggaacaatatgatgcaccaacatgcacaaagaaatatgaatggtatatttcctgaggaccctggtcagcttgtgaatgagtattgcatgaaaagaggagtttcattgtcatcgacggacaatcaaaaatcaaatcctaacgaagaaccgatgaaagatttgagaagtagagggctttgtcttgttcccatctcatgcacactacaagttggcagcgacaatggtgccgactattgggctccggcgttcggaaccactctccagtgaactattcactttctgttattttatttttggtcagccaaaaaaaaatagtagatgttataacatcatgagcaaccaatcaattgagaaaacatcaaaatgagtttccaaatttgattgctcatgatgctatactaaaaccgattggttttggcgtttggcctttgagcattttcagttgacgagtatgagatggcttgttgaatcatgtttttcttactttaataggaaactttatttattctcttaatgtatatgttggttctattttaattttattattgttataa

SEQ ID NO: 562 - protein, 362 aa, Arabidopsis thaliana
MNRGVLESSPVQHLTAAGNPNWWNNVSRGLRPPTPLMSHEPPSTTAFIPSLLPNFFSSPTSSSSSSPSFPPPNSNPNFSSWLEMSDLPLDQPWSLSQLLLGGLMMGEEEKMEMMNHHHHQNQHQSYQAKRIQNWEEQVLRHQASMKQESSNNNSYGIMSSPNSPPNKSCATIINTNEDNNNNIHSGLNLSECNSSEMIGSSFANKKPKLQVPSSQSTLKVRKEKLGGRIASLHQLVSPFGKTDTASVLSEAIGYIRFLHSQIEALSLPYFGTPSRNNMMHQHAQRNMNGIFPEDPGQLVNEYCMKRGVSLSSTDNQKSNPNEEPMKDLRSRGLCLVPISCTLQVGSDNGADYWAPAFGTTLQ

SEQ ID NO: 563 - DNA, 1872 bp, Arabidopsis thaliana
tcttaatctcttgggatttgtaagagaaactcttcaaaaatcatcattctttttcatctttctttacacacaaacacacatacacacacatatataatacagagatcaggtataataaatacttatatatatagcatcatcaactctcatacatatatggactctgctaatctccatcagcttcaagatcaattacagcttgtggggtcttcttcatcttcttcttccttagacaataactctgacccttcttgctatggagcttcatctgcccatcaatggagcccaggaggtatttctttgaatagtgtgagcttgagtcataattataacaatgagatgttaaacacaagagctcacaacaacaacaacaacaacaacacaagtgaatgtatgagtctctccagcatccacaatcactccttgatccaacaacaagactttcctttacaatggcctcatgaccaatcttcatatcaacatcatgaaggacttctcaagatcaaagaagagctttcctcatcaactatctcagaccatcaagaaggcatatccaagttcacagacatgttaaatagtccagtgataacaaactatttgaagatcaatgaacataaggactacactgagaagcttcttctcaagagtatgtcttctggattcccgatcaatggagactatggtagcagccttccctcttcttcttcttcctcttcaccttcgtctcagtcgcatagaggcaacttcagtcagatttacccaagcgtaaacatatcgagtttgagcgaatctcggaagatgagcatggacgacatgagtaacatctcaagaccatttgatataaacatgcaggtttttgatggaagattgtttgaaggaaatgtattagttcctccttttaacgctcaagagattagtagtcttgggatgagcagaggaagccttccttcttttggcctcccttttcatcatcatctgcagcaaacacttccccacctttcttcttcccctactcatcaaatggaaatgttcagcaatgaacctcaaacaagtgaagggaagaggcataacttcttgatggcaacaaaagcaggagaaaatgcttccaagaaaccgcgcgtggaatcacgctcctcttgcccacccttcaaggtgaggaaagaaaagttaggagacagaatagcagctctgcagcagttggtttcaccctttgggaagacagatacagcatctgtgttaatggaagcaattggatacatcaaattcctacagagccagatcgagactttaagcgtcccctacatgagagcatctaggaaccgacccggaaaagcctcccagctggtctcacaatcacaagaaggggatgaggaagagacgagagatcttagaagccgtgggctatgtctagtgccgttatcatgcatgacttatgttaccggagatggtggggatggaggaggcggtgttggtactggtttttggccaacgccacctggttttggtggcggaacttagccgtggacttaacaaaccgtaggactatgatgagtacatttatcggacttggaggtagagaataagaagaaatgttaaaggtggagtattagttctttaatctcttttggttttggtttattaattgaaattttcggttttgatagtggagcaaagttggtcgtcctgattagaaagaagtgttacaggatagaccagctttgatccatttaagattagtagtgagacttgacgatatgtttctacttacatgatgggctgtgggggctacataaaatatcaaatagctttggattattttgttaaatctcttttgtagataatgtgtcaatatctttaataaatgtattcctt

SEQ ID NO: 564 - protein, 453 aa, Arabidopsis thaliana
MDSANLHQLQDQLQLVGSSSSSSSLDNNSDPSCYGASSAHQWSPGGISLNSVSLSHNYNNEMLNTRAHNNNNNNNTSECMSLSSIHNHSLIQQQDFPLQWPHDQSSYQHHEGLLKIKEELSSSTISDHQEGISKFTDMLNSPVITNYLKINEHKDYTEKLLLKSMSSGFPINGDYGSSLPSSSSSSSPSSQSHRGNFSQIYPSVNISSLSESRKMSMDDMSNISRPFDINMQVFDGRLFEGNVLVPPFNAQEISSLGMSRGSLPSFGLPFHHHLQQTLPHLSSSPTHQMEMFSNEPQTSEGKRHNFLMATKAGENASKKPRVESRSSCPPFKVRKEKLGDRIAALQQLVSPFGKTDTASVLMEAIGYIKFLQSQIETLSVPYMRASRNRPGKASQLVSQSQEGDEEETRDLRSRGLCLVPLSCMTYVTGDGGDGGGGVGTGFWPTPPGFGGGT

SEQ ID NO: 565 - DNA, 1346 bp, Arabidopsis thaliana
aaaggtgatgaatagaggtgtgttggagagttcgccggttcagcagctgatggcagccggaaaccctaattggtggaacgtaagcggcggcatgaggccaccaccaccgttgatgggtcatcagcaggcgccgttgccaccacatatgactcctaataacaattatctccgaccacggatgatgcccactcccttcccgcacttcttgccatctccggcgacttcttcttcttcctcttcttcttcaccgtctttgcctaataaccctaatctctcttcttggcttgaaagcaatgatctccctcctgagtcttggagccttagccaacttcttttgggtggattgatgatgggagaggaagagagattggagatgatgaaccatcataatcatcatgatgaacaacaacaccatggttttcaagggaagataagattggagaattgggaagaacaagtgttaagccaccaacaagcttccatggtggctgttgacatcaaacaagagggtaacattaacaacaacaatggctatgtcatatcttccccgaactcacctcctaacaaatcttgtgttacaacaactaccacaacaagcctcaatagtaacgacgataacatcaacaacaataataatatgttggatttctctagcaatcacaatggtcttcacttgtcagaagggagacacactcctccggatcgatcctctgagtgtaacagcttagagattggtgggtctactaataagaagccaaggctccaaccttctccttcgtcacaatcaaccctcaaggtgagaaaggagaaactaggaggccgaatcgcagcgcttcatcagctagtatctccatttggaaagactgacacagcctctgtcctgtcggaagctattggatacattagattccttcagagtcaaattgaggctctgagtcatccatactttggtacgactgcctcggggaatatgaggcaccaacaacatttgcaaggagataggagttgcatatttcctgaggaccctggtcagctcgtgaacgatcagtgcatgaagagaagaggagcttcgtcgtcatctacggacaatcaaaatgcaagtgaagagcctaagaaagatctgagaagtcgaggtttatgtcttgtcccaatctcatgcacactccaagtaggcagcgacaacggcgcggactattgggctccagcacttggctccgccggtttccattgagccaatgaaattacgccacgtggaattccagcgttagagaaaaatgatataacatcacgagcagtcagtctactgagaaaacaacaaattgagtttccaaggctgattgctcatg

SEQ ID NO: 566 - protein, 407 aa, Arabidopsis thaliana
MNRGVLESSPVQQLMAAGNPNWWNVSGGMRPPPPLMGHQQAPLPPHMTPNNNYLRPRMMPTPFPHFLPSPATSSSSSSSSPSLPNNPNLSSWLESNDLPPESWSLSQLLLGGLMMGEEERLEMMNHHNHHDEQQHHGFQGKIRLENWEEQVLSHQQASMVAVDIKQEGNINNNNGYVISSPNSPPNKSCVTTTTTTSLNSNDDNINNNNNMLDFSSNHNGLHLSEGRHTPPDRSSECNSLEIGGSTNKKPRLQPSPSSQSTLKVRKEKLGGRIAALHQLVSPFGKTDTASVLSEAIGYIRFLQSQIEALSHPYFGTTASGNMRHQQHLQGDRSCIFPEDPGQLVNDQCMKRRGASSSSTDNQNASEEPKKDLRSRGLCLVPISCTLQVGSDNGADYWAPALGSAGFH

SEQ ID NO: 567 - DNA, 1569 bp, Arabidopsis thaliana
tctctcttttgcccttacgtcctcgagctcaaccctttaattgcatctacgacagtcgtaccttttgctaggttatcgtcgtcatgatgcagcagccacctccagcttccaacggtgctgcaacagggccagggcagattccttccgaccaacaagcttacctccagcagcagcagtcgtggatgatgcagcaccagcagcaacaacaaggtcagccgcctgcaggatggaatcagcagtctgcaccgtcttctggtcaaccacagcagcagcagtatggtggtggtggatctcagaatccaggatcagctggtgagatccggtccctgtggatcggtgacttgcagccatggatggatgagaactatctcatgaacgtctttggtcttactggcgaggctacagcagctaaagttattcgcaataaacagaacggatattcagaaggttatggctttattgagtttgtgaaccatgctacagctgagaggaatttacagacttacaatggtgctccgatgccgagcagtgagcaggccttcaggttgaactgggctcagcttggagctggagagagacgccaggctgaagggcctgagcacacagtttttgttggagacttggcacctgatgttaccgaccacatgcttactgaaacgtttaaagctgtgtattcctctgtcaagggagctaaagttgtgaatgataggactactggacggtccaagggttatggatttgtcaggtttgcggatgaaagtgagcagattcgtgccatgactgaaatgaatggtcaatactgctcatcaaggcctatgcgtactggtcctgctgccaacaagaagcctcttacaatgcaaccagcttcatatcagaacactcaaggaaattcaggagaaagtgatccaactaacacaacaatttttgttggagctgtggatcaaagtgtaacagaagatgatttgaagtcagtttttggtcaatttggtgaactagttcatgtgaaaatacccgcaggaaaacgttgcggatttgttcaatacgccaatagggcatgtgctgagcaagcactttctgtgttgaacggaacacaacttgggggacaaagcattcgtctttcatggggtcgcagtccttccaacaaacagactcaacctgatcaagcccagtatggtggtggtggaggatactatgggtatcctcctcaaggatatgaagcatacggatatgcacctcctcctcaggaccctaacgcctactacggtggttatgctgggggcggctatggaaactaccagcagcctggtggataccagcagcaacagcagtgaagcatgatgtgtaagtcgtgatcgagctgaagttgtagaaagctgtaaccgtttgacaatggtgaatgaattattgaagtggatgtgtattagctcttcttgtctcagattctctcttcaactcttttttttttcttttggattatttttctttcgcgtggctattgttgagtgtccttgcaagtcataacaaaaagcttaaacccaagtgttttttgtcatgactaatatgaccatt

SEQ ID NO: 568 - protein, 415 aa, Arabidopsis thaliana
MMQQPPPASNGAATGPGQIPSDQQAYLQQQQSWMMQHQQQQQGQPPAGWNQQSAPSSGQPQQQQYGGGGSQNPGSAGEIRSLWIGDLQPWMDENYLMNVFGLTGEATAAKVIRNKQNGYSEGYGFIEFVNHATAERNLQTYNGAPMPSSEQAFRLNWAQLGAGERRQAEGPEHTVFVGDLAPDVTDHMLTETFKAVYSSVKGAKVVNDRTTGRSKGYGFVRFADESEQIRAMTEMNGQYCSSRPMRTGPAANKKPLTMQPASYQNTQGNSGESDPTNTTIFVGAVDQSVTEDDLKSVFGQFGELVHVKIPAGKRCGFVQYANRACAEQALSVLNGTQLGGQSIRLSWGRSPSNKQTQPDQAQYGGGGGYYGYPPQGYEAYGYAPPPQDPNAYYGGYAGGGYGNYQQPGGYQQQQQ

SEQ ID NO: 569 - DNA, 943 bp, Arabidopsis thaliana
actttctattttcaccaattttcaaaaaaaaaataaaaattgaaactcagaaatggcgaatctctcttctgattttcagacatttacaatggatgatcccataagacaactagcagaactgagcaacacgcttcatcatttccaaacatttcctcctcctttctcttcttctctcgattctcttttctttcataatcaattccctgatcattttcccggaaaatctctcgagaataattttcatcaagggatattcttcccttctaatatccaaaacaacgaagagtcttcttcacaattcgataccaagaagagaaaatcattaatggaagctgtttctacgtcggagaacagtgtctctgatcaaactctctctacctcttctgctcaagtttccataaatggaaatatttcgacaaaaaataattcttcaaggagagggaagaggtcgaagaatagagaagaagagaaagagagagaagttgttcatgttagagctagaagaggccaagccactgatagccacagcatagcagaacgggttcgacgagggaaaataaacgagagattgaaatgcttgcaagatatagtccccggatgttataagacaatgggaatggctactatgcttgatgagataattaattacgtccagtccttacaaaatcaagtcgagtttttatctatgaagcttacagcagcaagttcgtattatgactttaactcggagactgatgctgtggaatccatgcagaaggcaaaggcacgtgaggcagtggagatgggtcaagggagggatgggagttctgtcttccattcatcatcgtggaccctttgacttttgttttttgctctcctttttttgtctttctaattttcttcctttttttggatttaaaaagatacttttaaagattaatttcaagaaatctcgatgtaaaaa

SEQ ID NO: 570 - protein, 261 aa, Arabidopsis thaliana
MANLSSDFQTFTMDDPIRQLAELSNTLHHFQTFPPPFSSSLDSLFFHNQFPDHFPGKSLENNFHQGIFFPSNIQNNEESSSQFDTKKRKSLMEAVSTSENSVSDQTLSTSSAQVSINGNISTKNNSSRRGKRSKNREEEKEREVVHVRARRGQATDSHSIAERVRRGKINERLKCLQDIVPGCYKTMGMATMLDEIINYVQSLQNQVEFLSMKLTAASSYYDFNSETDAVESMQKAKAREAVEMGQGRDGSSVFHSSSWTL

SEQ ID NO: 571 - DNA, 1025 bp, Arabidopsis thaliana
agttctgtcacgtgtaaaagagcttgtgaaacattacagcaaaccaaactatttgactaaagatgaaaacaacacctctcccgaggctgcattatttagtaagtcttctttgtttttttctttcttccaagattaaagaagacagacccaattatgtaagggcagtctctcctataaacctaactagttcattggaaaaaacaagagagaaaaaaaaacgattactgctgagatctaccatttctaaacctcaacccatgaatccttctaacaatcctaaaaagacaaggcaccagagtcatatgcctcaagaaagagatgaaacgaagaaggagaagaagcttctccaccgcaacatcgaacgacaaagaagacaagaaatggcgatccttttcgcctctcttcgtagtcagctacctctaaaatacatcaaggctctttcttcgcagggaaagagagccatgtcagatcatgtaaacggagcagtaagtttcatcaaagacacgcaaacaaggataaaagatctctccgcaagaagagacgagctaaagcgagagattggtgaccctactagtctaactggatccggatccggatctggatcaagtagatcggaaccagctagtgtcatggtgcaaccgtgtgtgagcggcttcgaggtggttgtgagcagcttagcatcaggtctcgaggcttggccactctcaagagttcttgaagttcttcacgggcaaggacttgaagtcatcagctctttaacagcacgagtcaacgagaggctcatgtacactatacaagtcgaggtaaatagctttgattgcttcgacttagcttggttgcagcagaagctaattgagcagttagtactttccacgactaggcactgaaaaaactaacatttgtcataagaatatgttcattgaatgatgcttttgtcccaatctctttgttttagtgtccgtaagggtgtgttcttttggtccttcactacttggagtgatttttttttttttttttaaaaaaaa

SEQ ID NO: 572 - protein, 274 aa, Arabidopsis thaliana
MKTTPLPRLHYLVSLLCFFLSSKIKEDRPNYVRAVSPINLTSSLEKTREKKKRLLLRSTISKPQPMNPSNNPKKTRHQSHMPQERDETKKEKKLLHRNIERQRRQEMAILFASLRSQLPLKYIKALSSQGKRAMSDHVNGAVSFIKDTQTRIKDLSARRDELKREIGDPTSLTGSGSGSGSSRSEPASVMVQPCVSGFEVVVSSLASGLEAWPLSRVLEVLHGQGLEVISSLTARVNERLMYTIQVEVNSFDCFDLAWLQQKLIEQLVLSTTRH

SEQ ID NO: 573 - DNA, 519 bp, Arabidopsis thaliana
atgggaagagggagaagctcatcgtcttcatcgatagagagcagctgcaaaagcaacccatttggtgtgtcttcgagtaatactcggaacctaagcacggacctgagactcgggctcagcttcggatcatcttccggacaatattacaacggtggagataaccatgaatatgatggagtcggtgcggcagaggaaatgatgatcatggaagaagaagagcaaaacgagtgtaatagtgtcggaagcttctacgtgaaagtgaacatggaaggagttcctattgggagaaagatcgatcttttatctcttaatggatatcatgatttgatcacaactctcgactacatgttcaatgcttcaatcctttgggctgaagaagaagatatgtgtagtgagaagagtcacgtgctaacgtacgcagacaaagaaggtgactggatgatggttggagatgttccttgggagatgttcttgtctagcgtgagaagactaaagatctcaagagcttatcactactga

SEQ ID NO: 574 - protein, 172 aa, Arabidopsis thaliana
MGRGRSSSSSSIESSCKSNPFGVSSSNTRNLSTDLRLGLSFGSSSGQYYNGGDNHEYDGVGAAEEMMIMEEEEQNECNSVGSFYVKVNMEGVPIGRKIDLLSLNGYHDLITTLDYMFNASILWAEEEDMCSEKSHVLTYADKEGDWMMVGDVPWEMFLSSVRRLKISRAYHY

SEQ ID NO: 575 - DNA, 2304 bp, Arabidopsis thaliana
atggaaagtggcaacgttgtgaatacacaacctgaattatcaggcataattgatggatccaagagttatatgtacgagcagttatggaaactctgtgcgggacctttgtgtgatattccaaaacttggagaaaaggtttattactttcctcaaggccatatagagcttgtgagttctctctctctatattctttctctcttctttctctctctctctctctctctctctctctctctctctctctctctctctctctctctcctttctctctcttctctctcttctctctctcgcctctttctctctctctctctctctctctccttctctctcatgttgaggcatctacaagagaagagttgaatgagttacaaccaatttgtgattttccttctaagcttcaatgtcgtgttattgctattcaacttaaggtggaaaacaatagtgatgagacttatgctgagatcactttgatgccagatacaactcaagttgtaatccctactcagaatcaaaatcaatttaggccattagttaattcctttacgaaggttttaacggcctcagatacaagcgttcatggtggattctctgttccgaaaaaacatgccattgaatgtctccctccgctggatatgtcacagcctctaccgacacaagaaattcttgctatagatcttcatggtaatcaatggagattcagacacatctatagaggtacagcgcaaagacatttgttaacaattggttggaatgcattcacaacatcaaaaaaattggttgaaggagatgttattgtattcgttaggggagagactggagagttacgagttggtatcagacgagcaggacatcaacaagggaatataccttcatcaatagtatcaatagaaagtatgagacatgggataattgcttctgcaaagcatgcttttgataaccaatgtatgttcattgtggtttacaagccaaggtcaagtcaatttattgtcagttacgacaaattcttagacgttgtgaacaataagttcaatgtcggttcaagatttacaatgcggtttgagggtgatgatttctctgaaagaagatcttttgggacaattattggagttagtgatttctctcctcattggaagtgttcagagtggcgcagcttagaagtgcagtgggatgaatttgcatcatttccgagaccaaaccaagtttcaccatgggacatcgaacatttaacgccttggtcaaatgtttccaggtcatcttttctcaagaacaagcgttcacgagaagttaatgaaatcggttcttcctcatcacatctcttgcctcctacattgacacaaggacaagaaattggacaacaaagcatggccaccccgatgaatatttctcttcgttatcgtgatattactgaagatgctatgactccttctagattgctaatgagctaccctgtccaaccaatggccaaactaaattacaataatgtggttacaccaatagaagaaaatataacaaccaatgcagtcgctagttttaggttgtttggagtctctctggccactccttcggtgatcaaagatcccgttgaacaaattggcttggagatttctagacttactcaggaaaaaaagtttggtcaaagccaaattttgagatcaccaacagagatccaaagcaagcagttcagttctaccagaacttgtaccaaagttcaaatgcaaggtgtaacaataggaagagctgtggatttaagtgttcttaatggatatgatcagttaatactagaattggagaagctcttcgatctcaaaggccaattgcaagctcgcaaccaatgggaaatagctttcacaaataatgaagaggataagatgcttgttggagaagatccatggcctgaattctgcaacatgcgtgggtacgtcgcctcaaactccaaggatgatcctgcaaaggttgctgctagcttcacctcccaggtcgtcatcatgaaccaccttggtcagattaaaaatggttacaccccagttcttgattgccacacctctcacattgcagtcaagttctctgagatcttgaccaagattgactggcgtactggtcatgagattgagaaggagccaaagtttttaaagaacagtgaggccgctattattaatatgactcccaccaagcctatggtggttgaggcttactctgcgtacccacccctgggacgttttgctattagggacatgaggcaaaccgttggtgttggagttatcaagagtgttgtcaagaaggacccaagtggagccaaatga

SEQ ID NO: 576 - protein, 767 aa, Arabidopsis thaliana
MESGNVVNTQPELSGIIDGSKSYMYEQLWKLCAGPLCDIPKLGEKVYYFPQGHIELVSSLSLYSFSLLSLSLSLSLSLSLSLSLSLSPFSLFSLFSLSPLSLSLSLSLLLSHVEASTREELNELQPICDFPSKLQCRVIAIQLKVENNSDETYAEITLMPDTTQVVIPTQNQNQFRPLVNSFTKVLTASDTSVHGGFSVPKKHAIECLPPLDMSQPLPTQEILAIDLHGNQWRFRHIYRGTAQRHLLTIGWNAFTTSKKLVEGDVIVFVRGETGELRVGIRRAGHQQGNIPSSIVSIESMRHGIIASAKHAFDNQCMFIVVYKPRSSQFIVSYDKFLDVVNNKFNVGSRFTMRFEGDDFSERRSFGTIIGVSDFSPHWKCSEWRSLEVQWDEFASFPRPNQVSPWDIEHLTPWSNVSRSSFLKNKRSREVNEIGSSSSHLLPPTLTQGQEIGQQSMATPMNISLRYRDITEDAMTPSRLLMSYPVQPMAKLNYNNVVTPIEENITTNAVASFRLFGVSLATPSVIKDPVEQIGLEISRLTQEKKFGQSQILRSPTEIQSKQFSSTRTCTKVQMQGVTIGRAVDLSVLNGYDQLILELEKLFDLKGQLQARNQWEIAFTNNEEDKMLVGEDPWPEFCNMRGYVASNSKDDPAKVAASFTSQVVIMNHLGQIKNGYTPVLDCHTSHIAVKFSEILTKIDWRTGHEIEKEPKFLKNSEAAIINMTPTKPMVVEAYSAYPPLGRFAIRDMRQTVGVGVIKSVVKKDPSGAK

SEQ ID NO: 577 - DNA, 1461 bp, Arabidopsis thaliana
atgcagccattaaatatggctgagatattggatcaccgtggagtcttgaccgacggtgatgatggtccatttagaaatctaacaaacttctatgatatgttttcaagcaactttcctgaaggtttgcgagtgttagtcttcgatgaagatccatcgtatcttctgatattggagagacatctccaaaagtttcaataccaagtgactatatgcaacgaagtgaacaaagctatgcatacactccgcaaccataggaataggttcgacctcgctatgatacaagtaaataatgcagaaggtgatatattccggtttctctcggaaatcggatcggaaatggatcttccaatcatcataatatctgaagacgattcagtgaagtcggtgaagaaatggatgattaacggtgctgccgactatcttataaaaccgataagacccgaagatctacggatagtattcaaacatttggtaaagaagatgagagaaaggaggagtgtggtgaccggagaggcagagaaagcagcaggtgagaaatcatcctctgtcggagattccaccataagaaaccctaacaagagtaaaagaagtagttgccttgaagcagaagtcaacgaggaggatcgtcatgatcataatgatcgtgcttgtgcttctagtgccaagaaaagacgagtcgtttgggacgaggagcttcaccaaaactttctcaacgccgtggattttcttggactcgaaagagctgttcccaaaaaaatattagatgttatgaaggttgattacatcagtcgagaaaacgtagccagtcatcttcagaaattccggctcatgctgaagaaggagaatgatgaaaagattaagaaagaggagatgaacaaatctttaataaccccacaaaatggaagaatgtatgttggagaagatccatcaaatttctacagaggaagaaatgatcatttcccaacacatcatgtcaacaatattcctcaaccttcttatgtgccgcaacacaccttgaaccctaacaatctcaacacacagctcataccatctctcggacatcattttgatcatcgaggctctattgtggttcccgatacaaacctagagatgaatcaacaattttttcaccaccaacagacctcggacttcacgccagaagagaatcttggtgataacaactttactgaggaagatttaatgatggcatcaacatattatttgagcgagccggatgatgcttcttttgaaaagaagaatgggcatgaagttgtgccatcgcccatatttcattcgccgttttcctctaataagtaccaacgtagttcctttcttgatcagcaagaaagtggaggacttagctacaatactgttttttctaatgatgaatccaacattgggatttgcaagaagggatcaagatgggtcaagatcggagccaagcatgaagacggaagatga

SEQ ID NO: 578 - protein, 486 aa, Arabidopsis thaliana
MQPLNMAEILDHRGVLTDGDDGPFRNLTNFYDMFSSNFPEGLRVLVFDEDPSYLLILERHLQKFQYQVTICNEVNKAMHTLRNHRNRFDLAMIQVNNAEGDIFRFLSEIGSEMDLPIIIISEDDSVKSVKKWMINGAADYLIKPIRPEDLRIVFKHLVKKMRERRSVVTGEAEKAAGEKSSSVGDSTIRNPNKSKRSSCLEAEVNEEDRHDHNDRACASSAKKRRVVWDEELHQNFLNAVDFLGLERAVPKKILDVMKVDYISRENVASHLQKFRLMLKKENDEKIKKEEMNKSLITPQNGRMYVGEDPSNFYRGRNDHFPTHHVNNIPQPSYVPQHTLNPNNLNTQLIPSLGHHFDHRGSIVVPDTNLEMNQQFFHHQQTSDFTPEENLGDNNFTEEDLMMASTYYLSEPDDASFEKKNGHEVVPSPIFHSPFSSNKYQRSSFLDQQESGGLSYNTVFSNDESNIGICKKGSRWVKIGAKHEDGR

SEQ ID NO: 579 - DNA, 2152 bp, Arabidopsis thaliana
agagtacgcgggggtactatattcctttgaagagaggagacttgcaaacgtattgcatcaaatatggagtttggaagcactgaagatggaaggcatgacaagtttcctgtaggaatgagggttcttgctgtggatgacaatccaacctgccttcggaaactcgaagagttgctgcttcgttgcaagtatcatgtgacaaagacaatggagtcgaggaaagctctggaaatgctgagagaaaacagcaacatgtttgatctggtgataagcgatgtagagatgccagacacggatggttttaagttgcttgaaattggtcttgaaatggaccttcctgtcatcactcatagcgactatgacagcgttatgaaaggtattatacatggcgcttgcgattatctggtcaagcctgttggactcaaggagcttcagaatatatggcatcatgttgtgaagaagaacattaaatcttacgcaaaactgctcccaccttctgaatctgattccgtcccaagcgccagcaggaaacggaaagacaaagtcaatgacagtggtgatgaagatgacagtgacagagaagaggatgatggtgaggggagtgaacaggatggtgacgggtcaggtacgcggaagaagccacgtgttgtttggtctcaggagcttcaccagaagtttgtcagtgccgttcagcaattgggcctcgacaaggctgttcccaaaaaaatacttgatctcatgagtatagaaggtctcactagggaaaacgtagccagtcatttgcagaagtacagactgtacttgaaaaagatagacgaaggtcagcagcaaaatatgaccccagatgcatttggaacaagagattcatcttactttcagatggctcaacttgatggacttagagattttactgccgcaagacaaattccaagctcaggactcttatcgcgttcccatctcaccaaactccaaccccctatgtattcatcgataaatctccaaggaatgaactcctccagcttcatccaacaggggcatcaccagaactcaagcaattcagctaatccgtttggaacatatcacagtactctgtcaccaagaatccagaacgtgaatctgtttcagcgaacttcatctccactagaacccctccagtttcctagaagcaagtcatacattggagattttaaaggcttaggggacagagctattggcggtagcttcctagatacttgtatgccatttggtagctctagcacctctttaccaagtgcttccaccaatcctctaatgttgcaagcaaactatacacaacccctgcatatagcctcagatggaattcagccttgcatcgagggaactccgtccaactctgcctccccaaacatcagtttccaaggcttatctagatttcctggtcatagctggcaagggaatttgaacacaaccagattcccaccgagttccttaccactaaatcttgctttcttgccggatcaagtgacatgtgcagggaacaatctgggagattgtacttctttggtttctgcagagaatcctggtggagagatgcagtgtgatcctcaattacttggcggcttcatgcagaacgtgaatccgttaggcggacagaaatgggagcaacagaactgcaccatgctgaacaatccattcggtaacattgagtatcctctacccgcagataacatggttttcagagacaacaattcaaccagaagcaaaggcttggatgagtcactgatgaacccaatagacaacagtcaagagtatgttggaaaagctactacaatgctggatccagagatgaagtcgggaaagccagagaatgacaaccagcatgatgtattcgatgacataatgaatgagatgatgaaacaggaggagaataacggaatggtgccagtggctactagatttggctttgattcatttcctccaccttagctagtcatctctttctctaccagttgcattaagtttctccacttgagaccattttcatgtgatttttttaaatttcttcccacattgtttcctccgactgtcaatagatcatagtacaccaacctgtttcatactctcttttatgaattggaattgaaagcgagcctgttacaaaaaaaaaaaaaaaaaa

SEQ ID NO: 580 - protein, 632 aa, Arabidopsis thaliana
MEFGSTEDGRHDKFPVGMRVLAVDDNPTCLRKLEELLLRCKYHVTKTMESRKALEMLRENSNMFDLVISDVEMPDTDGFKLLEIGLEMDLPVITHSDYDSVMKGIIHGACDYLVKPVGLKELQNIWHHVVKKNIKSYAKLLPPSESDSVPSASRKRKDKVNDSGDEDDSDREEDDGEGSEQDGDGSGTRKKPRVVWSQELHQKFVSAVQQLGLDKAVPKKILDLMSIEGLTRENVASHLQKYRLYLKKIDEGQQQNMTPDAFGTRDSSYFQMAQLDGLRDFTAARQIPSSGLLSRSHLTKLQPPMYSSINLQGMNSSSFIQQGHHQNSSNSANPFGTYHSTLSPRIQNVNLFQRTSSPLEPLQFPRSKSYIGDFKGLGDRAIGGSFLDTCMPFGSSSTSLPSASTNPLMLQANYTQPLHIASDGIQPCIEGTPSNSASPNISFQGLSRFPGHSWQGNLNTTRFPPSSLPLNLAFLPDQVTCAGNNLGDCTSLVSAENPGGEMQCDPQLLGGFMQNVNPLGGQKWEQQNCTMLNNPFGNIEYPLPADNMVFRDNNSTRSKGLDESLMNPIDNSQEYVGKATTMLDPEMKSGKPENDNQHDVFDDIMNEMMKQEENNGMVPVATRFGFDSFPPP

SEQ ID NO: 581 - DNA, 1470 bp, Arabidopsis thaliana
atggggaaaactcaactcgctcctggatttcgtttccatccgactgatgttgaactcgtgaggtattacttgaagaggaaaatactggggaaaaagctccttgtcgatgctattgctgaagttgacatttacaagtttgaaccccctgatttacctgatatgtcttttataagaagtggggatcttaagtggcacttcttctgccccagggaaaagaagtatgctagtggggtaagggcaaaccgtgcaactgagtgtggctactggaagaccacggggaaggagagaccagttctgtgcaattctgaggttgtgggaaagatcaaaactctggtttatcactttggcaagtcgcctcgtggggagcggactgattgggttatgcatgaatacaggcttgacgacaaagtactgacgcagatgaatgttcctcaggatacttatgtggtgtgtgttctgttcaagaaagatggtcctggacctagaaatggagctcaatatggagctccgtttaaggaagaggactggagtgatgaggaagtacgtactgatgttccttctactagtaatcccacaaaccttcttgagcctagcaaagaaaccactctggctttgactgccccagatgactccaataaggattgttttggtggcatgatatcagagtcatgtgtctcggatttcctaccagctacaactaataccaccagcgagcttccacatccaagtgatgcagctaccactcctatgtctactgcacctctggcagagaccgttcagacccccaacaatgatgacttatattcaatgttggatctatttgatgatgacgaagagttcttagggttcaacaataatgaggtaagatatgatcccggtgtctcagctccagtttgcttagaagaagaaggcattttcaacggactaccagagttgagcagcatgccaaggacggcctcttacgacctagttgaaaactcggagttatacctagagctacaagacctcactgctccattaaatccccaaactgggctacaagacctcactgctccatttaatcctcaaactgggctacaagacctcactgctccatttaatcatcaaactgggctacaagaccacactgctccatttaatcctcaaactgggctacaagaccacactgctccatttaatcatcaaactgggctacaagacctcactgctccatttaatcctcaaactgggctacaagacctcactgctccatttaatcctcaaactgggctacatgacctcacttctccatttaatcctcaaactgggctacaagacctcactgctccattaaatcctcaaactgggaatcgcaatgacccgagaagctcctcctttctgtataatcaaggccattttgacttctctggtggtaatgatgatgatccttatggcttttctgcttccatgagacatagaccaaaaatgtaa

SEQ ID NO: 582 - protein, 489 aa, Arabidopsis thaliana
MGKTQLAPGFRFHPTDVELVRYYLKRKILGKKLLVDAIAEVDIYKFEPPDLPDMSFIRSGDLKWHFFCPREKKYASGVRANRATECGYWKTTGKERPVLCNSEVVGKIKTLVYHFGKSPRGERTDWVMHEYRLDDKVLTQMNVPQDTYVVCVLFKKDGPGPRNGAQYGAPFKEEDWSDEEVRTDVPSTSNPTNLLEPSKETTLALTAPDDSNKDCFGGMISESCVSDFLPATTNTTSELPHPSDAATTPMSTAPLAETVQTPNNDDLYSMLDLFDDDEEFLGFNNNEVRYDPGVSAPVCLEEEGIFNGLPELSSMPRTASYDLVENSELYLELQDLTAPLNPQTGLQDLTAPFNPQTGLQDLTAPFNHQTGLQDHTAPFNPQTGLQDHTAPFNHQTGLQDLTAPFNPQTGLQDLTAPFNPQTGLHDLTSPFNPQTGLQDLTAPLNPQTGNRNDPRSSSFLYNQGHFDFSGGNDDDPYGFSASMRHRPKM

SEQ ID NO: 583 - DNA, 1089 bp, Arabidopsis thaliana
atggagctgacgcaacccataagagaaaacggagacccgcagggacaccagctaacagatccagatgcagaggtggtatctttgtcaccaagaacgttactagaatcagatcggtacgtgtgtgagatctgcaaccaagggtttcagagagatcagaatctacagatgcatagaagacgacataaagtgccatggaagcttctgaagagagacaagaaggatgaggaagtgaggaagagagtctacgtgtgtcctgagccaacatgtctccaccatgacccgtgccacgctcttggagatctggtcggaatcaaaaagcacttccgccgtaaacacagtgtccacaagcaatgggtttgcgagagatgctccaaaggctatgcagttcaatctgactacaaagcccatctcaagacctgcggttcacgcggtcactcctgcgactgtggccgcgttttctccagggttgagagtttcatagagcatcaagatacttgcaccatccggcaacctcaacccaccaaccaccgtcatctacagcagcacacgatgggccttgacgctccatcaagaaccacttcgacagcaagcttcggccctttattgcatggacttcctttgttaagacctccacgaccgtccaatcaacattcaccagcttttgcttaccctttcaatgcttcatcagctcctttcgaaagcctcgaacttcaactatccataggaatggcaagaacatcagcacaagcgaggcacaacgaaaagagagagacgagtttaacaaaggagagagcgaacgaggaggcaaggaaggcagaggaaacgagacaagaagcgaaaaggcagatagagatggcagaaaaggattttgagaaagctaagagaataagggaagaagcaaaaaccgagttggagaaggctcacgttgttagagaagaagcaatcaagaggattaatgcaacaatgatggagatcacttgccactcttgcaagcaactatttcagctgcctgttacggctgatgagagtacgtcgtctcttgttatgagttacgtttcctcggcgacaactgaaggagaatgcgagtga

SEQ ID NO: 584 - protein, 362 aa, Arabidopsis thaliana
MELTQPIRENGDPQGHQLTDPDAEVVSLSPRTLLESDRYVCEICNQGFQRDQNLQMHRRRHKVPWKLLKRDKKDEEVRKRVYVCPEPTCLHHDPCHALGDLVGIKKHFRRKHSVHKQWVCERCSKGYAVQSDYKAHLKTCGSRGHSCDCGRVFSRVESFIEHQDTCTIRQPQPTNHRHLQQHTMGLDAPSRTTSTASFGPLLHGLPLLRPPRPSNQHSPAFAYPFNASSAPFESLELQLSIGMARTSAQARHNEKRETSLTKERANEEARKAEETRQEAKRQIEMAEKDFEKAKRIREEAKTELEKAHVVREEAIKRINATMMEITCHSCKQLFQLPVTADESTSSLVMSYVSSATTEGECE

SEQ ID NO: 585 - DNA, 456 bp, Arabidopsis thaliana
atgacgaagagagctcccaagtcagggcctttgtctccgtcgtgcagcggaggctctagtcggaacttagagttggctgtgaagtcaagtgaaggtgcaaggaggtctacaagactgagacttcagcctttgagaaagccaaagacaagccccaagaagaaacccgttaaactccaaacgaagatgcccaagaaacctgccactgctttcttctttttcctggatgatttccggaagcaatatcaagaggagaatccagatgtcaagtccatgcgcgagattgggaagacatgtggagagaaatggaaaacaatgacttacgaggaaaaggtaaagtattatgatatagctactgagaagagggaagaatttcaccgagcaatgacagaatataccaagagaatggaatcaggtgcccacgatgaatcagagaccgactcagactattctgaatag

SEQ ID NO: 586 - protein, 151 aa, Arabidopsis thaliana
MTKRAPKSGPLSPSCSGGSSRNLELAVKSSEGARRSTRLRLQPLRKPKTSPKKKPVKLQTKMPKKPATAFFFFLDDFRKQYQEENPDVKSMREIGKTCGEKWKTMTYEEKVKYYDIATEKREEFHRAMTEYTKRMESGAHDESETDSDYSE

SEQ ID NO: 587 - DNA, 3252 bp, Arabidopsis thaliana
atggcggaagcaagacgattcagcccagttcatgaattagatgttggacaaatactctcagaagcacgacatcgatggcttcgtcctcctgaaatctgtgaaattttacagaattaccaaagatttcaaatttctactgagccacctactacaccatcaagtgggtctgtttttatgtttgatcgaaaggtgctcagatacttcaggaaagacggtcacaattggaggaagaaaaaagatggaaagactgtgaaggaagctcatgagaggttgaaggcgggaagcgttgatgttctacattgttactatgcgcatggacaggacaatgaaaactttcaaagacgcagttactggttgcttcaggaagaactttcccacatagtttttgttcactacctcgaagttaagggtagtagagtttctacttcttttaaccggatgcaaaggactgaagacgcggctcggtctcctcaagaaactggggacgccttgaccagtgaacatgatggttatgcttcttgcagcttcaatcaaaatgatcatagcaatcattcacaaactactgactcagcaagtgtcaatggttttcactctccagaacttgaagatgctgaatcagcatacaatcagcatggaagttccacagcttactctcatcaagaacttcagcagcctgcaacaggaggaaaccttactggttttgatccttactatcaaatctctttgacgcccagggatagttatcaaaaagagcttcgcacaatccccgtaactgattcttcaattatggtagacaaaagcaaaactatcaacagtcctggagtaacaaatgggttaaaaaacagaaaatccattgattcccaaacctgggaagagattctgggaaattgtggttctggagttgaagccttacctttgcagcctaacagtgagcatgaagtgctggaccaaatactcgaaagctcttttacaatgcaagattttgctagtctacaagagtccatggtcaaaagccagaatcaggagttaaattcaggacttacatctgatcgtaccgtgtggttccaaggacaagatatggagctaaatgctataagcaatctagcttcgaatgaaaaagctccatatctatctacgatgaaacaacatctgttacacggtgcattgggcgaagaaggtctgaaaaagatggacagtttcaatcgctggatgagcaaagaacttggagatgttggtgttatagctgatgcaaacgagtcctttactcaatcaagttcaagaacctactgggaagaagttgagagtgaggatgggtccaatggtcacaactctaggagggacatggatggatatgttatgagtccttccctctcaaaggaacagctctttagcatcaatgacttctctccaagctgggcttatgtgggttgtgaagtggtggtttttgtcactggaaaattcttaaagactcgggaggagactgaaattggcgagtggtcttgcatgtttgggcaaacagaagttccagcagatgttatatctaatggtattctccaatgtgttgctcctatgcatgaggctggaagagttcccttttatgtaacatgttccaacagattggcatgcagtgaagtgcgtgaattcgagtataaggttgccgagtctcaagtttttgatagagaagcagatgatgagtctactattgacattcttgaggcaagatttgttaaactgttgtgctcgaaatctgaaaatacaagccctgtttctgggaatgacagtgatttgtcacaattgagcgagaagattagtttactacttttcgagaacgatgaccagttggatcagatgctcatgaatgaaatctcccaagaaaatatgaaaaacaaccttttgcaggaatttctgaaagaaagcttacactcatggcttttacaaaagatagcagaaggtggaaaaggtccaagtgttttggatgaaggtggccaaggtgtattacattttgcagcttctcttggttacaactgggccttagaaccaacaataatcgctggtgtaagcgttgattttcgcgatgtaaatggttggaccgcacttcattgggcagctttctttggcagggagaggataattggttcactcatagctcttggtgctgctcctggaactttaactgacccaaatccagatttcccatcaggaagcacaccttctgatctagcctatgctaatggtcacaaaggaattgctggttatctctcagaatatgccttaagagctcatgtttctttgctcagtctaaatgataaaaatgccgaaactgttgagatggctcctagcccatccagctcatcattgacagactcgttgacagctgtacgtaacgctactcaggcagcagctcggattcatcaggttttcagggctcagtctttccagaagaagcaactaaaagaatttggagataaaaagcttggaatgtcggaggagcgtgctctttcgatgcttgctcctaaaacacacaaatcaggaagggcacatagtgatgattccgtgcaagccgctgctattcggattcagaacaagttccgaggttacaagggaagaaaagactatttgattaccagacaaagaatcatcaaaatacaggctcatgtgagaggttatcagtttaggaaaaactacagaaagataatttggtcagtgggggtattagagaaggtgatattacgttggagacggaaaggagctggtttgcgcgggtttaagtcagaagcacttgttgagaagatgcaagacggaacagagaaagaagaagatgatgattttttcaaacaaggaagaaagcaaacagaggataggctacaaaaagctcttgcaagagtgaaatccatggttcaatatcctgaagctagagatcaataccgtagattgctaaatgttgtcaacgacatccaagaaagcaaggttgaaaaagctcttgaaaattcagaagcaacttgttttgatgatgatgatgatctgatagatattgaagcattgttggaagatgatgacacattgatgttgcctatgtcctcatctttgtggaccagttaaatcactctcaagctttgttgtgatattgtgtcacagtattattgactcattaaacttgtaaattcttgtgtaatcactcttctcatatactgtaactgcattcatgactctaatttaaatgatatatatttgaaacataaatcaaacttatgt

SEQ ID NO: 588 - protein, 1032 aa, Arabidopsis thaliana
MAEARRFSPVHELDVGQILSEARHRWLRPPEICEILQNYQRFQISTEPPTTPSSGSVFMFDRKVLRYFRKDGHNWRKKKDGKTVKEAHERLKAGSVDVLHCYYAHGQDNENFQRRSYWLLQEELSHIVFVHYLEVKGSRVSTSFNRMQRTEDAARSPQETGDALTSEHDGYASCSFNQNDHSNHSQTTDSASVNGFHSPELEDAESAYNQHGSSTAYSHQELQQPATGGNLTGFDPYYQISLTPRDSYQKELRTIPVTDSSIMVDKSKTINSPGVTNGLKNRKSIDSQTWEEILGNCGSGVEALPLQPNSEHEVLDQILESSFTMQDFASLQESMVKSQNQELNSGLTSDRTVWFQGQDMELNAISNLASNEKAPYLSTMKQHLLHGALGEEGLKKMDSFNRWMSKELGDVGVIADANESFTQSSSRTYWEEVESEDGSNGHNSRRDMDGYVMSPSLSKEQLFSINDFSPSWAYVGCEVVVFVTGKFLKTREETEIGEWSCMFGQTEVPADVISNGILQCVAPMHEAGRVPFYVTCSNRLACSEVREFEYKVAESQVFDREADDESTIDILEARFVKLLCSKSENTSPVSGNDSDLSQLSEKISLLLFENDDQLDQMLMNEISQENMKNNLLQEFLKESLHSWLLQKIAEGGKGPSVLDEGGQGVLHFAASLGYNWALEPTIIAGVSVDFRDVNGWTALHWAAFFGRERIIGSLIALGAAPGTLTDPNPDFPSGSTPSDLAYANGHKGIAGYLSEYALRAHVSLLSLNDKNAETVEMAPSPSSSSLTDSLTAVRNATQAAARIHQVFRAQSFQKKQLKEFGDKKLGMSEERALSMLAPKTHKSGRAHSDDSVQAAAIRIQNKFRGYKGRKDYLITRQRIIKIQAHVRGYQFRKNYRKIIWSVGVLEKVILRWRRKGAGLRGFKSEALVEKMQDGTEKEEDDDFFKQGRKQTEDRLQKALARVKSMVQYPEARDQYRRLLNVVNDIQESKVEKALENSEATCFDDDDDLIDIEALLEDDDTLMLPMSSSLWTS

SEQ ID NO: 589 - DNA, 1059 bp, Arabidopsis thaliana
ctctactaaaagtctctctatagcgatgtcatcggacaacgaatcgacaccgtctcaagcgacggtagaaatgatggcgacttcgccggcgaagattaaagagtatccagaaccattggctttacatgaagttgtcgtcaaggattcttctgtcttctgggatactctcaggcggtttcactcaattatgtccactaagttcatgattcctgtgattggaggaaaagaactagatttgcatgttttgtatgtggaagtcacgaggaggggaggttacgaaaaggtagtcgtagagaaaaaatggagggaagttggaggagtgtttagattctctgcgacaacaacaagtgcttcgtttgtcttaaggaaacattatctcaatcttctcttccattacgaacaagttcatctcttcactgctcgtggtcctcttcttcatcccatagctacatttcatgcaaatccctcaacgagcaaagaaatggcgctcgtcgaatatactcctccgagtataagatatcataatactcatcctccttctcaaggttcgtcgagtttcacagccataggtacaatagaaggcaaattcgattgtggttatctggtaaaagttaagttgggctcagagattcttaacggcgttctttatcattcggcccagcccggcccatcatcatctccaaccgctgttctaaacaatgccgttgtaccttatgttgaaactgggaggagacggcgtcgtttaggtaaaagacgaagaagcagacgcagagaagatccgaattacccgaaaccgaaccggagcggttacaatttcttctttgctgagaaacattgcaagctcaaatcactttatcccaacaaggagagagagtttacgaaacttatcggagaatcgtggagcaatctctctaccgaagaacgaatggtttatcaagacattggattgaaggataaggaaaggtatcagagggagttgaatgagtacagagaaacgttgagacttagggatggtgacatgacaaacggcaaggctttttaggtgatttagttaaaacg

SEQ ID NO: 590 - protein, 338 aa, Arabidopsis thaliana
MSSDNESTPSQATVEMMATSPAKIKEYPEPLALHEVVVKDSSVFWDTLRRFHSIMSTKFMIPVIGGKELDLHVLYVEVTRRGGYEKVVVEKKWREVGGVFRFSATTTSASFVLRKHYLNLLFHYEQVHLFTARGPLLHPIATFHANPSTSKEMALVEYTPPSIRYHNTHPPSQGSSSFTAIGTIEGKFDCGYLVKVKLGSEILNGVLYHSAQPGPSSSPTAVLNNAVVPYVETGRRRRRLGKRRRSRRREDPNYPKPNRSGYNFFFAEKHCKLKSLYPNKEREFTKLIGESWSNLSTEERMVYQDIGLKDKERYQRELNEYRETLRLRDGDMTNGKAF

SEQ ID NO: 591 - DNA, 778 bp, Arabidopsis thaliana
agcctcttttttgttcctcttgccgtcgtatatatatgtcttctcaaccgaatcatcagacttcaatatcaagtttactccatgatcgcttgcatatccctcctgcagaaacaatcgttgagaaagagtctgcagagaaggacacttgtcaatcacaaagaaaaaggaaagaaccagttttgcatgaggttgatggctcaagtagtggtgcagcaaagaaacaagaccataacgctaaggagcgtttaaggaggatgagacttcatgcctcttacctcactcttggcactcttcttcctgaccattcttcttcttcttcaaagaagaaatggtctgcaccatctataatcgataatgtaatcacttacattcccaagctacagaatgaagttggagagctaactctaagaaagcagaagcttgtggagttagagagacgaggtccttctattcgagcaatctcggttcttgaattgggggaatcaggttatgaggctgttgtacagatatgcttgaagaaagaaaacgaagatgagttctccaacttgcttcatgtaatggaggtgcaaggtttgagtgttttaagtgcttctacttctcaagtttgccgagagcaaagggtggtttgctacaacttccatgtcaagatggatgagaagccatgtgaaggtgatgactacatcacagtgttaaagaacaacatcatttcttcgcttcgtgacaacacaaagtgcaaatgatatatagtgaggtatagaatcaacagaatatctttgat

SEQ ID NO: 592 - protein, 234 aa, Arabidopsis thaliana
MSSQPNHQTSISSLLHDRLHIPPAETIVEKESAEKDTCQSQRKRKEPVLHEVDGSSSGAAKKQDHNAKERLRRMRLHASYLTLGTLLPDHSSSSSKKKWSAPSIIDNVITYIPKLQNEVGELTLRKQKLVELERRGPSIRAISVLELGESGYEAVVQICLKKENEDEFSNLLHVMEVQGLSVLSASTSQVCREQRVVCYNFHVKMDEKPCEGDDYITVLKNNIISSLRDNTKCK

SEQ ID NO: 593 - DNA, 905 bp, Arabidopsis thaliana
aaaaaacagaatcaataaccttgtccttgattaagcaaaaaatgtgtgcattagtcccttcatttttcacaaacttcggttggccgtcaacgaatcaatacgaaagctattacggtgccggagataacctaaataacggcacatttcttgaattgacggtaccacagacttatgaagtgactcatcatcagaatagcttgggagtatctgtttcgtcagaaggaaatgagatagacaacaatccggttgtggtcaagaagcttaatcacaatgctagtgaacgtgaccgacgcaagaagatcaacactttgttctcatctctccgttcatgtcttccagcttctgatcaatcgaagaagctaagtattcctgaaacggtttcaaagagcttaaagtacataccagagctgcaacagcaagtgaagaggctaatacaaaagaaggaagaaattttggtacgagtatcgggtcaaagagactttgagctttacgataagcagcaaccaaaggcggtcgcgagttatctctcaacggtttctgccactaggcttggtgacaacgaagtgatggtccaagtctcatcgtccaagattcataacttttcgatatcaaatgtgttgggtgggatagaagaagatgggtttgttcttgtggatgtttcatcatcaagatctcaaggagagaggctcttctacactttgcatcttcaagtggagaatatggatgattacaagattaattgcgaagaattaagtgaaaggatgttgtacttgtacgagaaatgtgaaaactcgtttaactaggtgactaattcatataatggtgtgtttatccactagttctcatttctttttagctgtgtccttttctcatatgaatctaacactgatctggaccaaaaaaaa

SEQ ID NO: 594 - protein, 253 aa, Arabidopsis thaliana
MCALVPSFFTNFGWPSTNQYESYYGAGDNLNNGTFLELTVPQTYEVTHHQNSLGVSVSSEGNEIDNNPVVVKKLNHNASERDRRKKINTLFSSLRSCLPASDQSKKLSIPETVSKSLKYIPELQQQVKRLIQKKEEILVRVSGQRDFELYDKQQPKAVASYLSTVSATRLGDNEVMVQVSSSKIHNFSISNVLGGIEEDGFVLVDVSSSRSQGERLFYTLHLQVENMDDYKINCEELSERMLYLYEKCENSFN

SEQ ID NO: 595 - DNA, 1161 bp, Arabidopsis thaliana
catagagaaccatctggttctttaaggcaccatcattcaacaagtaaacaataaaggaaattaaattatcacaagacagaaccacaaaatcctttggagatctgacactggtaaagctcaaagtgtcaaactatggatccttataagaatcttaatccaaaaggttaccagagacagagaccgtttagctcagccggcgagagtggcggcagcggcggctccggtacggcccatgaaacagatgacaataagaagaagaagaagcttctccaccgcgacatcgaacgccaaagaagacaagaaatggctacactctttgctactcttcgtactcacttacctcttaaatacatcaagggaaaaagagctgtgtcggatcatgtaaatggagcggtaaatttcattaaggacacggaagcacggattaaagaacttagtgcaagaagagacgagttaagtagagaaaccggccaaggatataaatcgaatccggatccaggaaaaactggatccgatgtaggcaaatcggagccggcgactgtgatggtgcaaccacacgtgagcggtttagaagtggtagtgagcagcaactcctcaggccccgaagctttgccactatcaaaagtgctcgagacaattcaggagaaagggcttgaagtcatgagctccttcactacaagagtcaatgataggctcatgcacactattcaagtagaggttaatagtttcggatgcatagacttattatggttgcagcagaagctagttgaggatttgatactttcgacggggtactaatcatgcagaaacataccattcgtagtcctaaagaacttcctcatcaaaaaatcaaagtcttcttgaaatttcgttatgagagcaaggtgcataggtgttaaagttcattcatggattgaggtgtagctttggtttaaacaagttcaagtgacttcatggggtagatcataacttcaccatgattcgccgccgtaaagaccaagggtctgatgttttcagtagagattttttttttctcacgggcaagccatttttttgtttccctttcattataacattttgtatcactccattgttaggttttcttgggttttctcgtatggaaaataagtttttctgtaatacatatccatgaatcattta

SEQ ID NO: 596 - protein, 221 aa, Arabidopsis thaliana
MDPYKNLNPKGYQRQRPFSSAGESGGSGGSGTAHETDDNKKKKKLLHRDIERQRRQEMATLFATLRTHLPLKYIKGKRAVSDHVNGAVNFIKDTEARIKELSARRDELSRETGQGYKSNPDPGKTGSDVGKSEPATVMVQPHVSGLEVVVSSNSSGPEALPLSKVLETIQEKGLEVMSSFTTRVNDRLMHTIQVEVNSFGCIDLLWLQQKLVEDLILSTGY

SEQ ID NO: 597 - DNA, 540 bp, Arabidopsis thaliana
atgtcaccggaggaatacgttagggtttggccggattccggtgatcttggaggaactgagctgaccctagctttgcctggcactccgacaaatgcatcggaaggtccaaaaaagttcgggaacaaacgtagattcctcgagaccgttgatttaaaactcggggaagcacacgagaacaattatatctcaagcatggtcactaatgaccagttggtgggctggccgccggtagcgacagcgaggaaaacagtgaggcggaaatacgtgaaagtggcgttggatggtgcggcctatctcagaaaggttgatcttgggatgtacgattgctatggacagcttttcaccgctctagaaaacatgtttcaggggataataacaatatgtagagtgacagagttggagaggaagggagagtttgttgctacttacgaggataaggacggtgacttgatgttagtcggagatgtgccgtggatgatgtttgtggaatcttgcaaacgtatgaggttaatgaaaaccggagatgctattggattatag

SEQ ID NO: 598 - protein, 179 aa, Arabidopsis thaliana
MSPEEYVRVWPDSGDLGGTELTLALPGTPTNASEGPKKFGNKRRFLETVDLKLGEAHENNYISSMVTNDQLVGWPPVATARKTVRRKYVKVALDGAAYLRKVDLGMYDCYGQLFTALENMFQGIITICRVTELERKGEFVATYEDKDGDLMLVGDVPWMMFVESCKRMRLMKTGDAIGL

SEQ ID NO: 599 - DNA, 822 bp, Arabidopsis thaliana
gaaggataagaatcgcaaagctcatatcacaaaactttgagatctcatttcatctttcttcgattctacctactccgattcaatcgatcttatcgagacatggatgctcgtaagagaggacgccctgaagctgctgcctctcacaactccaatggcggattcaagaggtctaagcaagagatggaatcaatttcaactggtttaggaagcaaatccaagccatgcactaaatttttcagcacttctggatgtccatttggtgacaattgccacttcttgcactatgtgcccggtgggtacaatgctgcagcgcagatgacaaatctccgaccaccggtttctcaagtttccagaaatatgcaaggatctggtggtcccggcggcagattctcagggagaggagatccaggatcaggccctgtttcaatctttggtgcttctacttccaagatcagtgtagatgcttctttagccggtgccatcattggaaaaggtggaatccattccaaacagatatgccgtgaaacaggagcaaaattatcgattaaagatcatgaaagagacccaaacttgaagattatcgagctggaaggaacatttgaacagatcaatgtagcgagtgggatggtgagagagcttatagggaggcttggatcagtgaagaaacctcaagggattggtggtcctgaagggaaaccacatcctgggagcaactacaaaaccaagatctgtgataggtactctaaagggaactgtacatatggagatagatgccattttgctcatggtgaatctgagctgcgcaggtcaggaatcgcttag

SEQ ID NO: 600 - protein, 240 aa, Arabidopsis thaliana
MDARKRGRPEAAASHNSNGGFKRSKQEMESISTGLGSKSKPCTKFFSTSGCPFGDNCHFLHYVPGGYNAAAQMTNLRPPVSQVSRNMQGSGGPGGRFSGRGDPGSGPVSIFGASTSKISVDASLAGAIIGKGGIHSKQICRETGAKLSIKDHERDPNLKIIELEGTFEQINVASGMVRELIGRLGSVKKPQGIGGPEGKPHPGSNYKTKICDRYSKGNCTYGDRCHFAHGESELRRSGIA

SEQ ID NO: 601 - DNA, 1209 bp, Arabidopsis thaliana
atggaagacgaacatcaagatctccataaacccattaatggagctttgcgagacctcaagattactcggtcacagaaagaaacagaaaagtctacgaaccaacagcaagatgttacttgttactatggtctaagggaaaactcgaagaagaaaacccaggaatctccggaaccaatgaagaagattttgtttcgatgcgaagaatgtggaaaagggtttcggtacgagaaatattttaagaatcatcgctcgatgatgcatttatcgccgaacgagaaggtttgtgaagaatccttgatgactctgtctcgtagccttgggtttgtgaagaagaagaaaagatcaagacttggtaggtctgggaagactttatttactacgtttcttgaaccgagttctatttttgatgcgactgatgaagaattagaagtggcggattgtttgattctattgtctaagagtgctcccaaggttgtagacgaattgaaaagtctttctgaggcagtacgtgttactcctgaaacacctgaaagtagctatgatttgggttgtttgctcaacaagaaaccgagaaaaggtggtgaattggaatctggggttttaagtaatgagcaaagacttatggaagaagggtttagtagttatggaacatcgaaagaaccagctagcttcttgagagacgaaaacagattggatcagcagaaacggagaaaagatggtgaatttgaatccggacttttgagtaatgagcaaagactgctagaagaagagattactactcctgtgacattcaaaggtccagcgagttccttgagacacaagtgtgctttggatcgaaatggaggtgaatttggtcctgagtttttgagtaatgagcaaacactgatggaagaaacatggaaagaaccagtgagtttcttagaagataagcatgaatttgatcagcggaaaatgcgagaagctggcgactttgaatctaggttttacagaattgagcttggagtaggagctatggagtgtacttcttcagatactgatatgctcacgcaatctgataagaagaacgttgagcatcgatgcaggttgtgcaacaagatattctcgtcttatcaagctctagggggtcatcagacgtttcatcggatgagcaaatgtaagaacaagaagaatggcatagaggaatcagttgaacccaggatgactctgtga

SEQ ID NO: 602 - protein, 402 aa, Arabidopsis thaliana
MEDEHQDLHKPINGALRDLKITRSQKETEKSTNQQQDVTCYYGLRENSKKKTQESPEPMKKILFRCEECGKGFRYEKYFKNHRSMMHLSPNEKVCEESLMTLSRSLGFVKKKKRSRLGRSGKTLFTTFLEPSSIFDATDEELEVADCLILLSKSAPKVVDELKSLSEAVRVTPETPESSYDLGCLLNKKPRKGGELESGVLSNEQRLMEEGFSSYGTSKEPASFLRDENRLDQQKRRKDGEFESGLLSNEQRLLEEEITTPVTFKGPASSLRHKCALDRNGGEFGPEFLSNEQTLMEETWKEPVSFLEDKHEFDQRKMREAGDFESRFYRIELGVGAMECTSSDTDMLTQSDKKNVEHRCRLCNKIFSSYQALGGHQTFHRMSKCKNKKNGIEESVEPRMTL

SEQ ID NO: 603 - DNA, 1122 bp, Arabidopsis thaliana
atggcggctcgaaaactagggtcgttgttacgtcaatactttttctctctatgcttcctcttcctcggttgcttcttcttccctaaagacgcagactataaacaaaagagaagaaagaagaagcttagaagagtttcttcttcttctggttcatctctatcctcttcttggacgtatttaaaacgagttttcttatccacgacaaggatatccaaatcccgtaaccaaacacatcctaacgttactttaacatccgcaagatcatctcaaaactccctcgtcactctcgtccaacccgataccacaaaccaacccgacccggaaacacgtattcatcagcaaaccgaattcgagatctcctcttccgacgagattttcccttgtaactcgtgtggcgagattttcccaaaaatcaatctcctcgagaatcacatcgcgatcaaacacgccgtgtcggagctaatcgccggagaatcaagcacgaacatcgtcaagatcatattcaaatctggttggccggagcaaggtaattacaaatctccggtgatcaatcgaatcttaaaaatccacaacagttcaaagattctcaccagattcgaagagtatcgtgagttcgtgaaagctaaagccgctcgtagcaacggcggtggaagacggtgggacgatgaacgttgcgtcgccgacggaaacgaacttttacgattttactgctcgacgtttatgtgtgatttagggcaaaacggtaaatcaaatctctgtggtcatcagtattgtagtatctgtggtatcatcggatctggattctcgccgaagctcgacgggatcgcgacgttggcgacggggtggagaggacacgtggcggttccggaggaggttgaagaagagtttgggtttatgaatgtgaaacgggccatgttggtttgtcgggttgtagcgggtcgggtcgggtgtgatttgattgatgatgatgacgtggataagagtgatggtggagggtatgattctctggttgggcagagtgggaacaagagtggggctctgttgaggatcgacgatgatgagcttttggtttttaatccaagggctgtgcttccttgttttgttattgtgtatactgtgtaa

SEQ ID NO: 604 - protein, 373 aa, Arabidopsis thaliana
MAARKLGSLLRQYFFSLCFLFLGCFFFPKDADYKQKRRKKKLRRVSSSSGSSLSSSWTYLKRVFLSTTRISKSRNQTHPNVTLTSARSSQNSLVTLVQPDTTNQPDPETRIHQQTEFEISSSDEIFPCNSCGEIFPKINLLENHIAIKHAVSELIAGESSTNIVKIIFKSGWPEQGNYKSPVINRILKIHNSSKILTRFEEYREFVKAKAARSNGGGRRWDDERCVADGNELLRFYCSTFMCDLGQNGKSNLCGHQYCSICGIIGSGFSPKLDGIATLATGWRGHVAVPEEVEEEFGFMNVKRAMLVCRVVAGRVGCDLIDDDDVDKSDGGGYDSLVGQSGNKSGALLRIDDDELLVFNPRAVLPCFVIVYTV

SEQ ID NO: 605 - DNA, 999 bp, Arabidopsis thaliana
atgtctcagagacttcatggttgcaaaacatgcgggagaaagtttggaactttaaaaggtgtgtatggtcaccagaggatgcattctggtaatcacaatagaatcgaagatgagaatggtttggaaaggatttggggtcttaagaagaagtctagggtttgctctgtttcagcttttgatcgattcaaaggatcttcttttatggctgagattgagaaacatgaggtgattgaagctgcattgaacttggttatgttgtgtcaaggagtttatgactttgcttctatcagtaatttgcctctaggtgatggtttcatggatttagagcttaaaccttgtcctttgagaaggaaactacagaaaaaatctcgctccagttataaatgcagtatatgtgagaagagttttgtgtgttctcaagctcttggtagtcaccagagacttcacagatggaaactagtgcctaaacctgagtacattgaagatgatagttcactgttagactcatcagaagctaagaagattgtttcaaaaccatcaagctttgaacatgctcaggaggagaagatcttacaatgtgttgagccgaaactagagttccacgaacagcttgctcactcgggtttcgacaagtttgatacttgcagtaaaatcaggttcagtgcattaccttctcctccagaagctaagaagattgtttcacaaccaccaagctttgaagtctctgtggatgaaaagatcttatatcgtgctgagccaaaactaaacttcagcgaaccgcttgctcactcgtgtttcgacaattctagtagctatagaagcataatatgtggcaagagttttgtgtgttcacaagcattaggtggtcaccaaacacttcacagatcgattaaaggccaattagcgggtactgaagatggtaattcactctctgtgactgactcagaagctagcaagattgttgcacaaccatcaagctacaagtctcaggggatataa

SEQ ID NO: 606 - protein, 332 aa, Arabidopsis thaliana
MSQRLHGCKTCGRKFGTLKGVYGHQRMHSGNHNRIEDENGLERIWGLKKKSRVCSVSAFDRFKGSSFMAEIEKHEVIEAALNLVMLCQGVYDFASISNLPLGDGFMDLELKPCPLRRKLQKKSRSSYKCSICEKSFVCSQALGSHQRLHRWKLVPKPEYIEDDSSLLDSSEAKKIVSKPSSFEHAQEEKILQCVEPKLEFHEQLAHSGFDKFDTCSKIRFSALPSPPEAKKIVSQPPSFEVSVDEKILYRAEPKLNFSEPLAHSCFDNSSSYRSIICGKSFVCSQALGGHQTLHRSIKGQLAGTEDGNSLSVTDSEASKIVAQPSSYKSQGI

SEQ ID NO: 607 - DNA, 1331 bp, Arabidopsis thaliana
gaaatttctcgtcctctttctctgttttttgtttctggggaaaatgtcttctgcgattgttgtttctcaagatgcggaatcgcttggtctgcaaatttatagccgcaaggagaaatctcttggggttctcgtctccaatttcctgagactgtataaccgagacgatgtggatctcattgggctcgatgatgccgctgggcaattaggagttgaaaggcggcgtatctatgatgtggtcaatatattggagagtattgggattgtggcaagaagagggaagaatcaatactcgtggaaaggttttggagagattcctcgttctctagatgaactcaaggaagaagggatgagagagaggttaggttactcaagttcaaacaattcagacaaggtttcaaatggttgtgaaagagaagaacctttaactttaacacctgatgatcaggagaactcatcatcctctaaaatggaccaaaagaaggaaaaatctctctggcttctcgcacagaattttgtgaagatgtttctatgttctgatgatgatctcatcacacttgatagtgctgcaaaagccttgctgagcgactctccagattcagtccatatgcgaactaaagttagaagactttacgacattgcaaatgtatttgcctcgatgaatttaatcgagaagactcatataccagtgactaggaaaccagcatataggtggttagggtccaaaagcatagctgaaagaggattaagcttatttaattccggagaaccgaagcgggtatttggaacagagatcacaaacttgagggcaaagagaaacaaaacatattgttcatcaatccgcaagcaaattggatataagaaacatgacgaggaaaacacagagcaggaatcgaaaccagctgcaagtaaatatgtgtttggcccgttctccccaataggagcatctaagacgaacaacgacaaagtcggaaagggaaggttactagagatcgaggcccttgcttctacctaccaaccacagtattgcaatcaagaaataactggtcttcttgggcatttcacggaggcatggaagaaatggtatgcagaggttgatcggaataaataacattactgaggtcacatgttttctctgggtacatgagagcacataactcatccaacatatagctttagtctttgtttgccttaaacaatagtaagaaacagagtattgttattgttaataaaagtcacacccaacaaattccgagtgactttgttctatacttgattcgaattcctatcctctccttaacttaatataaatgtttaatccatccaaaaaaaaa

SEQ ID NO: 608 - protein, 354 aa, Arabidopsis thaliana
MSSAIVVSQDAESLGLQIYSRKEKSLGVLVSNFLRLYNRDDVDLIGLDDAAGQLGVERRRIYDVVNILESIGIVARRGKNQYSWKGFGEIPRSLDELKEEGMRERLGYSSSNNSDKVSNGCEREEPLTLTPDDQENSSSSKMDQKKEKSLWLLAQNFVKMFLCSDDDLITLDSAAKALLSDSPDSVHMRTKVRRLYDIANVFASMNLIEKTHIPVTRKPAYRWLGSKSIAERGLSLFNSGEPKRVFGTEITNLRAKRNKTYCSSIRKQIGYKKHDEENTEQESKPAASKYVFGPFSPIGASKTNNDKVGKGRLLEIEALASTYQPQYCNQEITGLLGHFTEAWKKWYAEVDRNK

SEQ ID NO: 609 - DNA, 1158 bp, Arabidopsis thaliana
atgacaactactgggtctaattctaatcacaaccaccatgaaagcaataataacaacaataaccctagtactaggtcttggggcacggcggtttcaggtcaatctgtgtctactagcggcagtatgggctctccgtcgagccggagtgagcaaaccatcaccgttgttacatctactagcgacactacttttcaacgcctgaataatttggacattcaaggtgatgatgctggttctcaaggagcttctggtgttaagaagaagaagaggggacagcgtgcggctggtccagataagactggaagaggactacgtcaatttagtatgaaagtttgtgaaaaggtggaaagcaaaggaaggacaacttacaatgaggttgcagacgagcttgttgctgaatttgcacttccaaataacgatggaacatcccctgatcagcaacagtatgatgagaaaaacataagacgaagagtatatgatgctttaaacgtcctcatggctatggatataatatccaaggataaaaaagaaattcaatggagaggtcttcctcggacaagcttaagcgacattgaagaattaaagaacgaacgactctcacttaggaacagaattgagaagaaaactgcatattcccaagaactggaagaacaatatgtaggccttcagaatctgatacagagaaatgagcacttatatagctcaggaaatgctcccagtggcggtgttgctcttccttttatccttgtccagactcgtcctcacgcaacagtagaagtggagatatcagaagatatgcagctcgtgcattttgatttcaacagcactccatttgagctccacgacgacaattttgtcctcaagactatgaagttttgtgatcaaccgccgcaacaaccaaacggtcggaacaacagccagctggtttgtcacaatttcacgccagaaaaccctaacaaaggccccagcacaggtccaacaccgcagctggatatgtacgagactcatcttcaatcgcaacaacatcagcagcattctcagctacaaatcattcctatgcctgagactaacaacgttacttccagcgctgatactgctccagtgaaatccccgtctcttccagggataatgaactccagcatgaagccggagaattga

SEQ ID NO: 610 - protein, 385 aa, Arabidopsis thaliana
MTTTGSNSNHNHHESNNNNNNPSTRSWGTAVSGQSVSTSGSMGSPSSRSEQTITVVTSTSDTTFQRLNNLDIQGDDAGSQGASGVKKKKRGQRAAGPDKTGRGLRQFSMKVCEKVESKGRTTYNEVADELVAEFALPNNDGTSPDQQQYDEKNIRRRVYDALNVLMAMDIISKDKKEIQWRGLPRTSLSDIEELKNERLSLRNRIEKKTAYSQELEEQYVGLQNLIQRNEHLYSSGNAPSGGVALPFILVQTRPHATVEVEISEDMQLVHFDFNSTPFELHDDNFVLKTMKFCDQPPQQPNGRNNSQLVCHNFTPENPNKGPSTGPTPQLDMYETHLQSQQHQQHSQLQIIPMPETNNVTSSADTAPVKSPSLPGIMNSSMKPEN

SEQ ID NO: 611 - DNA, 1267 bp, Arabidopsis thaliana
tgtttgtttatagcgggaactctcacccaaagtaatttcatctccgattttttttttttggttgttgttcgcatctctgtgtaataaaaagagtaaaaccaaaaccctagaaaaaaaatctccatctttttttattccgccattggaagatcgatcactgagaaggatgagtatggagatggagttgtttgtcactccagagaagcagaggcaacatccttcagtgagcgttgagaaaactccagtgagaaggaaattgattgttgatgatgattctgaaattgggtcagagaagaaagggcaatcaagaacttctggaggcgggcttcgtcaattcagtgttatggtttgtcagaagttggaagccaagaagataactacttacaaggaggttgcagacgaaattatttcagattttgccacaattaagcaaaacgcagagaagcctttgaatgaaaatgagtacaatgagaagaacataaggcggagagtctacgatgcgctcaatgtgttcatggcgttggatattattgcaagggataaaaaggaaatccggtggaaaggacttcctattacctgcaaaaaggatgtggaagaagtcaagatggatcgtaataaagttatgagcagtgtgcaaaagaaggctgcttttcttaaagagttgagagaaaaggtctcaagtcttgagagtcttatgtcgagaaatcaagagatggttgtgaagactcaaggcccagcagaaggatttaccttaccattcattctacttgagacaaaccctcacgcagtagtcgaaatcgagatttctgaagatatgcaacttgtacacctcgacttcaatagcacacctttctcggtccatgatgatgcttacattttgaaactgatgcaagaacagaagcaagaacagaacagagtatcttcttcttcatctacacatcaccaatctcaacatagctccgctcattcttcatccagttcttgcattgcttctggaacctcaggcccggtttgctggaactcgggatccattgatactcgctgaccgagcttctattcccaaattcttcaagaagaagaagtaatgatctaattggtatactaaaaaattatacatctggtttagtgttcaattgagagagactgtaaaatcaattcataggccaacaaatgtttgtttatccaattttcctttttattcgaacttgatgcgatatttcaacggaaacagaaactattgttttaaaccaaaaaaaaaaaaaaaaaa

SEQ ID NO: 612 - protein, 292 aa, Arabidopsis thaliana
MSMEMELFVTPEKQRQHPSVSVEKTPVRRKLIVDDDSEIGSEKKGQSRTSGGGLRQFSVMVCQKLEAKKITTYKEVADEIISDFATIKQNAEKPLNENEYNEKNIRRRVYDALNVFMALDIIARDKKEIRWKGLPITCKKDVEEVKMDRNKVMSSVQKKAAFLKELREKVSSLESLMSRNQEMVVKTQGPAEGFTLPFILLETNPHAVVEIEISEDMQLVHLDFNSTPFSVHDDAYILKLMQEQKQEQNRVSSSSSTHHQSQHSSAHSSSSSCIASGTSGPVCWNSGSIDTR

SEQ ID NO: 613 - DNA, 750 bp, Arabidopsis thaliana
atgaaggttcatgagttttcgaatgggttttcttcatcgtgggatcaacatgactcgacatcatcccttagcctaagctgcaaacgcctccgtcctctcgcccctaagctctccggcagccctccctcccctccttcttcttcctccggcgtcacttcagccacttttgaccttaaaaacttcattagacccgatcaaaccggtccgacaaaatttgaacacaaacgagaccctcctcatcaaacgcacccgggagggacaaggtggaacccgactcaagaacagatagggatacttgagatgttgtacaaaggtggaatgcgtactcctaatgctcaacagattgagcatatcacattgcaactcggtaagtacgggaaaatcgaagggaaaaatgtgttctattggttccagaaccacaaagcccgcgagagacagaagcagaagaggaacaacctcatcagcctaagttgccaaagcagcttcacgaccactggtgtctttaatccgagtgtaactatgaagacaagaacatcatcgtcactagacattatgagagaaccaatggtggagaaggaggagttagtggaagagaatgagtacaagaggacatgtaggagctggggatttgagaacttggagatagagaacaggagaaacaaaaatagtagtactatggcaactacttttaataaaatcattgacaatgtaaccctcgagctttttcctctccatcctgaagggagatga

SEQ ID NO: 614 - protein, 249 aa, Arabidopsis thaliana
MKVHEFSNGFSSSWDQHDSTSSLSLSCKRLRPLAPKLSGSPPSPPSSSSGVTSATFDLKNFIRPDQTGPTKFEHKRDPPHQTHPGGTRWNPTQEQIGILEMLYKGGMRTPNAQQIEHITLQLGKYGKIEGKNVFYWFQNHKARERQKQKRNNLISLSCQSSFTTTGVFNPSVTMKTRTSSSLDIMREPMVEKEELVEENEYKRTCRSWGFENLEIENRRNKNSSTMATTFNKIIDNVTLELFPLHPEGR

SEQ ID NO: 615 - DNA, 1107 bp, Arabidopsis thaliana
agtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcggata

SEQ ID NO: 616 - protein, 334 aa, Arabidopsis thaliana
MMDMTPTITTTTTPTPKSPEPESETPTRIQPAKPISFSNGIIKRHHHHHHPLLFTYKECLKNHAAALGGHALDGCGEFMPSPSSISSDPTSLKCAACGCHRNFHRRDPDNNNDSSQIPPPPSTAVEYQPHHRHHPPPPPPPPPPRSPNSASPPPISSSYMLLSLSGTNNNNNNLASFSDLNFSAGNNHHHHHQHTLHGSRKRFRTKFSQFQKEKMHEFAERVGWKMQKRDEDDVRDFCRQIGVDKSVLKVWMHNNKNTFNRRDIAGNEIRQIDNGGGNHTPILAGEINNHNNGHHGVGGGGELHQSVSSGGGGGGFDSDSGGANGGNVNGSSSS

SEQ ID NO: 617 - DNA, 729 bp, Arabidopsis thaliana
atggatttgtcttccaaaccacaacaacaacttctaaactctcttcccatcgccggagaactaactgtcaccggagaaatgggtgtttgttacaaagagtgtttgaaaaaccacgcggctaatctcggcggccatgctctcgacggttgcggcgagtttatgccgagtcccacggctacttccaccgatccttcttctctccgttgcgctgcttgtggctgccaccgtaacttccaccgccgtgacccttccgagaatctcaacttcctcaccgcgcctccgatttcttctccctccggcactgagtcgccgccgtctcgtcacgtgtcttctcctgttccttgctcttactacacctcagctcctccacatcacgtgattctctctctcagctccggtttccctggaccgtcagatcaagatccaacggtggttaggtcagagaacagttcaagaggagcaatgaggaaacgaacaagaaccaaattcacgccggagcagaagatcaagatgagagccttcgcagagaaagctggttggaaaatcaacggatgtgatgaaaagtcggtgagagagttttgtaacgaagttgggattgagagaggagttcttaaagtgtggatgcataacaacaagtactcacttctcaatggcaagatcagagagatcgaacatggcctgtgtctgaacactcacagcaatgatggtgatgggtcttcatcttcttga

SEQ ID NO: 618 - protein, 242 aa, Arabidopsis thaliana
MDLSSKPQQQLLNSLPIAGELTVTGEMGVCYKECLKNHAANLGGHALDGCGEFMPSPTATSTDPSSLRCAACGCHRNFHRRDPSENLNFLTAPPISSPSGTESPPSRHVSSPVPCSYYTSAPPHHVILSLSSGFPGPSDQDPTVVRSENSSRGAMRKRTRTKFTPEQKIKMRAFAEKAGWKINGCDEKSVREFCNEVGIERGVLKVWMHNNKYSLLNGKIREIEHGLCLNTHSNDGDGSSSS

SEQ ID NO: 619 - DNA, 1144 bp, Arabidopsis thaliana
tctctttctctctctctctctctctctctttatcttctttcttcaaagtctatcactttataaaaccctaattaaatctctaaactccttagcctctctctattctcagaaccttgtggttattctcaagaaaggtttcattttgagataaagtttgctgctctttctggttgtggatagatcaaaagaatggagattgcaagtcaagaagatcctattccaataaacactagttatggtaatagtggaggtgggcatgggaacatgaaccatcatcatcatgccaattctgcaccatcatctctcaacattactacttcaaacccactactagtctcctcaaatagtaatggtcttggtaaaaatcatgatcattctcatcatcatcatgtgggttacaacatcatggttaccaacatcaagaaagagaagcctgtggtgataaagtacaaggaatgcctaaagaaccatgcagctaccatgggaggcaatgccattgatggttgtggagagtttatgccaagtggtgaagaaggttccattgaagctctcacttgctcagtttgcaactgccatagaaactttcatagaagagaaaccgaaggtgaagagaaaacattcttttccccttacctcaaccaccaccaaccacctccgcagcagagaaaactcatgttccaccacaagatgatcaaatcaccattaccacaacaaatgataatgcctattggcgttacaaccgctggatccaactcagagtcagaggatcttatggaggaagaaggcggaggaagcttgacattccggcagccaccaccaccaccatcaccgtatagttacggacataatcagaagaaaaggtttaggacaaagtttacacaagagcaaaaggagaagatgattagttttgcggaaagagttggttggaagattcagagacaagaggaatctgttgttcaacagctttgtcaagagattggaattaggagaagagttcttaaagtttggatgcacaacaacaaacaaaatctctccaagaagagcaacaacgttagtaacaatgtcgacctttctgctggtaataacgacattactgaaaatcttgcttctactaatccttagttaagttcagattgttgttata

SEQ ID NO: 620 - protein, 310 aa, Arabidopsis thaliana
MEIASQEDPIPINTSYGNSGGGHGNMNHHHHANSAPSSLNITTSNPLLVSSNSNGLGKNHDHSHHHHVGYNIMVTNIKKEKPVVIKYKECLKNHAATMGGNAIDGCGEFMPSGEEGSIEALTCSVCNCHRNFHRRETEGEEKTFFSPYLNHHQPPPQQRKLMFHHKMIKSPLPQQMIMPIGVTTAGSNSESEDLMEEEGGGSLTFRQPPPPPSPYSYGHNQKKRFRTKFTQEQKEKMISFAERVGWKIQRQEESVVQQLCQEIGIRRRVLKVWMHNNKQNLSKKSNNVSNNVDLSAGNNDITENLASTNP

SEQ ID NO: 621 - DNA, 886 bp, Arabidopsis thaliana
gtttcacatttctcgacttcttgaatggagtttgaagacaacaacaacaacaacgacgaagagcaagaagaggatatgaatcttcatgaggaagaagaagacgacgacgccgtttacgactctcctcctctctctcgtgttctccccaaagcctcgacagaaagtcatgaaaccaccggaactacttccacaggcggtggcggaggattcatggttgttcacggcggtggagggagcaggtttaggttccgtgagtgtctcaagaaccaagcggtgaacataggaggacacgcggtcgatggttgtggtgagtttatgccagctggaatcgaaggtaccatcgacgctctaaaatgcgccgcttgtggctgtcaccgtaacttccaccgcaaggaattaccttacttccatcacgcgccgccacaacatcagcctcctcctcccccgccagggttttaccgtcttccagctccggttagctaccgaccaccaccgtcacaagctcctcctcttcagctcgctcttccccctccacaaagagagagatcagaagatccaatggagacgtcttcagctgaagcaggaggagggattaggaagaggcataggactaagtttacggctgagcaaaaggaaaggatgttagctttagctgagaggattggatggagaattcagagacaagacgatgaagtgattcagagattttgtcaggagactggtgttccgagacaagttcttaaggtttggttacataacaacaaacacactcttggtaagtcgccttcaccacttcatcatcatcaggctcctcctcctccaccaccacagtcttcgtttcatcatgaacaagaccaaccatgaatcttgaatttctttgatcact

SEQ ID NO: 622 - protein, 279 aa, Arabidopsis thaliana
MEFEDNNNNNDEEQEEDMNLHEEEEDDDAVYDSPPLSRVLPKASTESHETTGTTSTGGGGGFMVVHGGGGSRFRFRECLKNQAVNIGGHAVDGCGEFMPAGIEGTIDALKCAACGCHRNFHRKELPYFHHAPPQHQPPPPPPGFYRLPAPVSYRPPPSQAPPLQLALPPPQRERSEDPMETSSAEAGGGIRKRHRTKFTAEQKERMLALAERIGWRIQRQDDEVIQRFCQETGVPRQVLKVWLHNNKHTLGKSPSPLHHHQAPPPPPPQSSFHHEQDQP

SEQ ID NO: 623 - DNA, 930 bp, Arabidopsis thaliana
atggatatgagaagccatgaaatgatagagagaagaagagaagacaatggcaacaacaatggtggtgttgttattagtaacatcattagtactaatattgatgataattgcaatggtaataacaacaacactcgtgtctcttgcaactctcaaaccctagatcaccaccaatccaagtctccctcttcgttttccatctccgccgcagctaaacccaccgtaagataccgtgagtgtctaaagaatcatgcggcgagcgtcggcggaagtgttcacgacggatgcggcgagtttatgccgagtggtgaagaaggaacaatcgaagctctcagatgcgctgcttgtgattgtcaccgtaatttccaccggaaagaaatggacggcgttggaagctcggatttgatctctcaccaccgtcatcaccactaccaccataaccaatacggtggaggaggagggagaagacctccgccgccgaatatgatgcttaacccactcatgcttcctccgccaccgaattatcagccgattcaccaccacaagtatggaatgagtcctcccggaggaggaggaatggtgacgccgatgagcgttgcttacggcggtggaggaggaggagctgagtcgtctagtgaagatctgaatctgtacggacaatcaagcggagaaggagctggtgcggcggcgggacaaatggcgttttcgatgtcgtcgtctaagaaaagattcaggacaaagttcacgacggatcagaaggagaggatgatggactttgcggagaagctagggtggaggatgaacaagcaagacgaagaagagcttaagagattctgcggcgagatcggagtgaagagacaagtcttcaaagtttggatgcataacaacaagaacaatgctaagaaaccaccaacaccaacaactactctctaa

SEQ ID NO: 624 - protein, 309 aa, Arabidopsis thaliana
MDMRSHEMIERRREDNGNNNGGVVISNIISTNIDDNCNGNNNNTRVSCNSQTLDHHQSKSPSSFSISAAAKPTVRYRECLKNHAASVGGSVHDGCGEFMPSGEEGTIEALRCAACDCHRNFHRKEMDGVGSSDLISHHRHHHYHHNQYGGGGGRRPPPPNMMLNPLMLPPPPNYQPIHHHKYGMSPPGGGGMVTPMSVAYGGGGGGAESSSEDLNLYGQSSGEGAGAAAGQMAFSMSSSKKRFRTKFTTDQKERMMDFAEKLGWRMNKQDEEELKRFCGEIGVKRQVFKVWMHNNKNNAKKPPTPTTTL

SEQ ID NO: 625 - DNA, 891 bp, Arabidopsis thaliana
tattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 626 - protein, 262 aa, Arabidopsis thaliana
MEVREKKDEKMEMTRRKSSALDHHRLPPYTYSQTANKEKPTTKRNGSDPDPDPDLDTNPISISHAPRSYARPQTTSPGKARYRECQKNHAASSGGHVVDGCGEFMSSGEEGTVESLLCAACDCHRSFHRKEIDGLFVVNFNSFGHSQRPLGSRHVSPIMMSFGGGGGCAAESSTEDLNKFHQSFSGYGVDQFHHYQPKKRFRTKFNEEQKEKMMEFAEKIGWRMTKLEDDEVNRFCREIKVKRQVFKVWMHNNKQAAKKKDL

SEQ ID NO: 627 - DNA, 721 bp, Arabidopsis thaliana
ccctaaacgcaaaaatcattactcaaaaaaaaacaaagtctctctcttctaattagagagccaagaagatgcagagtacttgtgtctacagagaatgcatgcgcaaccacgccgcgaagctcggctcttacgccatcgatggctgccgtgaatactctcaaccatccaccggcgatctctgcgtcgcctgtggttgccaccgcagctaccaccgtcgtatagacgtcatatcttctcctcaaatcaatcacacgcgcttcccgttcacgagcttaaggcgcgtgaagcagctggcgaggctgaaatggaaaacggctgaggaaagaaatgaggaggaggaggatgacacggaggagacttcgacggaagagaagatgacggtgcagaggcggaggaagtcaaagttcacggcggagcagagagaggcgatgaaagattacgcggcgaagttgggatggacgttgaaggataagagagcgcttagagaagagataagagtcttctgtgaagggattggtgttactcgttatcattttaaaacttgggttaacaataataaaaagttttatcactaactaattaactaatatccttaattgagataatactataatttagttccaatttcattttcatcccttctgtgttaatttctcctccttgatcgcttattttaatggattattattttatcaaaaaaaaaaaaaaaaaaaaaaaaaaa

SEQ ID NO: 628 - protein, 168 aa, Arabidopsis thaliana
MQSTCVYRECMRNHAAKLGSYAIDGCREYSQPSTGDLCVACGCHRSYHRRIDVISSPQINHTRFPFTSLRRVKQLARLKWKTAEERNEEEEDDTEETSTEEKMTVQRRRKSKFTAEQREAMKDYAAKLGWTLKDKRALREEIRVFCEGIGVTRYHFKTWVNNNKKFYH

SEQ ID NO: 629 - DNA, 912 bp, Arabidopsis thaliana
atggagtcaccaccactatacgagatatcctcaagctcttcttctgaaaaacctagacaccatttccaatcccttgatctcttccctaacctcaaccaaaactcttgtatcaacaataccctaattgagcctttaccgcttattgatcgcataaacttgaactcaaacctagacctaaaccctaatcccttgtatgcggaagaaggagagcaagaggaggaagaagaagaagaagaagaccgtgaagtggacgtggacttacacatcggccttcctggttttggtaaaccaagcaatgatgctaaacagctgaagaagagaaatgggaaggagatcgccacatatgacgccggaaaaggcatcgagaatgaactttccggaaaggcatactggatcccggcgccggagcaaattctcatagggttcactcatttttcttgccatgtatgcttcaagacattcaatcgctacaacaatcttcagatgcacatgtggggacatggttcacaatacaggaaaggaccggagtcactgaaaggcacacagccacgagccatgttagggatcccttgttactgctgcgttgaagggtgcaggaacaacattgaccatcctcgttccaagccactgaaagactttaggacgctccaaacgcactacaaacgcaaacacggacacaaacccttctcgtgtcgcctttgcggtaagcttttggctgtcaagggcgattggcgaacacatgagaagaattgtggaaaacgttgggtttgcgtttgcggttctgattttaaacacaaacgttcccttaaggaccatgttaaggcgtttgggtctggtcatgggccttatccaactggtttgtttgaagagcaggcttctaattcatctgtctccgagactttttttttttaa

SEQ ID NO: 630 - protein, 303 aa, Arabidopsis thaliana
MESPPLYEISSSSSSEKPRHHFQSLDLFPNLNQNSCINNTLIEPLPLIDRINLNSNLDLNPNPLYAEEGEQEEEEEEEEDREVDVDLHIGLPGFGKPSNDAKQLKKRNGKEIATYDAGKGIENELSGKAYWIPAPEQILIGFTHFSCHVCFKTFNRYNNLQMHMWGHGSQYRKGPESLKGTQPRAMLGIPCYCCVEGCRNNIDHPRSKPLKDFRTLQTHYKRKHGHKPFSCRLCGKLLAVKGDWRTHEKNCGKRWVCVCGSDFKHKRSLKDHVKAFGSGHGPYPTGLFEEQASNSSVSETFFF

SEQ ID NO: 631 - DNA, 1416 bp, Arabidopsis thaliana
atggtggaagtcgaagaattggaaccacttagtccaatggacgatgaagaagaagagataagctatgatgacctcaaaagacgcatgtggaaagaccgaaacctcatggaaaaaaagctcaagcaacagaaacgacacagcaacgacgtcgtttcgtttacaacacaccgagccgaagcttcacggcgcaagaagatggctcgttctcaagattcagtgttgaagtacatgatgaagatcatggaggtgtgtaaagctaaaggttttgtatacggaattgtaccggaaaagggtaaaccaataaccggttcttccgatagcttaagacgttggtggaaagaaaacgttcagttcgaccaaaacgctccagacgctatcacagattacttagcactcgcggctgctgctgctgcagcagagctaatcgataagtcctcatcatcctcgagcttattacacatgttacaggaactgcaagacacgacactagggtcgttactatcagcgttaatgcaacattgcatgccgccacagcggcggtttccgttagagaaaggaattgctccgccatggtggccgacggggacggagctttggtggggagaacaaggagcggcacatgagcacggtgcaccgccatatcgaaagccgcacgatttgagaaaatcttggaaagttagtgttctcgcggctgtgattaaacacatgtcgccgaatttgggaagagtgagacgtctggcgagacaatctaaaagtttgcaagataaaatgatggctaaagagactgatacttggtctcgtgtcttaaaccaagaagaagctcttctcaatatcaaagacctcaagatctcggaagatcaggacgatcaagaatcgtcggggtctaagagaaaaagtgagtctatggaaccgtctaagagtgtttacacttgccaaaactcgagttgtcctaaaagtgatgtgagttttggattcggggacaagaactcgaggacgggtcatgagatccagtgtctttatgggtcgaaccaagaaccgagccagagcggtgaatatacatcttccttgcttgaaacggttccaagtattgttactaattcgactagtgaagatgattattacaatgtgagctcgcgtgcactggacaagcgagatgatgatgatcatagcattaatgggaattggatggaatatttctggttagaaaagatgcagcaggagtttcattgctctaggagattcgaagatgatgagggtactggaacggactttgaccaactcacagaatctgatcgatcggacaacgtgaatttgaaccaacttacaaaatctgatcgatcggacaacgtgaaccggagtgctttttcagtttgggacatgggttgcgaggacaaagacatatacatgttcgattaa

SEQ ID NO: 632 - protein, 471 aa, Arabidopsis thaliana
MVEVEELEPLSPMDDEEEEISYDDLKRRMWKDRNLMEKKLKQQKRHSNDVVSFTTHRAEASRRKKMARSQDSVLKYMMKIMEVCKAKGFVYGIVPEKGKPITGSSDSLRRWWKENVQFDQNAPDAITDYLALAAAAAAAELIDKSSSSSSLLHMLQELQDTTLGSLLSALMQHCMPPQRRFPLEKGIAPPWWPTGTELWWGEQGAAHEHGAPPYRKPHDLRKSWKVSVLAAVIKHMSPNLGRVRRLARQSKSLQDKMMAKETDTWSRVLNQEEALLNIKDLKISEDQDDQESSGSKRKSESMEPSKSVYTCQNSSCPKSDVSFGFGDKNSRTGHEIQCLYGSNQEPSQSGEYTSSLLETVPSIVTNSTSEDDYYNVSSRALDKRDDDDHSINGNWMEYFWLEKMQQEFHCSRRFEDDEGTGTDFDQLTESDRSDNVNLNQLTKSDRSDNVNRSAFSVWDMGCEDKDIYMFD

SEQ ID NO: 633 - DNA, 1133 bp, Arabidopsis thaliana
tctgatcatcaaaataatcaagggtttgtgttttacccttccggggaaaccattgaagatcataattctttgatggatttcaatgcttcatcattcttcacctttgataatcaccgaagccttatctctcccgtgaccaacggtggtgccttcccggtcgtggacgggaacatgagttacagctatgatggctggagtcatcatcaagtggatagtattagccctagagtcatcaaaactccaaatagctttgaaacaacgagcagttttggattgacttcaaactccatgagtaaaccggccacaaaccatggaaatggagactggttatactctggttcaactattgtaaacatcggttcaaggcacgagtccacgtcccctaaactggctggcaataaacggcctttcacgggagagaacacacaactttcaaagaagccgagtagcggtacgaatggaaagatcaagcctaaggcaacaacttcacctaaagatccacaaagcctagcagccaagaaccgaagagaaaggataagcgaacgcctcaaggtattgcaagaacttgtaccgaatggtaccaaggtggatttggtaactatgcttgagaaagcaattggctatgtaaagtttcttcaagtacaagttaaggtacttgcagccgatgagttttggccggcacaaggagggaaagctccggacatttctcaagttaaagaagctattgacgcaatcctctcatcatcacaacgagatagtaactcaactagagaaacaagtatagcagaataattccgaccaaaacaaaaagtatagcagaataattagttactaaatgtatcggcattaattataataccaaacaagtcatcacttttgaattcggtttaaaaaatagttaattggtgacgttacagatcgagaagttattgattcctttaaggctttaattatgtaagagccaacacattgaagtcaccgacgatatgtcagacgtcggtccacacgagcatggaatcttatagtagattagatatgtaatagttatatatgtggaggtatgtttctatttttgtatgttttgtaattctccaagtatgcgtaatgtgatgttgcaaaagtttggtttctga

SEQ ID NO: 634 - protein, 239 aa, Arabidopsis thaliana
MDFNASSFFTFDNHRSLISPVTNGGAFPVVDGNMSYSYDGWSHHQVDSISPRVIKTPNSFETTSSFGLTSNSMSKPATNHGNGDWLYSGSTIVNIGSRHESTSPKLAGNKRPFTGENTQLSKKPSSGTNGKIKPKATTSPKDPQSLAAKNRRERISERLKVLQELVPNGTKVDLVTMLEKAIGYVKFLQVQVKVLAADEFWPAQGGKAPDISQVKEAIDAILSSSQRDSNSTRETSIAE

SEQ ID NO: 635 - DNA, 713 bp, Arabidopsis thaliana
tctctttctttgtctctctcatattctaagtttgctatatatgtaactttctcccttgtagactttcatttgcagcaaaaatagtttctcatatggagaggcaaatcataaacaggaagaaacgagtgttttctcttgaaccaaacaagaaccctagtgcagttttcacgagaaaatacacaagccacttggttcctgcactcaagaagctcaacatgaacaagaactcttcaaaacaaaccgtgaagcatgaagtagatatggctttggctttgtctgctcaagaatttgcatggagccgtttcttgctgcagaagctatcgtcctcatcgaatccaaccactaccactagttcttcttccgatggaattcggattcttgaaagacccgataaagaaggcggaaacgaagaaggagggatagaggagagactgagggaattgaagaagcttttgccaggtggggaagagatgaatgtggaagaaatgttgagtgagattggtaactacattaaatgtcttgagttgcagacgattgctctcaagtccattgttcaagatagtacttgacttttagtttaagtgtataatttatagtttgtttcatgttttttttgttgtctttaaacgaaaatcatctgtgtttttttttttctcttgatttctttaagaacaagagcatgtattatagtgtttttcttttttccttttctt

SEQ ID NO: 636 - protein, 158 aa, Arabidopsis thaliana
MERQIINRKKRVFSLEPNKNPSAVFTRKYTSHLVPALKKLNMNKNSSKQTVKHEVDMALALSAQEFAWSRFLLQKLSSSSNPTTTTSSSSDGIRILERPDKEGGNEEGGIEERLRELKKLLPGGEEMNVEEMLSEIGNYIKCLELQTIALKSIVQDST

SEQ ID NO: 637 - DNA, 1202 bp, Arabidopsis thaliana
gtaacaacgcagagtacgcggggaagttgcaagccatgactaatcttgatgagtttcttgaagagctaagttctattgaatcacattctcagaaaatcgtgaagatagatgagcatttaaaaaagttggatgaagagacgaaagaagatgaagatgaagatgcggcgaagataattcaagatcggagtaccgcgagagaagcagaaattgctctacttatggatctccgtcagaactttcttccaccaccatcgatgtcatcctcctctcttcaaccaccgtcatcgtcaactctcgcaccatcgtcatcatcctctcttcaaccacccgcaccgttgatagacttctttcggtcatcagtgtcatactctcatcaaccaccgtcatcttcaactctcgcaacatcatcgtcaccgtctcttcaaccaccgtcgatgtcatcctcctctcttcaaccacccgcatctttgagggaattctttacgtcgtcagtgtcatactctcatcagccatcttcatcttcaactctcgcaacatcttcgttctttccgtcgtcaatgccatactctgttcgacctcccgattcgtctgatcgaccatctttgagggaattctttccgtcgtcaccatcatcctctattcagccacccgaatcatcatcatctaagcgagcacggcttagtaacatctttccgtcacctttatcctcctctccgtcaccgtttgttaacccgtttctccgtccgcaggcccaagaaccaacaataccaaatttcataaacccaataccacagatctctccaggcctacctgctctattcccaaaccctaaccctaatcctaaccctaacccaatcccaaacccaatccgaaacccagacttggtgtggacaaataggcttcaactagtgtttgatgacgcagttgtcagacttgggggattattcagtgcaacacccaaagccataaacgaactaatttctgaagagggtctcactggtgaccagatccgtagccacttacaagtcttgcgggatcgtcaaaaggctattgcagacaaattagccttggagtgaagaaaatattgaagatgagagataggattaaatagaaagagtgatagtatagaacgtttctttttcttttgttgttaatcttgcatattacaaacaattactatatcataatagaatttatgttaa

SEQ ID NO: 638 - protein, 346 aa, Arabidopsis thaliana
MTNLDEFLEELSSIESHSQKIVKIDEHLKKLDEETKEDEDEDAAKIIQDRSTAREAEIALLMDLRQNFLPPPSMSSSSLQPPSSSTLAPSSSSSLQPPAPLIDFFRSSVSYSHQPPSSSTLATSSSPSLQPPSMSSSSLQPPASLREFFTSSVSYSHQPSSSSTLATSSFFPSSMPYSVRPPDSSDRPSLREFFPSSPSSSIQPPESSSSKRARLSNIFPSPLSSSPSPFVNPFLRPQAQEPTIPNFINPIPQISPGLPALFPNPNPNPNPNPIPNPIRNPDLVWTNRLQLVFDDAVVRLGGLFSATPKAINELISEEGLTGDQIRSHLQVLRDRQKAIADKLALE

SEQ ID NO: 639 - DNA, 1634 bp, Arabidopsis thaliana
attctcaacttttctctgatttgctcgtgtgtttacttcaattcctcagttcttgtgtagaaagttgagtttcatgtgatcaaaattggggctttactacttttaagagaatgagtgacaaagacgagtttgccgcaaagaagaaggatttggtcaatacgccagtggatttgtatcctccggagaatccaatgttgggtccttctccgatgatggattcattcagagaaactctttggcatgatggtggtttcaatgtccacacagatgcagacacttcctttagaggtaataataatattgatatacctcttgaaatgggttggaatatggctcagttccctgcagattcaggattcattgagcgtgctgcaaagttttctttttttggatgtggtgaaatgatgatgaaccaacaacaatcatctcttggagttccagattcaactggcttgtttcttcaagatacacagattcctagtggatccaaactagataatggtcctcttactgatgcatctaagttagtgaaagagagatcgattaataatgtatcagaggattctcaatctagtggaggtaatggtcatgatgatgctaagtgtgggcaaacatcttccaaggggtttagtagtaagaagaggaaaagaattgggaaggattgtgaagaagaagaagataaaaagcaaaaggatgagcaaagtccaacttcaaatgcgaacaagacaaacagtgagaagcaaccttctgattctttaaaggatgggtatattcacatgagggcacgaagaggccaggctactaatagtcacagtcttgctgaaagagtaagaagagaaaaaatcagtgaaaggatgaagttcttgcaagatcttgtgccaggttgcgacaaggtgactggtaaggcagttatgctcgatgaaatcattaactatgtgcaatcacttcaatgccaaatcgagtttttatcgatgaaactttcggctgtgaatcctgtgctcgattttaacctcgaaagcctccttgcaaaagatgctcttcaatcatctgcaccgacatttccccacaacatgtcgatgctttatcctcctgtatcgtatctctctcaaacaggattcatgcaaccgaacatttcctcaatgtcgctattgagtggaggattaaaacggcaggaaacacatggatatgaaagtgatcaccacaatcttgtccacatgaaccatgaaaccggcactgcacctgatcatgaagatacaacagctgacatgaaggtggagccgtagatgtttcttcttcactttgtactcagctttagctgctgatatagtgcgccgcggtcgagaattttattaacttcgaacagaagagtgaaaacgaaacagaggaggaagcagattttgtctttgaaatattgacagctcccggagaaagagtcgagagtaagaatcaacaatgttgtgtaatgaatagctactgtctgcttcttttgtagctattgtctgcttcttttttgtacatataaatccatgcaagggaagaggaatgttaattcaacacatgtgcacaacatgatcatcacatatgtacttcaacttgatcaatcggaattagctctacttgtcaaaaaaaaaaaa

SEQ ID NO: 640 - protein, 390 aa, Arabidopsis thaliana
MSDKDEFAAKKKDLVNTPVDLYPPENPMLGPSPMMDSFRETLWHDGGFNVHTDADTSFRGNNNIDIPLEMGWNMAQFPADSGFIERAAKFSFFGCGEMMMNQQQSSLGVPDSTGLFLQDTQIPSGSKLDNGPLTDASKLVKERSINNVSEDSQSSGGNGHDDAKCGQTSSKGFSSKKRKRIGKDCEEEEDKKQKDEQSPTSNANKTNSEKQPSDSLKDGYIHMRARRGQATNSHSLAERVRREKISERMKFLQDLVPGCDKVTGKAVMLDEIINYVQSLQCQIEFLSMKLSAVNPVLDFNLESLLAKDALQSSAPTFPHNMSMLYPPVSYLSQTGFMQPNISSMSLLSGGLKRQETHGYESDHHNLVHMNHETGTAPDHEDTTADMKVEP

SEQ ID NO: 641 - DNA, 543 bp, Arabidopsis thaliana
atgagtcatcggcgagattacggcagtgatgcagttcacgtgagaatcacccacgaccctccgcctgagaattgttttccaaattccggcgacagttccgtctgggccactgaggatgattacagccgtgtctgggccataaactctgatggcgcagagtctccgagcaagaagacacgatcttcctcctcctccgagatcgggaaatcgttcttcaagacgaagctttgcttcaaattccgcgccggaacttgtccctactccgcgagctcttgccactttgctcacagcgcggaggagctccgtcttcctccgccgccgccgcccaattggcaggagacggtgacagaggcttcaagaaacagagaaagctttgcggttagtttaggccctcgtggcaatgttgctcagactctcaagtctccgaattggaagacaaggatttgcaataagtggcagactactggctattgtccttttggttctcactgccattttgctcatggaccttcaggtaaagctacggcctttttcatctattag

SEQ ID NO: 642 - protein, 180 aa, Arabidopsis thaliana
MSHRRDYGSDAVHVRITHDPPPENCFPNSGDSSVWATEDDYSRVWAINSDGAESPSKKTRSSSSSEIGKSFFKTKLCFKFRAGTCPYSASSCHFAHSAEELRLPPPPPPNWQETVTEASRNRESFAVSLGPRGNVAQTLKSPNWKTRICNKWQTTGYCPFGSHCHFAHGPSGKATAFFIY

SEQ ID NO: 643 - DNA, 1155 bp, Arabidopsis thaliana
atgagtcatcaccggcgagattccggcggagatgtagttcacgtgattcccacaaacaatcctccgccggataattggtttccgaatctcggcgatagtgctgtttgggcgacggaagatgattacaatagagcttgggctatgaatcccgataacacctccggcgacaacaatggtccaccgaacaagaagactcgaggctctccgtcgtcttcatcagccacgactacttctgctgcgagcaatcgtactaaagcgattgggaaaatgttcttcaagacgaagctttgttgcaagtttcgtgctgggacttgtccgtatataacgaattgtaactttgctcatacggtggaggagcttcgtcgtccaccgccgaattggcaggagattgtggcggctcatgaggaggagagatctggtggtatgggaactcctacagtttctgtggttgagattccacgggaggagtttcagatcccgtctttggtgtcatcgacggctgagagtgggagatcttttaaaggaagacattgtaagaagttttatactgaagaaggatgtccttatggagaaagttgtacgtttctgcatgatgaggcttcgaggaatagagagagtgttgctattagcttaggacctggtggttatggaagtggtggtggtggtggaagtggcggtggttctgttggtggtggtggtagtagtagcaatgtagtagtgcttggtggtggtggtggaagtggaagtggaagtgggattcagattttgaagccttcaaattggaagacaaggatttgcaacaaatgggagattactgggtattgtccatttggtgctaagtgtcattttgctcatggagctgcagagttacatagatttggcggaggactcgtggaagaagaaggcaaagatggagtatcacccaatccggacacaaagcaaacagtacaaaaccccaaaggactatcagacacaacaacacttctatctccaggagtacctcataatgcagatgccagttaccacactggagttgcattgcaacgagcgtctagtgcggttacacaaaagcctggaattagaactcatcagaagtggaaaggaccggcgaaaatcagtcggatatacggtgattggatcgacgatattgaatga

SEQ ID NO: 644 - protein, 384 aa, Arabidopsis thaliana
MSHHRRDSGGDVVHVIPTNNPPPDNWFPNLGDSAVWATEDDYNRAWAMNPDNTSGDNNGPPNKKTRGSPSSSSATTTSAASNRTKAIGKMFFKTKLCCKFRAGTCPYITNCNFAHTVEELRRPPPNWQEIVAAHEEERSGGMGTPTVSVVEIPREEFQIPSLVSSTAESGRSFKGRHCKKFYTEEGCPYGESCTFLHDEASRNRESVAISLGPGGYGSGGGGGSGGGSVGGGGSSSNVVVLGGGGGSGSGSGIQILKPSNWKTRICNKWEITGYCPFGAKCHFAHGAAELHRFGGGLVEEEGKDGVSPNPDTKQTVQNPKGLSDTTTLLSPGVPHNADASYHTGVALQRASSAVTQKPGIRTHQKWKGPAKISRIYGDWIDDIE

SEQ ID NO: 645 - DNA, 978 bp, Arabidopsis thaliana
gaattgtcaccgggaaaaatggaaaacaaaatcgcgccgtttagttacagcggaagctccgccggaaattcatccagtggcggcgtcgtttcgtcgtctctctactctgatcaactctacaagtcgactcgcaacataatgcaacagcgtcaagatatggtgaatcgcgaggcgttgtgttacacgcgtctccatgaggcttcgcttgaagcagaagcgcttcgtctagagaacactgaactccgatcgatgaatcttcgtctcaagaatgagctcaacagtctcatcagatcttcgatccagaaccgatttgatcatcgatctccgcttcggatgcttagcaatctttcgatcggaggtaatgacgccgacgaagtggagaatcagaaccgtacggttaatcgcgatgacgtcaatgataagagtccgacgagtgttatggagaatgaggatctgaatcgctcttcgcttccaaagagcatctctgtgagatctaatggctactctaaggcaagtcagggaggtggtggtgcggctgctcaaagtggaaaacctcgtggaaccgtcactaagcctgggacttgtggtcaagtcagtactacgcagaaggtgtatgtgcgaggaggagggaagaaagaagatcaggaggaagagatagaagtggaggtgtacaatcaagggatgacaaagacagagctgtgcaacaaatggcaagagacagggacatgcccatatggtgaccattgccagttcgctcacggcattaaggaactccgtccagtgatccgccatccccgttacaagactgaggtttgcagaatggttcttgctggtgataactgtccttatggtcaccgttgccacttccgccactcactatctgagcaggagaagctcgttgctgctggtttcaaacccaagtcatccctcaagctgatcacatgacctgaccctggtttcaagtcctccttcaagctg

SEQ ID NO: 646 - protein, 308 aa, Arabidopsis thaliana
MENKIAPFSYSGSSAGNSSSGGVVSSSLYSDQLYKSTRNIMQQRQDMVNREALCYTRLHEASLEAEALRLENTELRSMNLRLKNELNSLIRSSIQNRFDHRSPLRMLSNLSIGGNDADEVENQNRTVNRDDVNDKSPTSVMENEDLNRSSLPKSISVRSNGYSKASQGGGGAAAQSGKPRGTVTKPGTCGQVSTTQKVYVRGGGKKEDQEEEIEVEVYNQGMTKTELCNKWQETGTCPYGDHCQFAHGIKELRPVIRHPRYKTEVCRMVLAGDNCPYGHRCHFRHSLSEQEKLVAAGFKPKSSLKLIT

SEQ ID NO: 647 - DNA, 747 bp, Arabidopsis thaliana
atggatactcgtaagagaggacggcctgaagctggctcattcaactccaatggcggcggatacaagaagtctaagcaagagatggaatcatattcaactggtttaggaagcaaatcgaagccatgcacaaaatttttcagtacttctggctgtcctttcggagagaattgccatttcttgcattatgttcccggaggatacaatgctgtatcgcagatgacaaatatgggaccacccattcctcaagtttccagaaacatgcaaggttctggtaatggaggccgattctcagggaggggagagtctgggcctggccatgtctctaactttggtgactcagccactgccagattcagtgttgatgcctctttagccggtgcaatcattgggaaaggcggagtcagttcaaagcagatatgtcgtcagacgggagtaaaattatcaattcaagatcacgagagagacccaaacttgaagaacattgtgcttgaaggaacacttgagcagataagcgaagcgagtgcaatggtaaaagatttgattgggaggcttaattcagcagctaagaaaccacctggtggtggtcttggtggtggtggtggcatgggttctgaagggaaaccacatccagggagcaacttcaagactaagatatgtgagagattctcaaaaggaaactgtacatttggtgatagatgtcactttgctcatggggaagcagagctacgcaagtcaggaatcgtctag

SEQ ID NO: 648 - protein, 248 aa, Arabidopsis thaliana
MDTRKRGRPEAGSFNSNGGGYKKSKQEMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 649 - DNA, 1365 bp, Arabidopsis thaliana
atgattccacataatcatgaccgcctctcattctctagctttgtccatgaccaagagcacatcacccctaatccttaccctaactctcagcctgcagcctccactaaaacacccaagaaaaagagaaaccttccaggaaatccagatccaaatgcagaagtcatctctctatctccaaaatccctcatggcgacaaatcggttcttttgtgaaatttgtaacaaggggtttcagagagaacagaaccttcagctccacaaaagaggccacaacctgccatggaagctgaagcagaaaacgaacaagaatcaggtgaagaagaaagtttatatatgccctgagaagagttgcgtccatcatgatccagctcgagccctaggagaccttactggaataaagaagcactttagcaggaaacatggagagaagaagtggaaatgcgataagtgttccaagaagtatgctgtgatatccgattggaaagctcataacaagatttgtggtagcagagagtttagatgtgattgtggtactcttttctccaggaaggacagtttcatctcacatagatccttctgtgatgtcttagctgaagaaagttctaaattcttctcagttccttcaccattagccgccaattcgaccatcgccactgtcactgataccaacaatccaattctcattcaatcacaattggatcaatcttccacaggtacggccgatcttaacgtcaacaacaatcacaccaccctatttggacaaaagttcaccaactccaacccaacccaacaacaacccaatgctttggcgttgtcctcaccaccatcacctcgtagtacatctgattcggttcataatctatggaagttacaagaagaggaatgtgcacaccagtggttactcaatgaatatatgaacaataacaaaaacatattccataagggaatattcaagaatcaagaagatgagataaagaagggaaatatctacagcggctcaaacccaaccgatggaaacatagcatccttgttctcgtataatcaagaagcagtgaatatggcttcattttcggcaacaacattgcttcaaaaggtagctcaaacgggaacaccatcaagctccgaaactagcaccaccatgtttgggcaaatgacttcctccatcttcaacaatacgatgctaaactcctattgtttaacggcgaagaataatgaagaagagttgaccagagactttcttggtgtgggaagtagtgaggaccaacaacgtctacatcgtcatcgcttcccatcaagcgtgccattgacggcgaaccatgatattcccaagttggccgcaaccattgtaggcaggaagcaaccatag

SEQ ID NO: 650 - protein, 454 aa, Arabidopsis thaliana
MIPHNHDRLSFSSFVHDQEHITPNPYPNSQPAASTKTPKKKRNLPGNPDPNAEVISLSPKSLMATNRFFCEICNKGFQREQNLQLHKRGHNLPWKLKQKTNKNQVKKKVYICPEKSCVHHDPARALGDLTGIKKHFSRKHGEKKWKCDKCSKKYAVISDWKAHNKICGSREFRCDCGTLFSRKDSFISHRSFCDVLAEESSKFFSVPSPLAANSTIATVTDTNNPILIQSQLDQSSTGTADLNVNNNHTTLFGQKFTNSNPTQQQPNALALSSPPSPRSTSDSVHNLWKLQEEECAHQWLLNEYMNNNKNIFHKGIFKNQEDEIKKGNIYSGSNPTDGNIASLFSYNQEAVNMASFSATTLLQKVAQTGTPSSSETSTTMFGQMTSSIFNNTMLNSYCLTAKNNEEELTRDFLGVGSSEDQQRLHRHRFPSSVPLTANHDIPKLAATIVGRKQP

SEQ ID NO: 651 - DNA, 1296 bp, Arabidopsis thaliana
atggaagcttcaagcacaagaagcgagaagaagaagaagaagaagacgatacagagagaaaacaccgatactcaaaagaaaaaaaagctacccagtgtttggttttcacttaagaaatctctcccctgcaaatctgatgtctccgatgtccacattccgagatccaaaaaagagctagctcccatatccactaagagaacaacaacctcctccggcggcggggtcggcggcaggtccggttgttcaagatccatagccaatcttaaagacgtaatccatggaaaccaacggcatttagagaagccgctttgctctagccctcgttctataggaagcagcgagtttctcaatcccattactcacgatgtaatctttagcaactccacctgcgagctcaagatcaccgccgccggagcaacagaattcgtcgggaatcttagaccagggacgccggtcaattactcttcttcacgccgtagccaaacttcgagaaaggcttcttctttagatagagaaggattagggtttcaccagagcagaagagagaatgatagagaagccgccattaacggagacaattcctctgtttcttgccataaatgcggcgagaaatttagcaaactcgaagctgcagaagctcatcatctaaccaaacacgccgtgactgagctaatggaaggagactcgtcgaggagaatagtggagataatctgcagaacaagctggttaaagacagagaatcaaggagggagaatcgatcggattttgaaagtacacaacatgcaaaaaaccttagcgagattcgaagaatacagagatacagtgaagatcagagcaagcaagttacaaaagaaacatccgagatgtatcgccgacggaaacgagcttctcaggtttcacggcaccactgtggcttgcgctttggggataaacgggtcgacgagtctgtgttcgtcggaaaagtgttgcgtttgtcggattatacgaaatgggttctcggcgaaacgggagatgaataacggaattggggtttttactgcgtcgacgagtgagagggcgtttgagtctattgtgattggagatggtggtggtggtgatcggaaggcgttgattgtgtgtcgagtgattgccgggagggttcatcggccggtggagaatgtagaggagatgggtgggttgttgagtgggtttgattcattggctggtaaagttgggttgtacacaaatgttgaggagctctatttgctcaattctcgagctttgcttccttgttttgtgctaatctgcaaaccttaa

SEQ ID NO: 652 - protein, 431 aa, Arabidopsis thaliana
MEASSTRSEKKKKKKTIQRENTDTQKKKKLPSVWFSLKKSLPCKSDVSDVHIPRSKKELAPISTKRTTTSSGGGVGGRSGCSRSIANLKDVIHGNQRHLEKPLCSSPRSIGSSEFLNPITHDVIFSNSTCELKITAAGATEFVGNLRPGTPVNYSSSRRSQTSRKASSLDREGLGFHQSRRENDREAAINGDNSSVSCHKCGEKFSKLEAAEAHHLTKHAVTELMEGDSSRRIVEIICRTSWLKTENQGGRIDRILKVHNMQKTLARFEEYRDTVKIRASKLQKKHPRCIADGNELLRFHGTTVACALGINGSTSLCSSEKCCVCRIIRNGFSAKREMNNGIGVFTASTSERAFESIVIGDGGGGDRKALIVCRVIAGRVHRPVENVEEMGGLLSGFDSLAGKVGLYTNVEELYLLNSRALLPCFVLICKP

SEQ ID NO: 653 - DNA, 2040 bp, Arabidopsis thaliana
atgcgtggggtttggctttatctcaagaagtctcttagctgctgcaaggcacagaagtcaactgtagcttgtgatccagacaagatccaaattcagaagaaggagaatccatctggatgctcaagaagatcaatgtcgaatctgagagatgtctttgtaactaatggagatgaaggagctatgcagaatgtaagctgctgcagctcacggtctcttgagagctccaggtttgtaaacacagtgaaatttgaggagaatgcaggttattcagacagattcaaaggtttgcttagcggagcatcttcttctgatttacttcccggtcgttgttcagagagatttgatgttgttggctctgacatctgcggtttcggagttcttgcttgtcaaaaatgtcatgagagagtcagagatcttgacgcgtttgaagcacattacctctctaaccactctgtcgttagactcttagcaggagatttctcaagaacaactgtggaactaatctgcaacacaggctattctcacaagctaggcaaaatgaaagggaacaacatttcagcgatctttaaaatccagaacttgcagagagttgttgcagactttgaagattacagagagctcgtgaaaataagagcaaacaagctttcaaagaagcactctcgttgtatggctgatggcaacgagtttcttgggttccacggtacaactctttcttgcactctcggtttcagtaacagctcttcaaacctctgtttctcggatcactgtgaagtttgtcatattctaagacatggtttcagtcctaaaacaagaccagatgggataaaaggagttctcacagcatcaactagctctacagctcttgaatctatcgaaaccgatcaaggaagaaatagaggttcattgatagctgttgtgctatgtagagtgattgcagggagggttcataaacctatgcagacgtttgaaaattctttagggttttctgagtttgattcactagctttgaaagttaaaaatgttgggctttccccaaaattgaaagatggaaaacttgctggacaagtctatgcccagcctctatatttaaagggtgaagaagactgtaacttgttctccctccggaaacctctgtttgtaagatactattctcttctctccccaatcacactttgttctttttttttttttttgatgatagacgccctagtgttgggtgcttgtcatctcgacgctgaaccttgcggattgggtatgggaaaactcatgattgcaattagtagtgataattcgatgtgggttttggagaagaaggcccctgtggagttggtggaaggaggaaagggaattgtaggagcatcccatgggtgggtagctactttgaaagacggagtagtgtgtctccaagatgatctaaacccaagcacatcgaattcagacccgaaacgcatctcattgcctagtctaagagttgagatgttctgcataccttcttctggaggtcacgttactggatcgtgggatctccacaaacacaagttgcagagggtgcgatttcgaaaccttgctaagttgacaaagaaggaatggaagcttttggattcgtgtagcaggagcgaacatttggtggagtcagcagaaaatgaaactttcttggttaagtggtacaggaagaaaagcaaagatttgaagagaatgatgacaacaaaggctgaaatgctaaaaaaaaaaaaaaaaaaaaaaaaaaaaaaaaaagaaggaaatgctgtttacactcgagacattggagatctctgcattttcctctcaaaatctgaatctttctgtgtctctgcaactagtagctacaaatccgttccttccctagtccgtaaccacgtctatgtccaggcttacgacgagtatggattcatggatatcgccaagccttttgacgattcctgggtcattcctgcctcacctgatgcgaacccgaatcctttctatattccacctcaaactatagaatatactttatctacgatgcacccggatctatga

SEQ ID NO: 654 - protein, 679 aa, Arabidopsis thaliana
MRGVWLYLKKSLSCCKAQKSTVACDPDKIQIQKKENPSGCSRRSMSNLRDVFVTNGDEGAMQNVSCCSSRSLESSRFVNTVKFEENAGYSDRFKGLLSGASSSDLLPGRCSERFDVVGSDICGFGVLACQKCHERVRDLDAFEAHYLSNHSVVRLLAGDFSRTTVELICNTGYSHKLGKMKGNNISAIFKIQNLQRVVADFEDYRELVKIRANKLSKKHSRCMADGNEFLGFHGTTLSCTLGFSNSSSNLCFSDHCEVCHILRHGFSPKTRPDGIKGVLTASTSSTALESIETDQGRNRGSLIAVVLCRVIAGRVHKPMQTFENSLGFSEFDSLALKVKNVGLSPKLKDGKLAGQVYAQPLYLKGEEDCNLFSLRKPLFVRYYSLLSPITLCSFFFFLMIDALVLGACHLDAEPCGLGMGKLMIAISSDNSMWVLEKKAPVELVEGGKGIVGASHGWVATLKDGVVCLQDDLNPSTSNSDPKRISLPSLRVEMFCIPSSGGHVTGSWDLHKHKLQRVRFRNLAKLTKKEWKLLDSCSRSEHLVESAENETFLVKWYRKKSKDLKRMMTTKAEMLKKKKKKKKKKKEGNAVYTRDIGDLCIFLSKSESFCVSATSSYKSVPSLVRNHVYVQAYDEYGFMDIAKPFDDSWVIPASPDANPNPFYIPPQTIEYTLSTMHPDL

SEQ ID NO: 655 - DNA, 690 bp, Arabidopsis thaliana
atgagaaacctagtagaagaaaagttcctagagttctatgagagttgggttattcaacttgagctatatcttcatcaacttttaattgctcataacaataacactatgagtgagaccgagcttcgacatttgatctcgaagctaactacacatcacaaagcttattatacagccaaatgggcagccataagagaagatgtcttagcttttttcggatcagtttggttaaacccgttagagaatgcttgctcttggttaaccggatggaaaccgtcgatggtgtttcggatggttgataggctgaggaagtcgagagtggtgcttgtggaggctcaggtgaagaaattggaggagctgagagttaagaccaagttcgatgagcaaaaaattgagagagagatggagcggtatcaggtggctatggctgatcggaaaatggtagagctggcgaggcttggatgtcacgtcggaggagaatcggtgatggtggtggaggcagcggtgagaggattatcgatgggtcttgagaaaatggtgaaggctgcggattgtgtgcggctgaaaacgcttaaaggtatattagacattttaactccaccgcaatgcgttgagtttttggcagcggcggctacgtttcaggttcagttacgtcggtggggaaaccgaagacattatgtcactcactcctga

SEQ ID NO: 656 - protein, 229 aa, Arabidopsis thaliana
MRNLVEEKFLEFYESWVIQLELYLHQLLIAHNNNTMSETELRHLISKLTTHHKAYYTAKWAAIREDVLAFFGSVWLNPLENACSWLTGWKPSMVFRMVDRLRKSRVVLVEAQVKKLEELRVKTKFDEQKIEREMERYQVAMADRKMVELARLGCHVGGESVMVVEAAVRGLSMGLEKMVKAADCVRLKTLKGILDILTPPQCVEFLAAAATFQVQLRRWGNRRHYVTHS

SEQ ID NO: 657 - DNA, 914 bp, Arabidopsis thaliana
caaaatatgagccaagagacagcgatagcaagcttcaagaaattccaacagtcatggatcgagcagctacgaaaccacctgaaccacctccgctccgcccaaaaccatcaccggaactctgctaccggtgatgaggaacggttaagggaggctgtggacagagtgatggaacactttagagaatatcacagggccaagtgggctgcgacggataaagacgtcatcgaagttatggcttctccttgggcttcagctcttgaacggtcgcttcagtgggtcggtggttggcgaccaaccaccttgttccatctggtttacactgagtcgagtattttatttgagtctcgtatcgttgatatacttcgtggctttcgcaccggtgatctcagtgatctctccccttctcagttcaggacggtaagtgagctacaatgtgagaccgtgaaggaagagaatgcgataacggaagagttgtcggagtggcaagacgatgcgagtgaccttgtcatggggacatcgtcagatcccgaccagaggatccgacggctagcagaaatcgtccaccgaactgatgatctgcgactgagaacgatcacacgtgtggtggaggtcttgagtccgctccaacaagcggagtttcttgtcgctgcggctgagcttcgtacaggcgttgctggttgggggactagccacgaccgtcgtcgaagttccgaagtttaaagctaactaaaaccggtctaaaggtaatgagaatcgaggaagaaaaatagtttttggatattaattatatgtttttaccatgtttttggttatccagactgagtttggttttacatggttatgaaaacaaaaaaaactcatatgttatgtctctacggttgcaataaagatcaacccacgtgtggtgcttgtta

SEQ ID NO: 658 - protein, 237 aa, Arabidopsis thaliana
MSQETAIASFKKFQQSWIEQLRNHLNHLRSAQNHHRNSATGDEERLREAVDRVMEHFREYHRAKWAATDKDVIEVMASPWASALERSLQWVGGWRPTTLFHLVYTESSILFESRIVDILRGFRTGDLSDLSPSQFRTVSELQCETVKEENAITEELSEWQDDASDLVMGTSSDPDQRIRRLAEIVHRTDDLRLRTITRVVEVLSPLQQAEFLVAAAELRTGVAGWGTSHDRRRSSEV

SEQ ID NO: 659 - DNA, 558 bp, Arabidopsis thaliana
atgtattgcagcgatcctccccatcccttgcacttagtggcatcagacaaacaacaaaaagaccacaaactgatcctttcctggaagaaaccaacaatggactcagacccactcggtgttttcccaaattctcccaagtatcatccatattactcgcagaccacggagtttggtggcgtaatcgatttaggtctcagcctgagaaccatacaacatgagatttaccactcatctggccaaagatattgtagtaatgaaggatacagacggaagtggggttatgtaaaggtcaccatggatggtttggtggtaggtcgcaaggtctgtgttcttgatcatggaagctattcaactcttgctcatcaactcgaggacatgtttgggatgcagagtgtgtcgggattgaggttgttccagatggagtctgagttctgtttggtctacagagacgaagaaggtctgtggagaaatgctggggatgttccatggaatgagttcatagaaagcgtggagcggctgagaatcacaagaagaaacgatgctgtacttcccttttaa

SEQ ID NO: 660 - protein, 185 aa, Arabidopsis thaliana
MYCSDPPHPLHLVASDKQQKDHKLILSWKKPTMDSDPLGVFPNSPKYHPYYSQTTEFGGVIDLGLSLRTIQHEIYHSSGQRYCSNEGYRRKWGYVKVTMDGLVVGRKVCVLDHGSYSTLAHQLEDMFGMQSVSGLRLFQMESEFCLVYRDEEGLWRNAGDVPWNEFIESVERLRITRRNDAVLPF

SEQ ID NO: 661 - DNA, 1621 bp, Arabidopsis thaliana
aagtttctctcacgttctcttttttaattttaatttctcgccggaaacaatctcatctcccggcgaacgaaacttccggtgtggtactgcaaacggagaaaaaaataaccaaagaagagagaaactcaaaagctactaagatggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtgaaactagaagtgggagtatgcgcgagtgctagccagggagggagttgtgcatagaagtatcggttcggcctttggagaaaagtcgaagatagcaaagtagagaagagatcatgaacaaagctaaatttggtggtggtggtgaaaagggtttttgtaaagttggaacctttttttggtagggaagaaagtagcaaggttgtgtaatggtccgaactccaatgctattgtatgttcttacatccaaaaaaaagaaaagcagaagagaagtgatgtacaatgagaagcttattttattgtaactcaagaataattcaggtaattagtttaaaaaaaaaaaaaaaa

SEQ ID NO: 662 - protein, 379 aa, Arabidopsis thaliana
MESEFQQHHFLLHDHQHQRPRNSGLIRYQSAPSSYFSSFGESIEEFLDRPTSPETERILSGFLQTTDTSDNVDSFLHHTFNSDGTEKKPPEVKTEDEDAEIPVTATATAMEVVVSGDGEISVNPEVSIGYVASVSRNKRPREKDDRTPVNNLARHNSSPAGLFSSIDVETAYAAVMKSMGGFGGSNVMSTSNTEASSLTPRSKLLPPTSRAMSPISEVDVKPGFSSRLPPRTLSGGFNRSFGNEGSASSKLTALARTQSGGLDQYKTKDEDSASRRPPLAHHMSLPKSLSDIEQLLSDSIPCKIRAKRGCATHPRSIAERVRRTKISERMRKLQDLVPNMDTQTNTADMLDLAVQYIKDLQEQVKALEESRARCRCSSA

SEQ ID NO: 663 - DNA, 684 bp, Arabidopsis thaliana
atggcgatcgaggatcaagagaacacaatccgtgaaatcaaacctaagaacagaagaatcatgggagctggtggtccggaggaagaggagaaccggtggccgccatggttgaaacctttgcttaaagagcaattctttgttcattgcaagtttcatggagactctcataagagtgaatgcaatatgtattgcttagactgcaccaatggcccactttgctctctttgtcttgctcatcacaaggatcatcgcaccattcagataaggagatcttcttatcatgatgttataagggtgaatgagatacaaaagtatcttgatataggtgggatccaaacctatgtgatcaatagtgctaaagtcgtcttcctgaatgagaggcctcagcctaggcctgggaaaggagtgaccaatacctgcaaggtttgctatcgtagcctcgttgatgatagcttccgcttctgctctcttggctgcaagattgctggaacatcaagaggctttgaaaagggaagggagaacctgctaatggaaacagaggattcaagtagcagcattgcaattgggaagaacattacaaatctccagagtttcagcccatcaacacctccacttactacatctagtaactgcagaatcgtcaagcgaagaaagggaattcctcaccgatctccaatgggataa

SEQ ID NO: 664 - protein, 227 aa, Arabidopsis thaliana
MAIEDQENTIREIKPKNRRIMGAGGPEEEENRWPPWLKPLLKEQFFVHCKFHGDSHKSECNMYCLDCTNGPLCSLCLAHHKDHRTIQIRRSSYHDVIRVNEIQKYLDIGGIQTYVINSAKVVFLNERPQPRPGKGVTNTCKVCYRSLVDDSFRFCSLGCKIAGTSRGFEKGRENLLMETEDSSSSIAIGKNITNLQSFSPSTPPLTTSSNCRIVKRRKGIPHRSPMG

SEQ ID NO: 665 - DNA, 738 bp, Arabidopsis thaliana
atggaatctggagaatttcctgcatggcttgaggttctgttaaaagacaagtttttcaacgcttgtttggatcatgaagatgataagaagaacgagaagaacatattatgtatcgattgttgtcttaccatctgtcctcactgtctctcttctcatacctctcatcgtcttcttcagataagaagatacgtgtatagagacgttttgagggttgaagatggttctaagctaatggattgctctttaattcagccatacacaacgaacagttcaaaagttgtgttcatcaatgaacggcctcagtctcgacaatttcgtggttccggtaacatttgtatcacctgtgaccggagtctccagtctccttacctcttctgctgtctctcctgcaagattagtgacgtcataatgagacaaagaggactctcagggtttctccgcgtctgcaacgttcttgatttaaccgacgaagtcacgacaacgacaccgagttccactctcgagcccaccgggtcgaaccgaacatcttccgagtcaagtggtaacgaaggagaagacatgttctggtgtcaggcgctcgcttgcaccgccactactgaaatcgttaggaagaaaagaagcagcttgtcgacgacttgcaggagagtcacggaggtggtttcaacgactaacacggaagctccggtgaactttttaaaccgtcggaagaatccgccgcaacgcgccccgctttattaa

SEQ ID NO: 666 - protein, 245 aa, Arabidopsis thaliana
MESGEFPAWLEVLLKDKFFNACLDHEDDKKNEKNILCIDCCLTICPHCLSSHTSHRLLQIRRYVYRDVLRVEDGSKLMDCSLIQPYTTNSSKVVFINERPQSRQFRGSGNICITCDRSLQSPYLFCCLSCKISDVIMRQRGLSGFLRVCNVLDLTDEVTTTTPSSTLEPTGSNRTSSESSGNEGEDMFWCQALACTATTEIVRKKRSSLSTTCRRVTEVVSTTNTEAPVNFLNRRKNPPQRAPLY

SEQ ID NO: 667 - DNA, 738 bp, Arabidopsis thaliana
atgggaccgatgatgatgagagcagaagaagataactacaatctaaatcctccaccatggctaatcccaatgctaagagcaaactacttcatcccttgttcaatccacgccgcttccaacaaaagcgagtgcaacatgttctgtcttgactgttcttctgaggccttttgctcttactgtttgctcaatcacagaaaccatcgtgtcctccagatacggagatcatcgtaccacaacgttgtgagagtaaacgagattcagaagtacatagacatatcttgtgttcagacatatataatcaacagcgcaaggatcgttttcttgaacgaacgtcctcagccaagaatcggcaaaggagtcaccaatacttgtgaaatctgttgcagaagccttctcgattctttccgtttctgctctctcggttgcaaacttggaggaatgaagcgtgatccaagtctaaccttctctttgagagggaagcatggaagagagtacgaaggtgagtgggaatctgatgaagcgactacaccaactaagatacgcaagacatgtgctttcaaccgtctgatgagtggtctttccatctccaccgttaaatgtgattacttgtcaggagatcaaccgtcttcgagctccggtgatgagagcggttttaaactttctccggggacaccgccgatatataatcaccggaattcaagtagacggaagggcgtcccacaccgtgctcctttctaa

SEQ ID NO: 668 - protein, 245 aa, Arabidopsis thaliana
MGPMMMRAEEDNYNLNPPPWLIPMLRANYFIPCSIHAASNKSECNMFCLDCSSEAFCSYCLLNHRNHRVLQIRRSSYHNVVRVNEIQKYIDISCVQTYIINSARIVFLNERPQPRIGKGVTNTCEICCRSLLDSFRFCSLGCKLGGMKRDPSLTFSLRGKHGREYEGEWESDEATTPTKIRKTCAFNRLMSGLSISTVKCDYLSGDQPSSSSGDESGFKLSPGTPPIYNHRNSSRRKGVPHRAPF

SEQ ID NO: 669 - DNA, 684 bp, Arabidopsis thaliana
caacaacaaaacctcttactcactccaatggctcgccttctctttcgtcttctcgtagaatccaacactccgtctccggcgattgataactccaccgccgcgttgaattctgatctcgtcgtcatcctcgctgctctcctctgcgccttgatttgcgttctcggcttaatcgccgtttctcgatgtgtctggctccgtcgtctcgcagccggaaacagaacagtctccggatctcaaactcaatctcctcaacctccggtggcagcggcgaacaaaggcctgaagaagaaagtccttcaatctctcccgaagcttacgttctcgccagagtcacctgagtcggagaaattcgcagagtgcgcgatctgtctagctgaattctctgccggcgacgagctccgagttttaccgcagtgtggtcacgggttccacgtggcttgcattgacacgtggctaggatctcactcgtcttgcccttcttgccgtcagatcttggttgttgccaggtgtcacaagtgtggaggtttacccggtagctctagctccggacttgaatccgaacccgaaatcgagatccgaatcaagcaaggcgaagatgaccccaactccttcttgccataatcattttagtttcccatttatttattagaaaactctataatttaatgcagatcattttagtgg

SEQ ID NO: 670 - protein, 197 aa, Arabidopsis thaliana
MARLLFRLLVESNTPSPAIDNSTAALNSDLVVILAALLCALICVLGLIAVSRCVWLRRLAAGNRTVSGSQTQSPQPPVAAANKGLKKKVLQSLPKLTFSPESPESEKFAECAICLAEFSAGDELRVLPQCGHGFHVACIDTWLGSHSSCPSCRQILVVARCHKCGGLPGSSSSGLESEPEIEIRIKQGEDDPNSFLP

SEQ ID NO: 671 - DNA, 475 bp, Glycine max
gacgaaccaaagttaactactttagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtctgtgctagagtcgatgctcttcaggcaacccttcaccaccactacgtgcccccgcggcaacttctctctggcggtggtggtgggtcc

SEQ ID NO: 672 - DNA, 1471 bp, Glycine max
ccacgcgtccgaatacaacagcaacatgatggtttcagtttcttgagggtactaatatgaacagaatctcctctcaacacctttgccttgctgcagttcgcaactgcaactgcactcaaatataaatatatatacatatatatatatatatatatatatgtattacttcatggtcacacatagttaagtttattaattactaggtagctggttttgaatagggtagttggtagttatagttgttgtcccagatatggaagaagcaggtttaggagattgttgttcctcgaattcgacgattacgaggaagagcgataagcgaaagcagcaacaccaacaacaagagaagccatacagaggaataaggatgaggaagtggggcaagtgggtggcggagattagagaacccaataagcgttcgaggatctggctgggttcttacgccacccccgtcgccgccgcacgcgcctatgacaccgccgtcttccacctccgaggcccttccgctcgcctcaacttccccgaattgctgtcccaggacgacgacgtttcgacccaacaacagggcaacatgtccgccgattcaattcgcaaaaaagccacccaagtcggcgccagagtcgacgcgctccaaaccgcgcttcagcaatcctcgtcctcacactccgctaattccagccacgtcagcagctctgacaaaccagacttgaacgagtatcccaaacctgaagattagtaatttccttcaaccttcaagattaatattgatccaccaatcatgggttctgatgtgacttatatatagggcttcaacttgccctcttcacctatgctaatttgaaaagaaaaaaattttatatttgtcatatgatttatctgagtaaatatttttttccagtttatttaattaatattagaaagtgtaggaagaaatagacacacctgatgagaattgagatgaggctaattaacttgttaatgaggtgagtaactcctttaactatatataaattaaggggtatatatattattagttgctcacctcatgttgttgctcatctcacgaagaaactcattttagattacttttttcctttcattatgtgtatgctggagcggtggactggtagctacatagattctcgctatgatggggcatatgatcatgaggtcttttctcaggtcggttgtgtgttgtaatttgtaacgagatatccgtaacacaataggatcaaattaaccgtgttttgttgtttcagattatcttttctacgttcccgttcattgctccaatctgatatcctacataatctccactactttatatataaggccggccgttttttaagacccaagttaccttcccttgccttcaaagcaaatacttttctattgtgtcccctaaaatcaatttcattggccgtctttttccaaacctctgcttggaaaaaccttggctttccccaactta

SEQ ID NO: 673 - DNA, 1419 bp, Glycine max
  misc_feature (832)..(832): n is a, c, g, or t
  misc_feature (868)..(868): n is a, c, g, or t
  misc_feature (870)..(870): n is a, c, g, or t
cccacgcgtccgtaccaatatgaacagaatctcctctcgacacctttgctttgctgcagctcgcaactgcaacttcccacaaatataaatatatattacttcatggtcacacatagttaattttattaattactactaggtagctggtttttaataggtagtaggtaggtgtaatcgttgtcttcctgcagatatggaagaagcgggtttaggagattgttgttcctctaatacgactattacgaggaaaagcgagaagcgaaagcagcagcaccaacaacaagagaagccatacagaggaataaggatgaggaagtggggcaagtgggtggcggagattagagaacccaacaagaggtcgaggatctggttgggttcttacgccacccccgtcgccgccgcacgcgcctacgacaccgccgtcttccacctccgaggcccttccgctcgccttaacttccccgaattgctgtcccaggacgacgacgtttcgacccaacaacagggcaagatgtccgccgattcaattcgcaaaaaagcgacccaagtcggcgccagagtcgacgcgctccaaaccgcgcttcagcaatcctcgtcgacacactccattagttccagccacgtcagctatgagaaaccagacttgaacgagtatcccaaacctgaagatttagtaatttccttcaaaccttcaagattaatattgatccaccaatcatgggttctgatgtgacttatatatagggcttcaacttgccctcttcaccctaggctaattggaagaagaagaaaaaaccctttttatatttgtcatatgattatatatatatcntagtagatatttttcttccagtctatttattttaanantagaacgtgtaggaagaaatatacagacacacctgagaattgagatgaggctaattaacttgtttatgaggcgagtaactcctttaaatatatataaattaaggggtatatatactattacttgctcatcaccacatgaagaacaacgtttgacctttaaccaaatgagatcgtgtaattcatgctgttgacctgattttgctgttgttgctcatctcacgaagaaactcattatagtttttttttttctttcaatatgtgtatgttagctggagtcgtggactggtagctacgtaggttctcgctatgatggggggcatatcatgtggtcttttctcaggtcggtggtgtgttgtaatttgtaacgagatatccgttacacaatcggatcaaattaaccgtgttttgttgttttagattaataaaaatacatatgttctgatgaattcgataatttcacatacatgtggtgaaaatgatttcatatataagttgtatgcatagttcatgtgtgtgaactatattaattcgaccgatcctgtttatgtt

SEQ ID NO: 674 - DNA, 973 bp, Glycine max
gcttagtgcgcgagtcgcatgaccctctctcccttataacccttccgtgtcttttacgagttagatttctcattcgtcattgaacagattcactctctctctctttagagatttgattgacaaacacaactaattccaaagctaacaactttatagagagagagagagagagagagagagatggagggtgaaggaagaagaagagaaggaggagagagagaaacagcaacagcagcagcaacgaggaaggtggtggagggtgctgatcagagaagatacaaaggaataaggatgaggaagtggggcaagtgggtcgctgaaattagagaacccaataagcgttcaaggatttggctcggttcctattctacccctgtcgcagccgcacgtgcctacgacaccgccgtcttttaccttcgaggaccctccgcgcgtcttaacttcccggagcttctcatcggagaaggcgccgccgccctcaccggcggctgtgacatgtcagcagcttctattaggaagaaggcctccgaggtcggtgctagagtcgatgctcttcaggcaacccttcaccaccatcaccaccatgttgtgccaccacggcagcttctctctgccagctgtggcggtgggtccggtgattttgcagtgcgggttgttgacctgaataagatgcccgaacccgagagctccgactgtgagtggaacgtgaattgaaggaaaaagaaaaaaggtgcatgttttcatattcaggtgatggtggttgttaacgtgcgccggctgaggcaaaatgatgttgttgatgaggcctgtggtggtggtggtggtggtgcggagtactgtactgtatctttttttccttcaaccttctctcttgggtagtttttttttaaaatttttagatattacaaaagaatttttggcttgtaaaaatatgttaaatgtaaattaactagtccggtagcagtttcttttt

SEQ ID NO: 675 - DNA, 1021 bp, Glycine max
cccacgcgtccgtacggctgcgagaagacgacagaaggggataccaaggtggaggcttacccagatgacaagcttagtgcgcgagtctctctcccttataacccttcttccacttccgtgtcttttacgagttagatttctcattcgtcatggaacaacacattcactctctctctctttagtgattttttcgatttgattgacaaacacaacgaaccaaagttaactactttagagagagagagagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtcggtgctagagtcgatgctcttcaggcaacccttcaccaccactacgtgcccccgcggcaacttctctctggcggtgatggtgggtccggggatttcccggtgcgggttgttgacctgaataagatgcctgaacccgagagttcggactgtgagtgggatgtgaattgaaggaaaaaaaagtacatgttttcttattcggttgctaagcgcgggttgaggcaaagtgatgttgttgatgaggcctatggtggtgtggagtactgtactgtatcttattccttcaattttctctcttgggtcttggctagttttttttttttagatattacaaaagaaattttggcgttgtaaaaatatattaaatgtaaattaactagtccagtagccaaaaaaaaaaaaacccccaaaaac

SEQ ID NO: 676 - DNA, 1285 bp, Glycine max
ccttttttttttttttttttcagaaccaaactgttattaaattacttatactttaacctacatcttttaaataaaataagaaataatatctacagcggatcacaaaacaaatataaaacacaacctttgggggagatgtttgtaatagttaattgtggaacaacgatcgaggtttgaggagctacaattttggtttcacattgaagacacatctctttctttcttacattttcggttgcttttctttcatattttctggttttctattttccaatttgttggatacaatgtcgtttgagatttgactccaactagacaaaaatctgagacgcagaaccgattaaccgaccccatgcatcacccatcgttatcatcgaaacagagtagtgaccacaacagcgtcttccctccccaatggtcccttctcttcacatatacaactcataaaaacacctaacatccatctttttttactcttcagtagaatagtagctattataatattataattacttgagtggttaacatggctcactccctctttttcaacccaactccctggcatcataggccattgctgtgccctctaaccccttttccccaataaaaaaaaaattaattaaaacaaggttataattttatatttgtttttgaaaaactccaaattaacaactaaacaacactcctaatccctgtcccagtagtcacaatccgaattctcgggttcgggcatcttattaaggtcaacccggtcggcgaattctccagcaggcagcgcgtgggggtgctggcggtggagagcgtcgactctggcgccgacctcggtggccttcttcctgatggaggctgcggacatgtcggcggcggggccctccgcggcaacaagctcggggaagttgaggcgcgcagaggggccccggaggtggaaaacggcggtgtcgtaagcacgcgccgccgcgacgggcgtggagtaagaaccgagccaaatccttgaacgcttgttgggttctcgaatctcagcgacccacttgccccactttctcattctgattcctttgtagcgcgtcgtctcagtttcaccctctttccctctcttctttgttgcaattcctccttcttctccttccataactactctctccctctctctctctctgaaaattcccttaatttttcatgaagagtataaataaatgaaataaaagaatgaagtgcgaggaagggaagggttataggggttttgcagtgcagagagacactgagccgaggttgtcgcgcgcgctgg

SEQ ID NO: 677 - DNA, 400 bp, Glycine max
  misc_feature (319)..(319): n is a, c, g, or t
gttttgaatagggtagttggtagttatagttgttgtcccagatatggaagaagcggggttaggagattgttgttcctcgaattcgacgattacgaggaagagcgataagcgaaagcagcaacaccaacaacaagagaagccatacagaggaataaggatgaggaagtggggcaagtgggtggcggagattagagaacccaataagcgttcgaggatctggctgggttcttacgccacccccgtcgccgccgcacgcgcctatgacaccgccgtctttcacctccgaggcccttacgctcgccttattccaattgtgcanacacactttgaccacacagcacattcgcgttcatcgaaaagcaccagtcggccgatcaccctcaacgccttacatctgtct

SEQ ID NO: 678 - DNA, 1090 bp, Oryza sativa
  misc_feature (37)..(37): n is a, c, g, or t
ttttttttttttttttttttttttttgattcgagagnttcttgaacctgctttttttgtcttgcttgctgggttttttccctttacaaaccaacgcttaagcgaaaagggtgaggtacatagccgtcttgcttttagctacatgctcacgctgacacgcacgctcctagtacagtcgccgtcgccggaacagacgacgagctgagctctagattcctacttgctaaccaccacttccccggcttgacggcgacgtcgcgggctccattattggatatacttgtgggctcctccgacctcaatcgcatttcgccgaacaccttgcgtgcgcccccgtccacgaccgcctccttggcgctatccgcttcgctgactagctatagctactagctgctactctctctctgtgtcttggggtggctaaggactacgaactagatggatggaagaagggaggcaaaatcagctcggattactactcgtcgtcggaggtgtccggggtgggctcccggttgaggtcggggttcttggtccggcggcgctggggcggcgggggctgcggcggctggagcggcacgggcgccgcggcgccgacgacggagtgctgcgcgtcgacgcgggcgccgacctcggcggccttcttgcggatggcggcggcggtgagctccctgtggtcctcggcaccaccgccgctgccgccaccaccacccgcgccgtcgagctggtcggggaagttgaggcgcgcggagcggccgcggaggtagaacacggcggtgtcgtaggcccgcgcggcggcgacggcggtggagtaggagccgagccagatccgcgaccgcttgttcggctcgcggatctccgccacccacttcccccacttccgcatccgcaccccgcgatactgcctccctcctcccccacccctcccgcctaccggagccctcaccgccgccgccgcaggctgctgctgcggctgcgtcggctgcggtggcggcggcgggggcaagaagacggtggcctccctcctatccatcctcgcggaattccgcagcggcgcgagggcgaggcgaggcgaggcgacacctgcgtgtctt

SEQ ID NO: 679 - DNA, 1231 bp, Oryza sativa
ggcacgagggggggaagcacggattaatctaatcgctgcttatctagtccataataacacggagaagagagagaggaaacaaaaacagagaggatgacttgttttatcactgttacagctgtcttttttgacatttggaaagaccgccacttgtggcgtcctcctcctcccccgtctccaccgccctcctcccgacgctgcccttcccttgttcttatccaaaaccgcatcgaaaaatctcgccacgaagccgccgccgccgccgccgaggtggagatgaggggtggacgaataggtggtaggtggatggatgcagcgagcgtacgtggtggaggtgatcgtacgctggctgcatgttgacgaagccgttgatcgatcttgccgcgcggaggcggttttgttggcttctactcggcgtcggagttctccgggcttggcgcctggttgagatccgggttcttggcgcggccgctccacgccgtccgctggtgcttctgctcgtggtggtggtgttgctcctcgccgtgcggctgcaggtgcgggtggtggtggtggtggtggtggtggtgcttctgccgctcgcggtggtgggtcgtcggcgcgaccatcatgccggtctggagcgcgtcgacgcgggagccgacctcgatggccttcttccggatcgaggccgcggacagcgtgccgccgtcgggctcgcggggctcgctcgcgccgccgccctcggacagcgacgccagcgaggagatctcctcggggaagttgagccgcgccgaccgcccgcggaggtagaacaccgccgtgtcgtaggcgcgcgccgccgccacgggcgtcgcgtacgaccccagccagatgcgcgtccgcttgtgcggctcccggatctccgccacccacttgccccacttccgcatccgcacgccacggtactgccgcctcggctgctgctgctgcagcggcagcaccgccgccgccgccgcctgctcctccttggcagcaaccgccgccgcagccgcggcgagaggagccatagccgcagccgccgccgccgcagcagcagcagcagaagcagccgagtcctcgctggaggagcggtggtactcgccctgcatgagcgaagcgcgccgccgccgcagccgccctcttctctctctctctctctctctctctctgccctctcctgtgcaagcagcagtagcttttggcgttggttgggcggcttcttcttctcttc

SEQ ID NO: 680 - DNA, 457 bp, Oryza sativa
  misc_feature (3)..(4): n is a, c, g, or t
  misc_feature (7)..(8): n is a, c, g, or t
  misc_feature (11)..(11): n is a, c, g, or t
  misc_feature (16)..(17): n is a, c, g, or t
  misc_feature (19)..(19): n is a, c, g, or t
  misc_feature (21)..(22): n is a, c, g, or t
  misc_feature (38)..(38): n is a, c, g, or t
  misc_feature (45)..(45): n is a, c, g, or t
  misc_feature (47)..(48): n is a, c, g, or t
  misc_feature (50)..(50): n is a, c, g, or t
  misc_feature (62)..(62): n is a, c, g, or t
  misc_feature (67)..(67): n is a, c, g, or t
tannatnnttngttanncnannaaaatctccttcgtgnaagtttnanncnccgtctgaccgntcctnggaggtagaacaccgccgtgtcgtaggcgcgcgccgccgccacgggcgtcgcgtacgaccccagccagatgcgcgtccgcttgtgcggctcccggatctccgccacccacttgccccacttccgcatccgcacgccacggtactgccgcctcggctgctgctgctgcagaagcagccgagtcctcgctggaggagcggtggtactcgccctgcatgagcgaagcgcagccgccgccgcagccgccctcttctctctctctctctctctctctctctgccctctcctgtgcaagcagcagtagcttttggcgttggttgggcggcttcttcttctcttctcttttctttctcgctatgtttgatgggtggtatttgtattgggcctcgtgc

SEQ ID NO: 681 - protein, 233 aa, Oryza sativa
MQGEYHRSSSEDSAASAAAAAAAAAAAMAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 682 - protein, 184 aa, Oryza sativa
MDRREATVFLPPPPPPQPTQPQQQPAAAAVRAPVGGRGGGGGRQYRGVRMRKWGKWVAEIREPNKRSRIWLGSYSTAVAAARAYDTAVFYLRGRSARLNFPDQLDGAGGGGAGAGGAEDHRELTAAVIRKKAAEVGARVDAQHSVVGAAAPVPLQPPQPPPPQRRRTKNPDLNREPTPDTSDDE

SEQ ID NO: 683 - protein, 206 aa, Oryza sativa
MAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 684 - DNA, 1149 bp, Zea mays
ggcggtgaagatggaggcggagcaagcggcgatggcggcgccgcagctgggggcggcgcaccagcagacgcagccgcggcggcagtaccgcggcgtgcgcatgcgcaagtggggcaagtgggtggcggagatccgggagccgcacaagcgcacgcgcccccgcctccggtcctacgccacggccgtggcggcggcgcgcgcctacgacacggccgtgttctacctgcccggcccgtcggcgcggctcaacttccccgaggagatcccctcgttcgggctggcggatggcgtggacgtgggggagcacgcgcgcgacccggccgccgccgccgccggcggcggcggcggctgcacgctgtccgcggcgtccatacggaagaaggccatcgaggtggggtcccgcgtggacgcgctccagaccggcatggtggtcccgccgccgcaccaccgcgagcgccataggcaccacaaccacctgccgcagctgcgggtgcacgcggaggagcagcaggaggaagaggagcagaagccgcagcggcctgcgtggagcgggcgcgtcaagaacccggatctgaaccgtgcgccgagccccgagagctccgacgccgagtgacaagcgagcgagagcgcagcagcagccaccgcaaggcgaggttcaacgacgacgtccgttatcggttattcccaatcccacgacgcagcatgccgttgtcgtctccgtccgaccgtccccacgtacgtacgtacgtacgtacacgacgatccagctgaccctgccgcctgcctatcctatccgtcctcgacgacgaccggatggtcggcgggcgggagggagggcggtgcggcgagggttttgggtacgttgtggataagcacgagggcagcagcagcaggggcggcgtgcgcgggcaggcaggcgaagacggagggaggcggccacaagcggcggtctttccaaacgtcaaaaaggacagctgtaacagcgataagaaaaaacaagtcatcatcaccctcgtctcactactagttctactactgttcccgagagtagtagtaacgattagcactccactagcagtatgattattcgaatcggccttgcttgacagcgattaaaaaaaaaaaaaaaaaaaaaaaaaaaaaaaaaag

SEQ ID NO: 685 - DNA, 635 bp, Glycine max
gcacgagccacattggcatgcctagaagaagaggctgaggatgatgatgaagcagcagaggaataagtggcagcattagtggcaccaccagcagtcatagggtactcatcaggaaagttaaggattgcaaatggacctctcatggcataagcagctctatcataggctctggccgcttcctccgcagtgttgaaagtccccagccacaccctctgaccctgcctcgtggagtctcgaatctccgccgcgaacttcccccacggccgcctccgaaccccccggtaccggacatctccggcatcctccttagccctccccctcgacccttcttcatccatggttgcacttttggtaaggtactaatttttgtgttttttgcatgcatggtaaggtatgacaaggttggagtatatatatatggttgaaaaggcacaatctgattaggccacgcaagcattgttgccacgtgacgattagaagtttctgctattgaaaccaatgaccaatattgaaaagttcttgtgtccattgtatctggatggtcaaggtggtgggctttgcaaggtatagagattcttgtgccgcgctagcactcgctctttgaaacgccttctgcacatcgttgtttgggaatc

SEQ ID NO: 686 - DNA, 520 bp, Glycine max
ggtgaagtaccgtggagtgagaaagaggccatggggtaagttcggagcagagatcagagacccaacaaaacctacgggaaggcaatggttagggacatttgacactgctgaagaagctgctagagcttatgatcgtgcagccattgctttgaggggtgctcttgcaatccttaattttcctcatgagttccattctcatctcccttttatattatcaaattcttccactaagggaaatggaagttcttttgataaggaagttattgagttagagtatttggatgacaaggtgttggaagagcttcttgagttagaagagaagagaaggagtaacgaagactaagatcactggagtactattcattgttttgagatccccggccccttttattttctctagctctccacttgtattaatatctgaacttatgatttagggttcagattgatttccaaaaatcttccccacccattgattgaattaaattgtgtatgcttcaaaaatcttacaattaatgca

SEQ ID NO: 687 - DNA, 517 bp, Glycine max
aagaaaatggagggtggaagatcatcagtttcaaatgggatatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtg

SEQ ID NO: 688 - DNA, 527 bp, Glycine max
gtcactaagcaactttactgtatttaattgtacacaggcactacataccaatttaggattaaaaagttgaaccttatcttcctaataatccaagttttcattgatggttttccccatcgcaatcaaggagttcctctaacaatttgtcatccaagcactcaaataccacaacttgtttaccaatctcagtgttagatgatgaggacttcttgctaagagaagtcacattgcaaggagggtgttcatctgggaagttgagaatggccgtagcacctctcatctcaaaggcagcacgatcataagctcttgcggcctcctcagcagtgttaaatgtcccgagccacacacgagcaccatgtctagctgaatctctaatttctgcagcaaattttccccatggtctcctacgtactcctctatacttaatttgcgttggttccccttcattgaccttttcctttaaatcctccatttctgtcacacttatgaatcccttctgtcgtcttctcgccgtacggacgcgtggg

SEQ ID NO: 689 - DNA, 596 bp, Glycine max
  misc_feature (583)..(583): n is a, c, g, or t
cgggattaaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaaatttgaatgttagattgatttcaaagcatacctatagtagggtgaatgtcttcatatatgatatgatttccttttaggcagcactttactttggtgagtatggtttataacttaagaatgactttgttgaaccatnttagtttgatcgt

SEQ ID NO: 690 - protein, 136 aa, Oryza sativa
MDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 691 - DNA, 806 bp, Zea mays
tgggacctcgagcggcggggccggtgcacaggaaatctctatccacagacacacaagcagccagtgcagtagtagcccggtatatagagagtgtagcacgattatacaatatatcacagagctagctagttagtatatacgtactatatatatagtctattgctcgctagcttgctgaatcaagctgaactatatagtaagagactaattaaagagctattagccacagcgcgtgatccacgattaatggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcaccatgaagggcgccacggccgtgctcaacttccccaccagcggaggatcagctgccgcggctcccggcggccggaccagcggcggcggctcctcctcgtccaccacgtcgtcggctccggccagcagggggagggcccgtgttcccgactcggagaaggtggagctggagtgcctcgacgacagggtcttggaggagctgctcgcggaggacaagtacaacaagaactaatgaaacgctagctgatgcacaacatacatatgttggtagtagccttattagccgccgcaacgcgctgctagctagagctagctcttcgctgccgcttccagtaaattatatttaagggagacagaactatattaactttaatatactatactcactacccaatt

SEQ ID NO: 692 - DNA, 1274 bp, Glycine max
cgtagtaagcgcataccggctccagccacctactgcttcaaaaaattcttaaggatggccacagcagaagaaatttcaactttgaaactgttgcgccaatatctcttgggggatatttcagacccttttctcaccaatctcattccagtaaaacttgaagacccctcatcaggacttgatatgggttcaaacttctcagaacaaagcagcttctgcaagtttctggagtgctttgattttgaagcagaagtggtaggtctcacttctcatcataaggtccaaagctccattgcaacaagtccaccccagaatttcaattttccagaagaaccaatggtgtcaatgaaaaaggaagcaacatgttatgcaacaaggcattacagaggagtgaggagaaggccatgggggaagtttgcggcagagattcgcgaccccaaaaagaaagggagcagggtgtggcttggcacatttgacactgagattgatgctgctaaggcttatgattgtgctgccttcagaatgaggggtcataaagccgtgttgaatttccctctagaggctggaatgtctcatccagagcccaacagcagtggcaggaaaaggagaagagagtacacaacagctgccacaagttcaaggcatgttatgtcatgagaaataattcagtgtgggagaaccatgtttttcttttggcattttttgccagttacacaagttaaagcaaggttttatagttacactacagttgagcatgatgagatctgttatttaaatccttgagttatggttaagggtgaaattgaattaaacccaagaatgaaacagctcataaagaaacctacttctacttttttatacaaggctctcaaagtagaatgtgtgatagtcaccactcaccttagttcattagataatgaggaaaattcttattgcatcttaactttatctttattcgcgccgttactaaccatatcgatagtggcttgttttcatcatttactgtaatagtcagcttttttcacaaggataaggtattatgggatgttcagtggagtatttaagtggcttggctttcccttcttaattggcagctaagttataagggagggtttcccaagtgcttggatatgacaatgatttttgctttcctagttacttaattataattataggatttattagaatttatcatttcctattttttactcaaattttacttgtaaagaatgtacaacgacttgtgaatataaatgaggaaaataatcttgtctcct

SEQ ID NO: 693 - DNA, 974 bp, Glycine max
  misc_feature (10)..(10): n is a, c, g, or t
  misc_feature (29)..(29): n is a, c, g, or t
  misc_feature (31)..(32): n is a, c, g, or t
  misc_feature (55)..(57): n is a, c, g, or t
  misc_feature (62)..(64): n is a, c, g, or t
  misc_feature (81)..(81): n is a, c, g, or t
  misc_feature (83)..(83): n is a, c, g, or t
  misc_feature (85)..(85): n is a, c, g, or t
  misc_feature (87)..(87): n is a, c, g, or t
  misc_feature (97)..(99): n is a, c, g, or t
  misc_feature (107)..(110): n is a, c, g, or t
  misc_feature (112)..(112): n is a, c, g, or t
  misc_feature (119)..(119): n is a, c, g, or t
  misc_feature (121)..(121): n is a, c, g, or t
  misc_feature (124)..(125): n is a, c, g, or t
  misc_feature (130)..(130): n is a, c, g, or t
  misc_feature (136)..(136): n is a, c, g, or t
  misc_feature (147)..(147): n is a, c, g, or t
  misc_feature (150)..(150): n is a, c, g, or t
  misc_feature (157)..(158): n is a, c, g, or t
  misc_feature (161)..(161): n is a, c, g, or t
  misc_feature (163)..(163): n is a, c, g, or t
  misc_feature (167)..(168): n is a, c, g, or t
  misc_feature (174)..(175): n is a, c, g, or t
  misc_feature (177)..(177): n is a, c, g, or t
  misc_feature (185)..(185): n is a, c, g, or t
  misc_feature (192)..(193): n is a, c, g, or t
gacccagcgngcgactgcatcttaaaggncnnaaggaggccacagcaccagaaannncaacnnngaaacgggggcgccaanancncnggggggaaannncagacccnnnncncaccaancncannccagnaaaacncgaagaccgcncancagaacnnganangggnncaaacnncncagaacanagcagcnncggcaaggggggagaatgcattgcggctggagcagacacagaagtggtaggtctcacgtctcatcataaggtcgaaaactccattgaaacaagtcttccacataattccaatttgccagaagaaccaatggtgtcaacgaaaaaggaagcaacatgttatgcaacaaggcgttacagaggtgtgaggagaaggccatgggggaagtttgcggcagagattcgcgaccccaaaaagaaagggagcagggtgtggcttggcacatttgacactgagattgatgctgctaaggcttatgattgtgctgccttcagaatgaggggtcacaaagccgtgttgaatttccctctggaggctggaatgtctcatccagagcccaacagtagtggcaggaaaaggagaagagattatacaacagctgtcacaagttcaagtcatgtcatgtcatgagaaataattcagtgtgggataaccatgtttttcttttggcattttttgtcagttacataagttaatgcaaggttttatagttctactacagttgagcgtgatgaggtctgttatttatatccttgacttatgattaagggaagcaaatggggtgaaattgaattaaaccaagaattaaacagttcataaagaaacctaatactacttttttatttaaagctctcaaagtagaatgtgtgatagtcagttagtcacgactcaccttagtcattatataattagaaaaattctcattgtatcttaactatacctttattctcaggattactaacc

SEQ ID NO: 694 - DNA, 969 bp, Glycine max
ggctcgacctcacaacaatattgtttcatcactcagatcccttaaagatgacaacagcagaagaaacttcaaacttggatctcatacgccaacacctattaggggaaaatatcatctcagactcctcctttttctccaatctccttcatcatcctatgaaacttgaagcaccctcatcaccagaatttgatttcacctcatatatctcagacaacacaagctttttcactttccttgaaggctatgatttgatggcagacatgaaatttgttgattcagacaacaccatcccttcaaaggaggttaagaaatgcaatatttctcctgaaccattggtgtcatcaaaagagaagccaaagaagttagaatacgataaggcaaagcgttataggggagttagaagaaggccttggggaaaatttgctgctgaaatccgtgaccctacaaggaaagggacaagggtttggcttggaacctttgacagtgaaattgatgcagctaaggcctatgattgtgctgctttcaagatgagggggcagaaggctattctgaacttccctcttgaggctggactgtctgatcctaagcctaacagttgtggcaggaaaaggagaagagagagccatgatcatgaattggagctgccacaagtccaagttcatcatggtgtttcctgagaaaaagtgagaagatataataatagatttagttgttttgtgagtagcattaagtttgttgcctagaaaaataaggttgctttgccttttaggttggacgtagaagcaaggctaatgtgaaatgtctatatgaatctatgcaaaaagcatgttacgaaagttttactaactttgaggagttttaaaaaaatattaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 695 - DNA, 1148 bp, Glycine max
tcacatttttttcatcactcccctgaggtgacaacagcagaaaaaacttcaaacttggatctcatacgccaacacctctttggtgaaaacatcatctcagactcctcctcctttgtctccaatctccatcatcatcctgtgaaacttgaacccccctcatcaccagaatttgagtgcacctcatatatcttagataacaacacaagcagcaacttcttcacattccttgaaggctatgatttggtggcagacatgaagtttgtaattgattcagacaacaccaccaccatggtgatcccttcaaaggaggttataaagaaatgcaatattaattctcctgaagaacaaccaatggtgtcatcatcatcagaagagaagccaacaatgaaaaagtcagaacattatgatgaggcaaagcgttataggggagttaggagaaggccatgggggaaatttgctgctgaaatccgtgaccctacaaggaaagggacaagggtttggcttggaacatttgacagtgaaattgatgctgctaaggcctacgattgtgctgctttcaagatgaggggtcagaaggccattctgaacttccctcttgaggctggagagtctgatcctaaacctaataacagttgtggcaggaaaaggagaagagatcagaaccatgatcatgaattcgagcttccataagttcaagttcatcatggtgtttcatgagaaagtgagaagaatattagagttagcttaattagttgtgtggctagcattaagtttgttacttacctaggaaaataattaatatgcctgtgaaagtctgtacatagaaacaatgctaatgtgaaatgtctatatgaatctatgcaaagtatgttatgaaagttttactaacttttaggagttttagaaaaatattaatcagtttatgtttttttttaaccttcaatttatcagaaaattttttttctgactaatccaaaatttgattaggagatcaaataatctgataaaacattattttcactgaagataatcaatttatgtttgaagatacaccgaataaaatgaacaaacacattttcttttttgttgtttgtctctgtttttgagggaaacatgcaaattcttttcagttcaccttcacttttgtc

SEQ ID NO: 696 - DNA, 1435 bp, Glycine max
agcggctcgagcggctcgagctcccaaattctcaactttcctaactttagcaaccatctaagaagttcagtcccttaattatctctcaccttgaattagaaaagcattcaaagctttgaacccaatttcactgtttgcacctcaaacatcttagaagtcccaattgagtctcaattccacaaccaaaaatgcaaagttcaatttcacaatctgatatttttatcactgattaccttgtaccccaagaagttccatttcaatttcaatttcaagatatgagcaagaatgacaacaacatgccaatgaaccataccaataataaccttcaaatgcctcaaatcacatctttctccaagcctccaaggtcctcatcaaatctaagcaaccgcaaaccctccttgaaaaacatcacaatcccttccataacctctggtcttgcaacagctatgtcacaaacaacagcaacaacaacaacaatagctacaaccatgtataacaacaaccaagtttcttcttcttctttttcttcagatgaaaccaacaataccaaagacgacaagcactatagaggggttagaagaaggccatgggggaagtatgctgcagaaatccgtgaccctaatagaaaaggctcaagggtgtggcttggaacctttgacacagccatagaagctgctaaggcttatgacaaagctgctttcaagatgagagggagcaaagccatattgaacttccctttggagattggatcagatcagtctaaagaagagtcatcatcatcatcatcatcagtttcaagcagcagcatcgtcatcaaggttggtgtgaagagagaaagagaggaagagagtgaaaggaagaacaactatgagaaaagtgagtttaacaacaatagtaatagtaataagcatgtgaagaaagaagagtgccctttgactccatcatgttggaaaggcttttgggacactgatgttatgggaacaatctttagtgtgcctcctttgtcaccactatctccactaatggttgtttgagattttgtggaacttttgctctttcaatgatgttttgaggtaaccaaactaaggggagagagagagatgatgctggtgattgtcctctctgatttaggttgctaatttgcctaaatcaaaatggtagtactaattaatctactaatagattaatttgcaagtgaatatatatatggatttgtataatgtaaatataggatagtactatgaagcaagatctttttgtttgttgaaaaaaaaaacaaaaaacccatgcttatcttcttcctttaggtaaaaaaatgtactgtacttgaagcaatattgaaatttgtttattcgtttattggagaaaaaaaaaaaaaaaaaaaaaaaaaggaaaaaaaaaaaaaaaaaaaaaaaaaaaaaaaaaaaaaaaaaaa

SEQ ID NO: 697 - DNA, 1091 bp, Glycine max
tacggctgcgagaagacgacagaaggggaacacaatactcttcaaacactttaccttcttcttaagacaacaagctaaaagcgcttctaacttaagtgatggctaacgctgctgaagtttcagcgttgaaacgcatcaagttgcatcttttgggtgaactctctccactggccactccccaaaacaaatttgaccaaacaaaccctagcccctctgaatcttccaattccgaatcttcttctatttctcttaaccactacttcactgacctcctcgaacccgaaattgaatttcctctcttcgaattcgattccaaaccccaagtaatcgacctcgaaaccccgaaaaccctaatttcagctgagaagaagcctcaatttaatcggaaaccgtcgctgctaatcgctgttccgaagaagaccgagtggatccaattcggaaaccctgaggtggcggcgccggagaaccagcctgagaagaagcactacagaggtgtccgtcagcggccgtggggcaagttcgccgccgagatccgcgacccgaacaagcgcgggtctagggtttggctcggaaccttcgacaccgccatcgaagccgccaaggcctacgaccgagccgccttcaggctccgcggctccaaggccatcctcaacttccccctcgaagttaacaccgcggcggagaccgtctccgtcgccgccgtcgacgtcgagaggaagcgccgccgcgaggaggaggaggtggtggtggaggatgtaaaggcggtggtgaagaaggagaaaataacggagcatgatgtgagttgttttagggggatgccgttaacgccgtctatgtggaccgggttctgggacagtgacgtcaaggatattttcaacattccgccgttgtcgccgttatctccttttggattttcaccgctcgtggctgtgtgaaattccaatttaggactgcgttttttcgtgttttagtacttacagcgtcctcctgttcagggatgagtacattgtacatttgacgaatttgtttattcaacaatcttttattcacttttatttgctacataccatggagaatttttttgaagtttg

SEQ ID NO: 698 - DNA, 1018 bp, Glycine max
ccacgcgtccgctctttaccttcttaacgcaccaagcgaagcgaaaagcgctttctaacttaagtgatggcgaacgcagctgaagtttcagccttgaaccgcatcaaactgcatcttttgggtgaactctctccactggccactcccctaaactattttgatgaatcaaaccctagcccctctgaatcttccaattcccaatcttcttctgtttctcttaaccactacttcactgacctcttcgaattcgactccaaaccccaaataatcgacctccaaactcccaaaacactaacttcagctcagaagaaacctcaattgaatcggaaaccgtcgctgctaatcgctgttccaaagaagaccgagtggatccagttcgggagcccggatccgaacccggtgatggctgcgccggagaacctgccgcagaagaatcactacagaggtgtccggcagcggccctggggcaaattcgccgccgagatccgcgacccgaacaagcgcggctctagggtttggctcggaaccttcgacaccgccgtcgaagccgccaaggcctacgaccgagccgccttcagactccgcggctccaaggccatcctcaacttccccctcgaagttagcgccgtggcggagaccgtctccgtcgccgccgccgaaggcaacgtcgagagaaagcgccgccgcgaggaagaggaggtggtggtggaggaagtaaagccggtggtgaagaaggaaaagataacggaacaggatgtgagttgttttagggagatgccggttaacgccgtctatgtggaccgggttctgggacagtgacgtcaaggacattttcaacgttccgccgttgtcgccgttatctccttttggattttcaccgctcgtggcggtgtgaaatttctaatttagcactgcgttttttcgtgtttaagttacagcgtcctgtatggggatgagtacagtgtacatttgacgaatttgttaattcaacaatcttttattcacttttatttgctcc

SEQ ID NO: 699 - DNA, 1027 bp, Glycine max
tttttttttttttttttttttttttttttttttttttttttttttttttttttttttttttttttttttttttttttttttcaatataataaataaatgaataaattatctccatattcgacaaggaaagaagaaaaaaaaatgatttcacacaaccataagctgtggaaaacccaacgccgggtggggagataacggtgacaagggcggcacggtgaatattccgtttgcatcactaccccagaaccctaaccaactagacggcgttaaaggattattcttaataagactaacgtcggattcccctatcttttctctcttgacgacttcaagcaccggctccaccttctcttccctttggcgtttgcggtcatcggcgccggcttcgagggggaagttgaggatggctttggagccgcgaagcctgaacgcggctcggtcgtaggctttggcggcttcgatagccgtgtcgaacgtcccaagccacaccctggagccgcgcttgttcgggtcccggatctccgctgcaaacttcccccacggtctctgtcgcactcctctgtagtgcttcttctcttccgcgttcgggttactctgcgacaccgtttcggtaacctcgggctctccaaattggatccactcggtcttcttcgggagagagatttgcagcgacggccttcgactcgatttgcagcgtgtggttggaaaactgaattccaattgtggctcaattatttcgggttttggctcaaactcgaatgcagaaaactggttttgttctgtggaagaagtagtagtagttgggaaatcgaggaattcggagaagatttggtcaactgtggtgaatgaatcggaagttgaagattgggaacagagggaggttgtgtttggttcctgaaattgggtgaggggagagagttctcctaaaagatgcagcttgatgcgattgagagcagagacttcaagagcgtttgccatgagatattgagaggagaaggagctttagaaatgttaagacgtgtggccc

SEQ ID NO: 700 - protein, 273 aa, Oryza sativa
MAGFGLDQHLDLIRAHLLEDAHHHVLAPSPSPSPPGTGRVRPAPVSLPPRPPLLWAAASAAPRQQEECFELGGGYAGEGEGEEEDDFRRYRGVRQRPWGKYAAEIRDPARKGARVWLGTYDTAVEAARAYDRAAFQLRGSKAILNFPNEVAADAAVKWAPPVAPIPAAAMSAGRGKRVRSEEQYYLREVKKERLIMAPPENSSSSSSSAAAAAGDIWDELKGICSLPPLSPLSPHPHMAFPQLFVIDLAFGQILNSFVLLLLRTRDFAFDYAI

SEQ ID NO: 701 - DNA, 400 bp, Zea mays
  misc_feature (369)..(369): n is a, c, g, or t
gagctcgcacgcttggggcccggcggccgtgccgctggaggcacctggcgcggcggtgctggacgcgaacgacttccgcaagtaccgcggcgtgcggcagcggccctggggcaagttcgcggcggagatccgcgaccccaagaagcgggggtcccgcgtgtggctcggcacctacgacaccgccatcgaggccgcgcgcgcctacgaccgcgccgcgttccgcatgcgcggcgccaaggccatcctgaacttccccaacgaggtgggcacccgcggcgcggacttcctcgcgccgccgccgccgccgccgcatgccgcggcaacgtcccagaacaaacggaagctgatgcacgacgccgaggccacggncacggccggggccggagccggagccgagcca

SEQ ID NO: 702 - DNA, 1082 bp, Glycine max
ccacgcgtccgcttcttctctcagaatacacaacacaaagtcaatataattatagtatatccctatgagtaggagttcggcgatgcatggaattacaagcacaaacaacaagttgaagggagttcggcgtcgaaaatggggcaaatgggtgtcggagattcgtgttccgggcacgcaagagcgtttgtggttgggaacctacgccacgccggaggctgccgcggtggctcacgacgttgccgtctactgtctaagtaggccttcttcgttggacaaacttaacttccccgaaaccttgtcttcgtacagtgttcagctcagggacatgtctccgaggtctgtgcagaaggtggcttccgatgttggcatggatgttgatgcaagaaacattgttgcgggcaaaacttcaacggtgggggcagaaactaattgcgagagtgatgagaggactagtactgcgtctgtgtgtaatgttgttggagaaggtggtgctgatcattcggatgtgttttggtgggatgatgatggtgggtcttggcatggaagtggtggagattctacggaaagggatgccttgagcatttccattgaagattatctttagctgttctaggtttcaactttagttatctttttttttttttttttgagttatgatcgatgcgcatagttagtagttacagataattactgctagtgttgggtgtttaaacggtcagagatgatgatatataaatttgatgtgcgctagctgcctttttgaagaaactaaaaaaaggtaaaacaagaaagattgtacccccaaaatgaacttggtcaatttcacactttcacgccatttgcattttgtgcacgttgttagttttcaaattgttaattcccttgctaaacccactcaaacttgagtgcgttcaccttttattaccacgtagtaactgagagttaacgaaaatatttctttataaaaattatttaccatttagtgtctttcgtttacttgtaattattcaacttgtcaataagatgaaagttctaattttagatataataaaattcagctagtatttgtgaattactcactt

SEQ ID NO: 703 - protein, 165 aa, Oryza sativa
MSRAECGGGEEEERCRYRGVRRRRWGKWVSEIRVPGTRERLWLGSYATPEAAAVAHDTAVYFLRGGAGDGGGGGATLNFPERAAATYGGGAAVARLSPRSVQRVASDAGMAADAQLLSARDAAPAPAPATANARPDHCTGCDDRAVRLAGTPRGCTVLTSHAIVF

SEQ ID NO: 704 - DNA, 1223 bp, Glycine max
gggggaaaagcgtagtcatcagtttgccgatagaagtagaaaatggaatcttgatcgtattatctttgttgctcatccattactccttctgcagtagaataatatataaagagagaagagtgcaatctagaaccacatagttattttactgtgtgagagagaaaattaaacatgggaagaggaagggttgttctggaaagaatagagaacaagatcaaccgtcaagtaacattctcaaaacgcagaagtgggttgctgaagaaggcctttgagctttctgtgctatgtgatgctgaagttggccttatcatcttttctagccgtggcaagctttttcagtacagcagcactgatattaccaaaatcattgagaggtatcgccaatgtcgttacagcaagtcacacactggtgattcattggaacacgattcacagagcgcataccatgaattcttgaaattaagagcgaaatatgaatctcttgagcggacacaaaggcattttcaaggagaagaccttgagccacttagctttaaagatttgcagagcctggagaagcaactagacataacgctcgcactaactcgacagcaccaaacgaagaaactcatggcacgagcggatgaattacgcgaaaaggtgcataagttggaggatcttaacaaacaattggagtccaaggttttctctttaaataaccatgaaaaagatgaattctcgagtctcatccttgacaataacaattacattcaaatgcatgctacacaagttgatcaatttgagtctgagacagcactaaacacatggtttcaacatcaagaagttgtttctaaggaaaaagcaattgataccaggacagagcatagtcaaagcagtcacaacaaaaacaatggatggctgtaatgaatattcatttaatttacatgctaaaaaaatacctatcacaataactaatgggataatgcccattattggtattcacacaaatagtttatataaagtaaatgttatttctactaaacacacattattcctaataagaaattatgtattttatgcatcagaaaaggggatgaattgtgtatttcatctatcattgtataagttgtcattttaaaaaaatttcttaaatattgatattttacctattggcgtcatcattgtaatcagtttctagtagtagagagaaataattttatcctaaaaaaaaaaaaaaaaaaagg

SEQ ID NO: 705 - DNA, 1169 bp, Glycine max
cccacgcgtccaattcggctcgagcaactactactactataggtacttactactttgcctagctcctctttctctctcttcccttttgcactgaacttcactctctcttctatatcaagggttgatcacataacctcaatatatttctaataataattgatatagtttgagttattgtttcgagacacacagaaagagagagagagagagaatgggtagagggagagttgagttgaagaggatagagaacaaaatcaaccgccaagtaactttctcaaaaagaaggaacggtttgctcaagaaagcttatgaactctcagttctctgtgatgctgaggttgccctcatcattttctcaagccgtggaaagctctatgaatttggaagtgttgggactaccaatactattgagcgataccaacgtagctcttttactcctcaagacgaacacgttgaatgtgaaactcagagctggtaccaagaagtttcaaagctaaaggcaaagtatgagtctcttcaaaggacccagaggcatttgcttggggaagatcttggaccattgaacataaaggagctgcagaatattgagaaacagcttgaaggggctttagcacaagcaagacaaaggaagacacaaatcatgattgaacaaatggaagagcttcgcagaagggagcgccatcttggagacatgaataagcaacttagactcaagcttgaagcagagggatttaatcttaaagctacggaaagcttgttgagctttacttcagctgctggaaacagtggctttcactttcagcagcctcctcaaaccaatcctattgattaccagcagccagaaccctttttgcaaatagggtaccatcaatatgttcaatctgaggcatctaatgttccaaagagcatggcttgtgagactaacttcatgcagggatggatcctttgatcaatcttattaattgaattaagtatatgatgatttaccttattgtctatatcctttttagattttttgtgttttggctgttgttaaatgtacctttgtcaccagaaaagttgcaaacttgtttagctctttctgtaattggatacaagtactacagacaatggttttactatatgttaaagcaatgctattgtttttaactttgatgcttggaacctat

SEQ ID NO: 706 - DNA, 1227 bp, Oryza sativa
tacccgcgggaatcgttcgatcgatcgggcgagatggggaggggaagagttgagctgaagcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccggcataacaaagactttagaaaggtaccaacattgttgctacaatgctcaagattccaacaatgcactttctgaaactcagagttggtaccatgaaatgtcaaagttgaaagcaaaatttgaagctttgcagcgcactcaaaggcacttgcttggggaggatcttggaccactcagcgtcaaagaattgcagcagctggagaaacagcttgaatgtgcactatcacaggcgagacagagaaagacgcaactgatgatggaacaggtggaggaacttcgcagaaaggagcgtcagctgggtgaaattaattaggcaactcaagcccaagctcgaggttgaaggttccaccagcaactccagagccatgcagcaagcctcctgggctcagggccccgtggtggagaatggcgccgcatacgtgcagccgccgccacactccgcggccatggactctgaacccaccttgcaaattgggtatcctcatcaatttgtgcctgctgaagcaaacactattcagaggagcactgcccctgcaggtgcagagaacaacttcatgctgggatgggttctttgagctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggtaaactgtttattacgtactctatatagcatatgtgaccaacgacaacggtttcattttagatgatgtgtatggatgatttctttccaaaatcacatctttagtataagagcaattttaccatccaaaaaaaaaaaaaaaaaaaaaaaacctgcagcccggggatccactagtttagagcgccgccaccgcgg

SEQ ID NO: 707 - protein, 249 aa, Oryza sativa
MGRGRVELKRIENKINRQVTFSKRRNGLLKKAYELSVLCDAEVALIIFSSRGKLYEFGSAGINKTLEKYNSCCYNAQGSNSALAGGEHQSWYQEMSRLKTKLECLQRSQRHMLGEDLGPLSIKELQQLEKQLEYSLSQARQRKTQIMMEQVDDLRRKERQLGELNKQLKNKLEAEADSSNCRSAIQDSWVHGTVVSGGRVLNAQPPPDIDCEPTLQIGYYQFVRPEAANPRSNGGGGDQNNNFVMGWPL

SEQ ID NO: 708 - DNA, 754 bp, Zea mays
  misc_feature (645)..(645): n is a, c, g, or t
ttgggtacctcgaggccggccgggaaagaatgtccgaagtcagacgacatattttgtagataatttgctatgctttgtgcacttatgtttttagggctttctagttgaaccggtgcccctgttctgtttttaaaattgcctctatgtaagaggctgtgcagtataaaaaaaaaaaaaaaaaaaagctagcggccggatcagcagccacaaaacgaggagagcaaccacgctgcacacagagacgcccgtgtgtgagatatagagcaagctcgatcgaaggaaggagggaagctagagatcgtacgtcgccatggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccggcataacaaaaactttagaaaggtaccaacattgctgctacaatgctcaagattccaatggcgcactctctgaaactcagagctggtaccaggaaatgtcaaaactgagggcaaaatccgaggccttgcagcgcactcagaggcacttgcttgnggaggaacttggcccactgagtgtgaaggagttgcagcagctagagaaacagctcgaatgtgctttgtcacaggcaagacagagaaagacacaacttatgatggagcaa

SEQ ID NO: 709 - DNA, 1310 bp, Zea mays
tggaccctccacgcgtcccccggtacaggggcagccaggcacacacacacacggtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccatggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccggcataacaaaaactttagaaaggtaccaacattgctgctacaatgctcaagattccaatggcgcactctctgaaactcagagctggtaccaggaaatgtcaaaactgagggcaaaattcgaggccttgcagcgcactcagaggcacttgcttggggaggaacttggcccactgagtgtgaaggagttgcagcagctagagaaacagctcgaatgtgctttgtcacaggcaagacagagaaagacacaacttatgatggagcaagtggaagagctccgcagaaaggagcgacacctgggagaaatgaacaggcaactcaaacacaagcttgaagctgaaggttgtagcaactacagaaccctgcagcatgcagcctggccagctcccggcagcaccatggtggagcatgacggcgccacctatcatgtgcatccaacaactgctcaatcggttgcaatggactgtgaacccactctgcaaatcgggtaccctcctcatcaccagtttctgccttccgaggcagccaataatatcccaaggagcccccctggaggcgagaacaacttcatgctgggatgggttctttgagttgctctggtaatcatccatccatcagatggatgtccaaactaataaaaggcactcagtgctaccatatgcatatccatgcctaagtgcttgatttgccacgacgtgggatatcttttaaatttatcgttctggtgtgtaataactaattaagaacggcaccttcattctatggttgtggtgtggcacttctatctaaaaaaaaaaaaaaaaaaaaaaaaaaaaaaaaaaaaaaaaaaaaaag

SEQ ID NO: 710 - DNA, 579 bp, Zea mays
cctagcagcacttgtgtccggcggccttgtgttcgtggggggtgtgtggcatattggctagcggataagcggccggccgaagagcaaccgcagtgagaagaagaagctcggatcggaggaggtcggcatggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccggcgtaactaaaactttagaaaggtatcaacatttctgctacaatgctcaagattccaacaatggtgcactctctgaatctcagagctggtaccaggaaatatcaaaactgagggcaaaattcgaggccttgcagcgcactcagagacacttgcttggggaggaccttggcccactgagtgtgaaggaattgcagcagctagagaaacagctagaatgtgctttgtcacaggcaagacagagaaagacacaacttatgatggagcaagtgga

SEQ ID NO: 711 - DNA, 1270 bp, Zea mays
ctcgtgcgctgatattccgctcctgtccctgtgtcctccccggatggagctagagccggctctgctcatcattatatcgtcgcgcacaaatgcagcacttgtgttcgtgggggtgtgtggcatattcgctggcgccctcgcggccggccgggcagctaccagcagtgagcaagctcggacctcggatcggaggaggtcggcatggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccggcgtaactaaaactttagaaaggtatcaacatttctgctacaatgctcaagattccaacaatggtgcactctctgaatctcagagctggtaccaggaaatatcaaaactgagggcaaaattcgaggccttgcagcgcactcagagacacttgcttggggaggaccttggcccactgagtgtgaaggaattgcagcagctagagaaacagctagaatgtgctttgtcacaggcaagacagagaaagacgcaacttatgatggagcaagtggaagagcttcgcagaacggagcgtcacctgggagaaatgaacaggcaactcaaacacaagctcgaagctgaaggctgtagcaactacacaaccttgcagcatgccgcctgctggccagctcccggcggcaccatcgtggagcatgacggcgccacctatcaagtgcatccgcctgcccactcagttgctatggactgtgaacccactctgcaaatcgggtaccctcatcaccagtttccgccccctgaggcagccaataatatcccaaggagcgctgccacaggcgagaacaacttcatgctgggatgggttctttgagttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtggcacttatactgtttattcatttggaccatgaatcggggtagtttgtaaaaacacatctatatatgctgccggtgcatagaattcaaagttatctgcaccgtaattattatatgctcc

SEQ ID NO: 712 - DNA, 1865 bp, Zea mays
cccgagccggctcattatatcgtccgtcgcgcagacaacgcaagtttgctagcggccggatcagcagccacagcgcgaagagagcaaccacgctgcacacagaggcgccgtgtgtgagatagagcaagctcgatcgaaggaaggagggaagctagagatcgtacgttcgccatggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccggcataacaaaaactttagaaaggtaccaacattgctgctacaatgctctcgaggcccggcccgcactctctgaaactcagagctggtaccaggaaatgtcgaaactgagggcaaaattcgaggccttgcagcgcactcagaggcacttgcttggggaggaacttggcccactgagtgtgaaggagttgcagcagctagagaaacagctcgaatgtgctttgtcacaggcaagacagagaaagacacaacttatgatggagcaagtggaagagctccgcagaaaggagcgacacctgggagaaatgaacaggcaactcaaacacaagcttgaagctgaaggttgtagcaactacagaaccctgcagcatgcagcctggccagctcccggcagcaccatggtggagcatgacggcgccacctatcatgtgcatccaacaactgctcaatcggttgcaatggactgtgaacccactctgcaaatcgggtaccctcctcatcaccagtttctgccttccgaggcagccaataatatcccaaggagcccccctggaggcgagaacaacttcatgctgggatgggttctttgagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaactgggacgagacctgcatgcagatggatgaagtgctagcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaagagttcatcgacattgtggagaccgtatacaggggcgcccggaaaggccgtggtctggtgattgctccaaaggactactccaccaagtaccgttactaagaaggcaggcattccccttatgcaatctattggggatgtttacacggacagttagtccgacaggtgatccctaactgtatcttggcataccctagtaattcaagttgctggctggagtgatgcttatccatgtcttggcatgccatagtgaacatgtaaacctgtgatttgaggtgattattcgagtgtaaagaaaccaggattgcgttcgcctatgactatgtgtctagttgtctacttaataagaaacagttattggtttggaatatcggaactgagacaataggtttcctttcggtatttctattatcaactaccctgctttgctacaaaaaagagacattaaaagcggcc

SEQ ID NO: 713 - DNA, 616 bp, Glycine max
  misc_feature (548)..(548): n is a, c, g, or t
ttcgttctttgacgcccgggcccgtcttgtcctccctccttcttcttctctcccctgcttctctttctccttccaaatcactcctataattttcaagtccaagggggtatttgtgaaggaaccctaaaatataattttttgaccaaagatggggagaggtaagattgcgattcgaaggatcgacaactccactagccggcaagtgactttctcaaagagaagaaatggattgctgaagaaagctagagaattatcaattctttgtgatgctgaagttggattgatggtgttctccagcactgggaagctttatgactatgcaagcacaagcatgaaagcggttattgaacgctacaacaagctaaaagaggaaccccatcacctcatgaatccggcttcagaagcgaagttttggcagacagaagcagcaagcttgaggcagcagcttcagtacttgcaggaatgccacaggcaattaatgggggaagaacttatgggtttgggtattaaagaactacaaagtctggaaaaccaactggagatgagtntaaagggtgtccgcatgataaatgaccagattgtaactaatgagatcgaagaactacgcctaaatgga

SEQ ID NO: 714 - DNA, 1019 bp, Glycine max
gggcgggtggaagaatttcttccttgatttgagtcttggtttctcataagatgctttcattgtttcttacatacatgctagggttgccttttctttttctgataatttcaaattaaaatctttaagccaatttgtctgtggtctatatgccacaacatttatacgaagacatcgaggtttaaatctgagtccatttttcttgatagcaattgtgaaacacacgcatcctgtatatggatcaatgcaattgcaatctgcccatttttgtagttcctgaaggtgccttgtagtgttgttgctggtgcttggctggcttagctggagattcacaggcacttgcaaatcctctcctatgcctagaccatttgtgagaacagaatctctgtttgtttcgttatcatcttgtgttccatagaccttcttatacagttccacattttcttggtgtatgaggtttccctttcgatttagctcttgtatttcacccattaaaagttgatcctttttcattcggacaccatgaaggctaatttctaattggttctccaaatttggtaattctttgactgtcaagcctgacagttcttcccccatcattttcctgcggtgactttcttgcaaattgtgtaattgttgccttaacattgctgcctccctttgccaaaatttaatttcagaggctgaactcccaagttgacaaggttcttcttttgatttgctgtatcggtccattactgatttcatgctggagctggcgaaatcgtagagttttccggtgctggagaagatcataactccgacttcagcatcgcacaagatcgcaagctccttcgccttcttcagcaaaccgttccttcgcttcgagaacgtcacttgcctgctcgtggaattgtcgatcctccttatcacgatcttacctctccccataccaaaccctaacaatcagatccttccgaaccagaaattcactcgtgaggagcgcgttgattataacagacaaagcgcccttcgagccgaat

SEQ ID NO: 715 - protein, 255 aa, Oryza sativa
MGRGKIAIKRIDNTMNRQVTFSKRRGGLMKKARELAILCDADVGLIVFSCTGRLYDFSSSSMKSIIERYQEAGEEHCRLLNPMSEAKFWQREVTTLRQQVQNLHHNNSFYLSANYLNENSAYYFIRINQYEGENEIFFKAHVEIHVSNKRQLLGEEISNFTVRDLQLLQNQVEMSLHSIRNKKGSLVQKENSELRKKFNIAHQRNIELHKKLNSGESTSSEQVTRSSKDPGESSTPRDSRVCIDLELSQKEVEDE

SEQ ID NO: 716 - DNA, 1903 bp, Zea mays
  misc_feature (248)..(248): n is a, c, g, or t
aatccttactatattaggcataaaattaggtgtagtttatttatttactggtactacttctttagtcataattaggtgtactagcagctacgccctgacggagacaagcacacacaatagaaaagagcgccctcgtgctcagagtgctcgcctttagtttcgtggctactatatactagttgcgacgatttttattttctttctcttctgggctatcattagcacggccatttaggggtaatgagcancggccaataaacaaagccctgagatgcatggggtagccaatcgggtgtcgccgtgcgcgcgcgcgcgcgtctggcctcctccttccctttccttgctaaataaagcaagtagcagataggggaaagtctgctcgcaagttgcatccgccctgcgccaagaaaagccatcgttcttcccccgcccgcacacatagaagcatcattcccctctcggctagcttcctcctctctccctcctcttcgtcttcctctttccttctcccttgggaaacctgctgcctttgagctttcttcttcgagtgctcccaccagatctcctcctccttaccttctttggcacgttcggcggcgcgcgcggagatagatagatcccgccatcgtcgtcgccgtccttgcttccgatcggagggccacaaccacaacctctcgctccttagcgtgcgcgcgcgagccagggtcaagaagagagctagctataggccggagatcgatgggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgccaaccccggccccgtcctcaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgtggaattcagaggatgattgctttctagttgcatttgatgtttgatgagacttttctcatgtgaaacgtttattaaaacttcaaaatggtgcagatgttgctactacacttgttaggcttgtataaatatctgcccttgggtactagctttacgaaaacagaaaagaagacagacagccgtgataggggacaatgatgcgatctaggagtacaaacagagtctagtttccactcagttgagttttatattgctctcaagcgttatcaagggtttagtaggatacagatataa

SEQ ID NO: 717 - DNA, 1031 bp, Zea mays
gcgcgagagagaaagagagcagcttctccatctagctagtagttagagagatgtagtactagctagctagctagtaccaccggcgacaaggtagttaggtttctcctctttctctctctagatctgtgctgctaggaaggatcggagatggggagagggaagatagagatcaagaggatcgacagcgcgacgagccggcaggtgaccttctccaagcgccgcagcgggctgttcaagaaggccaaggagctcgccatcctttgcgatgccgaggtcggcctcgccgtcttctccagcaccggccgcctgtatgacttcgctagcaccagcatgaaatgtgtgattgaaagatacagcgaggcaagagaggaacaccgtcagactatgagcgcaagtgctgaggccaaggcagttgttgggtcagcagctttctggcctgaacgtgggagatttgcagaatttagagaataagctggagacgagcctaagaaatattcgtctgaaaaaggaccaacttattttttatcagattcaagaattaaacaggaagggaagcctcatgcaccaggaaagcatagaactatacaacaaagttaaccttcttcatcaacataacactgaattacagagaaaggtgtatggacaaggagtaaataatgagcaaacaagtactactgttagacacagtacccgggatacagagaatcttccgatcaatcttgagctaagtgtgcaaagggacaaatcagaaacaccaagtgtaggcctgtagggtgagatttttgtccaaacttcaggataacacagagtcagtaaaccagatgatttaataaagaacactgaaagtgccataagactttaaatgcagtgaggatacctaagccgagtgataagaaatggatatcgttggtggaattgtaagacctaacagctaaactttaagctgctagatgcgattgtttatgtatgaagaagaatgttgattttaatttagcttttcatataaaaaaaaaaaaaaaatacccacacac

SEQ ID NO: 718 - DNA, 2420 bp, Zea mays
gaattcccgggtcgacccacgcgtccgcccacgcgtccggtcgtcctcttctctcgcctccaataattcgtaaccattctccttccaggccgggctcctgctggccggagttcccatctccctctttccttctcggttactatccgtgagtgtgcctgcccccgtgtgtgcgcgtgcaagatcgaccgggcgcagcttcacgatggggcgcggcaagatagtgatccgccggatcgacaactccacgagccggcaggtgacgttctccaagcggcggaacgggatcttcaagaaggcaagggagctcgccatactctgcgacgcagaggtcgggttggtcatcttctccagcaccggtcgtctctatgaatacgccagcacaagcataaagtcagtgattgatcgatatggtcgagcaaaggaggaggagcatgtagcagaccccaacacagagcttaagttctggcaaagggaggcagcaagcttgagacaacaactgcacaacttgcaagaaaatcatcggtacgtcaacaaaaccctgcaagttttacagatgcatcattcagaaaattgccaaatgtaaggaagatcaataaaagaattgtcagcatgagcacaaatacaaaacgtctgagtacagaaacacaagggattttttaaacaagaaaatccattctgctttttaaagaaacatatataaagtggtttaaaacaacaacaaatctgcgctgctggatcaaccttaaggagtaaggaccacgaggtaactagaacacctccaacatcgaacttgtgcagtgtatgaattagtatagcaatatgtgagaataattttagcatacaaaatgcataacaacagaacctagtttagggacgtggtaatgatgccataggataatacatggtttatgcagacatcagttttcacaagcaagagaaatgtaaaaggatgcaaaggcttgtgaacttcatgtgccaaaccatttatcaatagaaaactgtacatttagttatcttatgcattattattaacgtccaaagaagcagatacacaacattattgtaattttgtatgattaacccaaagcagcagatacacaccatcatatttaaatgtatttatttttttgcctactagtttttgagcgctctgatttgtaatcactctattccaagtaacagtactaaaggcatctgcagtgtaggaaatgaaggtgtcataagaccttaaagccgataaggtcagaaagcggtatttaacccaaaaaacttagaaccagaccattagcttaatacctggcctcagcaaattaaaaaaaacacaagcgaaggcaagaaactcctctcccacaggtgtgtggcagacaatggcaactgtggcctcccacaggaggacgcagctgcctcacgctgcagggagtggaaagggcctctagggcctcctgcagctagcggcgaggacctcgcatggaggaaggaggaggcgctgtgagcaggacacttggcgacggggaagacaaagcagcagagaggaagaggcctcattgagctcactttacggccattgggagtgccaggtgccctaacgcatacatagccagaagccgaatccttaaaaaggaacacgatatgatcaagcaacaagacccttttacattaaaatacagtcaaactcgaattgtaaaaactaagtgagattgtttgactggctgtaggcagttgatgggacaaaatctttctggactaggtgtcaagggacttcaaaatctagaaaatcagctagagatgagcatttgttgcatccggacaaaaaaggaccaactcttggttgacgaaattcacgaactgaatcgaaagggaagtctcatccaacaagacaacatgggattacacagaaaggtcaacctaattcgtcaagaaaatgccgaattatataagaagctctatgagaaagaagcagaaggtgaagtcaaccgagattcaacaactccgtacaactttgtagttgcagagggtgccaacgttcctatccatcttgagcttaatattccactgcaagaaaatggtgttgagcaacctgtggctcctaaattagggttgcaattaaatcaatgaagacatgcaggacattgcctttgttctcattgtccttgaagtctgcaactcaaagcagcctaaaatgataggttgtaacaggcctaaaaacattgcaagacaaataaagtatgcatgccagagacagtggcaatggtagtgcaaatctatctcaaataacttgtgttatattgaataatccagcaaatggtttgttttttacacgttatgcaagtttgtttgaccaaaatggtatgtaacatgtacaaatttccaagtgaacttattgaaaaaattctataaaaaaaaaaaaaaagggcggccgc

SEQ ID NO: 719 - DNA, 1231 bp, Glycine max
attcggctcgagcttcctctctagctagggtttccttctttatacaaaacacaacctaacaagtaacaaccttctttatatgtacttattccttaaccctcctgttaccttcttttgctttcgcgttcgttttctctttctcggtcttgctttgctcagaattgctagttacgtgggagaattaagcaccaagaagatgggaaggggtagggttcagctgaagcggatcgagaacaaaacaagccagcaagtgacgtttttcaagcgtagatcgggacttctcaagaaagccagcgaaatctctgtgctatgtgatgctcaagttgctttgattatattttctaccaaaggcaaactttttgagtattcctctgaacgcagcatggaagacctccttgaacgttacgagagatgtagccatacagcacttgctggagctaacaatgtcgaatcaccgggattttggtctttcgaacatatcaagctcaccgctaaagttgaagtcttggagaggaacataatgaatttctttggaaatgatctggatcccttgagtttgaaagagcttcacagtttggagcagcagattgagacatctctgaagcgcatccgaactagaaagaatcaagttatgaatcaatccgtctcagacctgcataaaaaggcaaggacattacaagtgcaaaacagatggctaggaaagatgaaggagaaagcgaagacagtgactgaaggtccacacaacggcccagaaactctaggctttgattcatccacactcaacttatcttctccacagctaccaccaccaccatcaccacaaagactggttccttctctaactctcagtgagacaatgcaagggaggaacaccagtggaagaaacgggtgaaggctcaaacagtccctagtggcaattctctcatcccaccatggatgctgcgctgcatgtctgactagttaggctggcatgattctgccaagtatgtgacatgtgatattatgtccaaggctcaactatatatatgtatgctagaacttagaatagccaattatatgccgatcgagcttaataactgctcaaacttctcgcatcgtgaactgtgcccttcactttgaaatcaatggtattaagcccttattttgacaaatgacacgtgatggttggtgctagttaaattacaagtcaccaaagaaaacatttggaccacagaaaaaaaaaaaaaaaagg

SEQ ID NO: 720 - DNA, 1108 bp, Glycine max
gccaaaaataactacatgtttctattattaatattgattcataataaatgtagttgacatttgcatgcaagaatcacttgcactcttgcaccatgtagtacttacaaggatgagcagttatcaaacttaacacttagctatataacattaagtttttgacatatagagatatataacttatgcttctaacattcatcacatgtgtcacaaacataacgtgtcacatgcagatttatcttgtaaatggatgcagcatccatggtgggatgtgagtgctggcagtaggaaccgttcgtgcttcaacaacttcctccagatgccctgcttgtgaagtctcacagagtgttaaagaaggaaatcctctttgctgtcgttgtagctctggaggacaagttagacctaaggtttctggtccgcagtgtggacgttcaaccacttccttccctttctccttaatcttctttgtaaggatgccattttgctcttgcaattgccttgcctttttctgcagatctgagatggattcattcataacttggttctttctagttcggatgcgctttatagctgtctcaagctgatgctctagactctgaagctctctcaagtttaagggatccagatcttctcccacacggttcctcaagttcctctctaagacttcaactttgccggtgagcttgaagcattgtaaggaccagtttccctgtgattcatcaccatctccaacaagtttccctatatgagtatgtctctcatatcgttccaggacgttttccatgctggattcagaagaatactcaaaaagcttccctttagcattgaacacaatcagtgccacttgagcatcacagagcacagagatttcattagctttctttcgcagcccagttctccttttggaaaacgtcacttggcggctgattttgttctcgatctgcttcagctgaacccttcctctccccatgatcttcaaactaagctaagggaagacaaaagaaggaagaagaatgaaatgagaagagtaagtgggggtgtgttgttatgtgacgaattcgcatatataacatgagtatctttcctttttctcgagccgattcggctcgcg

SEQ ID NO: 721 - DNA, 1259 bp, Glycine max
gaattcggctcgagcccagatagttttctcaccatttccgtattttacttcacctttagtgggtagtggttacatgatatcagcacactttcactcactgtgctttcccgtgacacgcatctatacttgtccagaagaagtaagatccatgaactaacattcccacacgctcgcttcaccatatttgccacccttttaacctcacttcttagggttattttgctcccttttccttgtttgggaattgggtttggtttggtttttcttggttgtaaaaggaaacaaagaaagaactaagatgggaagaggtagggtacagctgaagaggatagagaacaagatcaatcgccaggtaactttctccaaaaggagaggtgggttgctcaagaaagctcatgaaatatctgtactctgtgatgctgaggtagctttgattatcttctctcacaaaggaaagctctttgagtatgctactgattcatgcatggagaagatactggaacgccatgaaaggtatgcctatgcagagaggcagctagtagcaaatgattctgagacacaggaaaactggaccattgaatacactagactgaaggcaaaaattgaccttttacagagaaaccacaggcactatatgggagaagatttggcttcaatgagcctcaaagagcttcagagtttggagcagcagttggttactggtatcaaaaacatccgcacaaggaggaatgatctcatgtccgagtccatttctgagcttcagaaaaaggagaaaaggatacaagaggagaataacacccttgcaaagaagatcaaggagaaagagcaggctgtagcacagcaagctgcacaatgggagcagccaaactacagggttgatacatctttcatgccacagcagcaaccccttcccaccagtttgaacatatgtggcaataattactgccaggaagctgcaccagaactaggaaggaacggtctagacctgaccctggaaccactctattcttgcaaccttggatgcttctgaaaagttgtttcttctgagttggattatattatataagtgctggcatatatgaactactataagtagtctgtttgaatgttttatatgtattttggtctatggcttttccctctactttgaagacattattttgaattgcttctgttgtaaacaaattgaatttgaaatctaattgtgtatttttgaaatatgttaattatacggttttccttgcggccgccgaaaaagg

SEQ ID NO: 722 - DNA, 749 bp, Glycine max
ggtggcacacatctatacttgtgcagaagaagaaagatccatgaactaacattcccacacgctcgcttcaccatatttgccacccttttaaccctcacttcttgggtttattttgctccttttttttttccttgtttggggtttgcatttttcctggttgaaaaagggaagaacttgaactaattggttaagttacctatctatctatctatctagggtataatattttatatcagttattaaaggaaagaaagaaagaaacgaagatgggaaggggtaaggtacagctgaagaggatagagaacaagatcaatcgccaggtaactttctccaaaaggagaagtgggttgctcaagaaagctcatgagatctctgtactctgtgatgctgaggtagctttgattgtcttctctcacaaaggaaagctctttgagtatgctactgattcatgcatggagaagatactggaacgccacgaaaggtatgcctatgcagagaggcagctagtagcaaatgattctgaaacacagggaaactggaccattgaatacactagactgaaggcaaagattgaccttttacagagaaaccacaggcactatatgggagaagatttggcttcaatgagcctcaaagagcttcagagtttggagcagcagttggatactgctatcaaaaacatccgcacaaggaggaatgatctcatgtacgcttccatttctgagcttcaaaaaaggagaaaatgatac

SEQ ID NO: 723 - DNA, 1546 bp, Glycine max
ggctcgagggtgagactcacggtcatgactcatgtaaattcgtctcccacaacaacactagctctcacgtacataaatataaagatgttgatagcatattataaatcatagagttcattccatacacagaaagaagaacaacactaagaaagcagaatagggaaaaatacatcgatagaggaaaattaattgaagggtgctactactacgaccttctatatcattaatgattgaaattcgtgttggaattgtcttgtaggtgtagtagtgataataagagaggatcatatatatattagtagtgctagaaattaattgaagtgtgtaatagaatagagtgtgatagagagagatatggggagaggaagggtgcagttgaagaggatcgagaacaagatcaataggcaagtgacgttctcaaagagaaggtctggtttgctcaagaaagcacatgagatctctgtgctttgtgatgctgaagtggccctcatagtcttctccaccaaaggcaaactctttgagtactccagcgatccctgtatggaaagaattcttgaacggtatgagaggtattcatatgcagagaggcagcttgttgcaagtgatcaaccactaactgaaaattggactctagaacatgcaaagctcaaagcaaggttggaagtcctacagaaaaatcaaaggaattttatgggacaagatttggagggcctaagtatcaaagagcttcaaaatttggaacatcaacttgatagtgctctaaaacacattagatcacggaagaaccaaatcatgcatgaatctatttcagagcttcataaaaaggataaggtcctacaggaacaaaataacactctcgcaaagaagataaaggagaaagagaaggcactagcccagcatgcacaaatggagcagcgtggtgatgaaatggatcttacttcctctgccctagtacctcatccattggagacatcaaacattagagagtcctcacaaataaggggtgaaggagataatgaaggaaccccaactccaacccgagcaaatgccattcttccatcttggatgcttcgtccttcaaatgaatagaagagtattaacgacctaaaattttaaattacatatgaatatggcgaatacaaagcttaccctataagatgtaaaatggtctatgtgttgaattgtgaacaccacccaatgagttcaattggaatatcatagatatgtaatgtgtctctgactactacatttcaaggatgctaagtaaattatatggtatggcctgtctagatatagacctgcaatacatatatagtgtcaattatgtatgcttggttcttatcaaaagtttaagttggactttacatgcctctcttcctagaaattcggaaggtaaacataatttcagtacacatatatagtgagtttgtgtaatggaatgtaatctttgtgtatcaagtgttgaaggtttagacttttgggtgtatagatagatcctaacaatactacaataaaaacatactatatcggttttttgtagtttgtt

SEQ ID NO: 724 - DNA, 1395 bp, Glycine max
tacggctgcgagaagacgacagaaggggatagaattcattcgatacacacacagaaagaagaaccaccaagaaagaagcataggggaaaatacatcgatagagagaaattgaagggtgctacgtccttctattgtattaatgattgaaattcgtgtgggaattgtcttgttggtgtggtagagataataagagaggatcatagtagtgctagaaattgaagtgtgtaatagaatagtgatagagagagagagatatggggagaggaagggtgcagttgaagaggatcgagaacaagatcaataggcaagtgacgttctcaaagagaaggtctggtttgctcaagaaagcacatgagatctctgtgcattgtgatgctgaagtggccctcatagtcttctccaccaaaggcaaactctttgagtactccagcgatccctgtatggaaaaaattcttgaacggtatgagaggtattcatatgcagagaggcagcttgttgcaagtgatcaaccactaactgaaaattggactctggaacatgcaaagctgaaagcaaggttggaagtcctacagaaaaatcaaaggaattttatgggacaagatttggagggcctaagtatcaaagagcttcagaatttggagcatcagcttgaaagtgctctcaaacacattagatcacggaagaaccaactgatgtatgaatctatttcagagcttcataaaaaggataaggccctacaagaacaaaacaacactctcgctaagaagataaaggagaaagagaaggcactagcccaacaggcacaactggagcgacttggtgatgaagtggatctgacttcctctgcccttgttccccaaccactggtgacatcaaacattagaacctcctcacaaatcagaggtgaaggagataacgaaggaaccccaactccaacccaagctaatgccattcttccaccttggatgcttcgtcctacaaatgaatagaatactatttaattaatgacataaagttttaatcaaattaaatatgaatatggccaatacaaagctcaccctacaagatgtaaaatggtctagtgtgttgatttgggaatggcacccggtgacttgaccagttggaatatcaacgatatgtaatatgtctgtgactaccacatttcaaggatgcttagtaaattatatggtatggcctgtctatacaggcctacaatacatatatagtgtcaattatgtatgtttggttcttatcaaaagtttaagttgtgctagaaactacgatattgggcgatgttagatccctcaaaatctatgattttttacaacagaaatattaaattttgtatgaactaatggttttatctaagtgttacgagaatacatgggctgtatt

SEQ ID NO: 725 - DNA, 1094 bp, Glycine max
ccacgcgtccgcggtcgcgtgggaaaaaagccttgactaatagtccataccataattttcctctttcctctgtgcctcgcttcttcttgaatccatgcgcatgagtttgaagaattgtgttagcggtgaggtgagatatttcaatatttgataattgatagtatatatatggggaggggaagagtggatttgaagaggatcgagaacaagatcaataggcaagtgactttctccaagagaaggtctggcttgcttaagaaagcgcgcgagatttctgtgctgtgcgatgctgatgtggctctcatcgtcttctccactaaaggcaagcttttcgactactccaacgaaccttgtatgaaaagaattcttgaacggtatgagaggtattcgtatgcggagagacaacttgctggagatgatcaaccaccaaatgaaaactgggttatagaacacgaaaagctcaaggctagggtggaggtactacagagaaatcaaaggaattttatgggagaagatctggacagcttaaatcttagaggacttcagagtttggagcaacaacttgattccgctctcaaacacattagatcacgaaagaaccaagccatgaatgaatctatttctgagcttcagaaaaaggataggacactccgtgaacacaacaacttgctctccaagaagataaaggataaagagaaggagctggccccacaagagcaagatggactgcaaaataacatggatgtgacctctgtccttgtaactcaaccaccggagtccctgacaattggaggcttcccagaagccaaatgtaatgaagaaactccaacgtcgagtcgacctaaaaccattcttcccccttggatgcctcttcctacaaatgaatagaaagcctgttaactcttgttaaatacgaataccacttgtacaaagactagctatatacatcatcaggggcatttgatggtgactataccacctggattgtaatctctgtgtgacgtttctgactgcattttaatgcagctgcaaggtatattaaatgtactacatataaatacaaatgatactgatataaaattgagtttgaaaaa

SEQ ID NO: 726 - DNA, 531 bp, Glycine max
gaagaagaaagatccgtaaattaacattctctccctcccttcgctataatagcaagcttttcaagcatatttctggggtttggtcccttttccttgtttggggttttcttgggaaaaaagaagtaattaggtataataatagtataactaaagcaaaaaaaaagacagtaatatgggaaggggtagggttcagctgaagaggatagagaacaagatcaatcggcaggtaactttctccaaaaggagagctgggttactcaagaaagcacacgagatctctgtgctctgtgacgctgaggtcgctttgattgtcttctcccacaaaggaaagctctttgaatatgccaccgattcttgcatggagaagatactggaacgctatgaaaggtatgcctatgcagagagacaacttgttgcaaatgattccgagtcacagggaaattggaccattgagtatactagactcaaggcaaagattgaccttttgcagagaaaccataggcactatatgggagaagatttaggttcaat

SEQ ID NO: 727 - DNA, 1414 bp, Oryza sativa
cccgggctgcaggaacgggctgcaggaattcggcacgaggctctcctcctcctcttcttcttcttccactagctagttcgtcttcctccttcagctagcttgtagcagctaaggttaggtcggatcgagatcgggatcggccgccggcgagcggcgagcggcgaggatggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggatggacaaaatccttgaacgttatgagcgctattcatatgctgaaaaggctcttatttcagctgaatccgagagtgagggaaattggtgccatgaatacaggaaacttaaggcaaagattgagaccatacaaaaatgtcacaaacacctcatgggagaggatctagaatccctgaatctcaaagaactccaacagctagagcagcagctggagagttcattgaagcacataatatcaagaaagagccaccttatgcttgagtccatttccgagctgcagaaaaaggagaggtcactgcaggaggagaacaaggctctgcagaaggaactggtggagaggcagaagaatgtgaggggccagcagcaagtagggcagtgggaccaaacccaggtccaggcccaggcccaagcccaaccccaagcccagacaagctcctcctcctcctccatgctgagggatcagcaggcacttcttccaccacaaaatatctgctacccgccggtgatgatgggcgagagaaatgatgcggcggcggcggcggcggtggcggcgcagggccaggtgcaactccgcatcggaggtcttccgccatggatgctgagccacctcaatgcttaagatgatcatcgtcgtcgtcgtcggccaaacagctgccgtatgcaccgtgaatcatgggagcaaccttgaatgaattgaagtcattggtatcgatcctagcgataatatatatgattctcctaaaatgaaattgatctcaaaaaaacaaacctagcgattaagctattcttatatatgtgtttgcctgctgccccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaaaaaaaaaaaaaaaaaaaaaaaaacataaaaaaaaatacaaccgaatcaatcgttttataaaaaaaaaaaactttataacgt

SEQ ID NO: 728 - DNA, 1130 bp, Oryza sativa
cccacgcgtccgcgggctccccgggctccagcttccccgagctctccaccctccacccgccaccgccgccaccgccgccttcgccgccgccgccgccgccgacgacgatggggagagggccggtgcagctgcggcggatcgagaacaagataaacaggcaggtgaccttctccaagcggaggaacgggctgctgaagaaggcgcacgagatctccgtgctctgtgacgccgacgtcgcgctcatcgtcttctccaccaagggcaagctctacgagttctccagccactccagtatggaagggatccttgaacgctaccagcgttactcgtttgatgaaagagccgtactggagccaaatactgaggaccaggaaaactggggtgatgaatatggaattttgaagtccaaactggatgcacttcagaagagccaaaggcaactcttaggtgaacaattggacacactaacaataaaagaactccagcaattggaacatcaactggaatattctctgaagcatataagatcaaaaaagaatcagcttctgtttgaatcaatttctgagcttcagaagaaggaaaagtcacttaaaaaccagaataatgttctgcaaaagctcatggagacagaaaaggagaaaaacaatgctataataaacactaaccgggaggagcaaaatggagcaacaccaagcacatcatcaccaacaccagtgacggctccagatcccatcccgacaacaaataacagtcaaagccaaccaagaggatcaggggagtcagaagctcaaccgtctccggcacaagcaggcaacagcaagcttccgccatggatgctccggacaagtcacacatgaaggcatctgttgatctcaaacgtcactccactcaatggccaacatcaacatgtttcttccaactaaggcagccactgttgtgcaatccatcttccagcgatattgatatatcggcattcggcatagccaatatatattaatgtaatgtatcttgtcaaagcttcatagggttaatgacgccttgagcttctctgttctatatctgtcttgtaacgatctttgcatatctgctgcatttttttttctctctgatcgatgactcgtccttggtcc

SEQ ID NO: 729 - protein, 260 aa, Oryza sativa
MGRGKIEIKRIENATNRQVTFSKRRGGLLKKANELAVLCDARVGVVIFSSTGKMFEYCSPTCSLRELIEHYQTVTNTHFEEINHDQQIFVEMTRMRNEMEKLDGGIRRFTGDDLSNLTLADINDLEQQLEFSVTKVRARKHQLLNQQLDNLRRKEHILEDQNSFLCRMINENHHQAAVGGGDVKAMVEMAPVLSMLTAAPAYYGEESSSTALQLTPPLHAVDAAAAAGFRLQPTQPNLQDPGCSSSSFHAAAAGHGLQLW

SEQ ID NO: 730 - protein, 268 aa, Oryza sativa
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKITTKAVLEVKPFCLHSSEQLMETEKEKNNAIINTNREEQNGATPSTSSPTPVTAPDPIPTTNNSQSQPRGSGESEAQPSPAQAGNSKLPPWMLRTSHT

SEQ ID NO: 731 - protein, 320 aa, Oryza sativa
MGRGKVQLKRIENKINRQVTFSKRRNGLLKKAHEISVLCDAEVAAIVFSPKGKLYEYATDSSLTILLIIKESVNTYTYGYRIMGRMDKILERYERYSYAEKALISAESESEITLPQLTTCTASRSTHGICFQYCLMSKTLGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICSYPPVMMGERNDAAAAAAVAAQGQVQLRIGGLPPWMLSHLNA

SEQ ID NO: 732 - DNA, 3747 bp, Zea mays
ccacgcgtccgcccacgcgtccgcccacgcgtccgctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccaggtatacgtattcgatccccttgttcctgccggccggttgctacgatcgcccgctcggggtttgaagcgctgggtgtgcttcgacgcatgatttttggatcatttttcatgtgtcaatccgctgccggccggtttctatgttcgcccgcttggtgtttgtagtgctgggtgtcgacgcatgattttggaatcacttttcatgtgtcaatctgctgcgttcatcgaacttgtatggggattgagctgtgggaggtgtttgtagaacgtagacacatgcatgtatggttgttattacgtgttagttctatgtggattaattatagttatttccatggacactgctcggccggtcaacgatcgcttcagatgattcaaccgtggaatcatcgcttgctggttaattcgttcgtacgtacacagtggcatacgcaaattgagcgggatactgtagttttgcaaactgagaatgttatgagtagtggtgctggtgaatgtcaattagcccatgcaaattatgtcccaagctttgaggtgtgactgactaatggctagtatatagaaagtggtcaggattattatttggttcataaatactgtgaagaggtgaggatcagtcgctggaaggattctgattgccaaaatatatttttttcatcatgcgatcaaactcttcagtatcaagtaggtgtattatttcagcataatttattgcaaaggaaacacttcttttgtcttttgcatgcatgatgaaggatatgcttatcagtatctctatggtggtgtttggttcattgcatggagtggttaacgtaacctgaacggatcccacgactattggttacagtgcaacagagatacgtttggttagttaacgtcgaaaagatatggctccgtatccatttgtgaatcgttacggactgacccaaccaaacagaaaagaaagggaatagatggatcacagataaaaatgtcataccaaacagcctctatactattttctgcttcgatgttccttgtatatgtgcatcttgtcgatttttcagatagcctgtgataaatgtgcacaaatttctatacaaacagctgttgtggtcatgctgtagaagattcatatggagaagtgttattaattatctgaatattttcagaaattccagaagaacaattctgctcttgtgtggtgtctctgattcatgcatgtgtcatatattaagagattgtccctgttccacattttagtattatataaacggtatacaaggtgatcataatatttaaacattagtttgattttttggcacatatttcattacagtttcaaatatggttccttaaacaacacggctatcttagaaaatagatgcttgattatagcaaaaattgaccttatgctgctataagttagattctaggaggttaaattggcatgagtacatattctgaccatgcaacatattcatatataaccgatcgattcagggaaaatgtcactgagttaacttaccctccccacactggattatctgtaactctctagtgctggagacaaaatatgtatgttaaaaaataataagcacgttttagcttttgcacacgagtgatatgtgttggtgatatgatccgaagttgatagagattgtggcttgagtcaccgcaaaatttgatgacattttctttagctgaaactacaaggtcacccatgccggtactgaattctattttaaaaaataatatgatatggcttaatgcagatccatttttatatgttgtggattatcgaaaaccatgctaattacaactacgagtttgcattcgaaatatcaatagattcctacaaaaatgtgtatcactatgctttcgctaatttactaaagatgttacaaactttactggtcaaacccgacaaagacggtagatgccaaatcttttctaaagattatattagatcgatccacagattatagtatccaagtgatggaaaacattgtttgcacaaacaactgagtagctcgctacattttagagctatttttacatcattatttactcttgacttgttttattgttctaaaataccctttctgagttcatgtatgaactatatatgaagcaccatctgttcattaagtaatgacccacttatgtgtgcatgtgatgacagacgttgttccataaccatgcttgcatctagctatgcatgtgattcaaggttagctgtccaatgtcttttgcaattctggaatcgggagaatatacttgtatatatatatcttacatttatcaaatagggagaaattaaatcttgatatcttgaacgttgttcatcgtgaattttgtcgttttgtatgcaatactaatatacttcatctagtaatacaaaaggtacaagaaaaagaaaattgcacctggctatttgtcttaatatattatgctggaacatgacattgctatatgatacttcttttgcagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacctagagggggcgcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactactaataaagtcaggccccgtcaaatgctttacatggtgattgaagtctggagcttctcagcaccaccatatattgtgttcagttcttgtgtttattgccatagctaccttttttttctctgatctacgagctagacgtagctttgtgcttggagattccactactatgtttcctctgtcctgtgtatgctttaacggagatgcacgttgtacccgtggtaatatatataaatttgcgttgtaaaaaaaaaaaaaaaaaaag

SEQ ID NO: 733 - DNA, 1419 bp, Zea mays
caccgctttaaatccgcctcctcccagcgtctccctcctcccggcctgtcccctcacctcctccccctatctctccaccgccgcagctagctgtgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgggctaggatttaggttgagatcaggagagggagaaggcggcggcgatggggcgcgggaaggtgcagctgaagcggatcgagaacaagatcaaccgccaggtgaccttctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggtaaattgttgagcttgctaaagttggctgttcgaacttcctcttttaagaattgtatgatttctttagctggccattagatgggcatggtttattgcaagtgttaactactttggttgccttgttacatccacaaaatatctctgctcttgcgctgtgctgcgatgcattgttaccgcaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccacctgagctgctgaaggtttgctctcatcgtcgcagtgtgctagcccaaaatccagcaagtcttccccggaccccggactggccaagcttctccgcctggtgcagtatcgtcgtgatcgcgagaagcagcagcagcggtttgccgtattttttaccaccgtgtataagtagcatatctgcaatgtgtatattttgttcaccgttcctgctg

SEQ ID NO: 734 - DNA, 1152 bp, Zea mays
cctcgaggccggccgggcccggcctgccccctcacctccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgttttatctacacagactagtatatatgtggggaacttccacataccagaactgattgaaagagctagatacaatataatgcagtcagaaagtatggacaaaattcttgaacggtatgagcgctactcctatgcagaaaaggttctcatttccgcagaatatgaaactcagggcaattggtgccatgaatatagaaaactaaaggctgaaggtcgacacaatacaggaatgtcaaaagcacctcatgggagaggatcttagaactttgaatctcaaagagcttcagcaactagagcagcagctggagagttcactgaaacatatcagaacaaggaagagccagcttatggtcgagtcaatttcagcgctccaacggaaggtaaattgttgagcttgctaaagttggctgttcgaacttcctcttttaagaattgtatgatttctttagctggccattagatgggcatggtttattgcaagtgttaactactttggttgccttgttacatccacaaaatatctctgctcttgcgctgtgctgcgatgcattgttaccgcaggagaagtcactgcaggaggagaacaaggttctgcagaaggagctcgcggagaagcagaaagaccagcggcagcaagtgcaacgggaccaaactcaacagcagaccagttcgtcttccacgtccttc

SEQ ID NO: 735 - DNA, 833 bp, Zea mays
ggtccggccgggacggcctgtcccctcacctcctccccctatctctccaccgccgcagctagctgtgacgtcatgcactcgccggcgccaccgccaccgccaccgccaccgcatactatctacaattagccagccgtagccttacttatcctgtgtcaagcaaacctctcgcaaggaacaaggaaggaagctgcttgttttatagccgctgtcggcggcggcggctgaagcgacgtgcctgggctaggatttaggttgagatcaagagagggagaaggcggcggcgatggggcgcgggaaggtgcagctgaagcggatcgagaacaagatcaaccgccaggtgaccttctccaagcgccgctcggggctgctcaagaaggcgcacgagatctccgtgctctgcgacgccgaggtcgctctcatcatcttctccaccaagggcaagctctacgagtactctaccgattcatgcatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatggggagaggatcttgaaactttgaatctcaaagagcttcagcaactagagcagcagctgggagagttcactgaaacatatcagaacaaggaagagccagcttatggtcgagtcaatttcagcgctccaacggaaggagaagtcactgcaggaagagaacaaggttctgcagaaggagctcgcggagaagcagaaagaccagcggcagca

SEQ ID NO: 736 - DNA, 1340 bp, Zea mays
gtcgacccacgcgtccgccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctggggcggccgcacggtactttacgcatgtaatatatgtgcttcatcaaatcactttcactaccatagcatgtgccggtttgtggtagtttcatgtctcacataatgggtacacattcatatcccagtggtctcggttcttcaaaaaaaaaaaaaaaaaa

SEQ ID NO: 737 - DNA, 1433 bp, Zea mays
ctcgaggccggccgggctcccgttctgtcccctcacctccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggtaaattgttgagcttgctaaagttggctgttcgaacttcctcttttaagaattgtatgatttctttagctggccattagatgggcatggtttattgcaagtgttaactactttggttgccttgttacatccacaaaatatctctgctcttgcgctgtgctgcgatgcattgttaccgcaggagaagtcactgcaggaggagaacaaggttctgcagaaggagaaagcgttactcctgcatgcaggctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttccctgctggggcggccgc

SEQ ID NO: 738 - DNA, 1311 bp, Zea mays
ccggccgggatcccggtttcgctataccccctccccctccgatccgtcgcggcagcgctcatcaccgctttaaatccgcctcctcccagcgtctccctcctcccggcctgtcccctcacctccctccccctatctctccaccgccgcagctagctgcgacgtcatgcactcgccggcgccaccgccaccgcatactatctacaattagccagccgtaggcttacctatcctgtgtcaagcaagcctctcgcattcgcaagcaacaaggaaggaagctagctagttttatagctgctgtcggcggcggcggctgaagcgacgtgcctgggctaggatttaggttgagatcaggagagggagaaggcggcggcgatggggcgcgggaaggtgcagctgaagcggatcgagaacaagatcaaccgccaggtgaccttctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtgcaaaagcacctcatggggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctggg

SEQ ID NO: 739 - DNA, 1767 bp, Zea mays
  misc_feature (11)..(11): n is a, c, g, or t
ggtacccccgnggtccggccggggcaggcgcagcagcagcagcgtcagcgcccgaggcgcgcacgagagaaacagaggctgacgaggtggggcccgtgcgggccttgaccaatcggagttcgacaacagcctggccacccacaaaccacactccttcgcctcgcgccggccgtcgtcgcctccctccaccgaacgatccctcctcctcctcctcctcctcctcgcatcccaccccaccccaccttctccttaaagctacctgcctacccggcggttgccgccgccgcaatcgatcgaccggaagagaaagagcagctagctagctagcagatcggagcacggcaacaaggcgatggggcgcggcaaggtacagctgaagcggatagagaacaagataaaccggcaggtgaccttctccaagcgccggaacggcctgctcaagaaggcgcacgagatctccgtcctctgcgatgccgaggtcgccgtcatcgtcttctcccccaagggcaagctctacgagtacgccaccgactcccgcatggacaaaattcttgaacgctatgagcgatattcctatgctgaaaaggctcttatttcagctgaatctgaaagtgagggaaattggtgccacgaatacaggaaactgaaggccaaaattgagaccatacaaaaatgccacaagcacctgatgggagaggatctagagtctttgaatcccaaagagctccagcaactagagcagcagctggatagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcaggcagcagtgcagtgggaccagcagacacatgcccaggcccagacaagctcatcatcgtcctccttcatgatgaggcaggatcagcagggactgccgcctccacacaacatctgcttcccgccgttgacaatgggagatagaggtgaagagctggctgcggcggcggcggcgcagcagcagcagccactgccggggcaggcgcaaccgcagctccgcatcgcaggtctgccaccatggatgctgagccacctcaatgcataaggagagggtcgatgaacacatcgacctcctctctctctctctctcgtcatggatcatgacgtacgcgtaccatatggttgctgtgcctgcccccatcgatcgcgagcaatggcacgctcatgcaagtgatcattgctccccgttggttaaaccctagcctatgttcatggcgtcagcaactaagctaaactattgttatgtttgcaagaaagggtaaacccgctagctgtgtaatcttgtccagctatcatgtatgcttgttactgcccagttacccttgaatctagcggcgcttttggtgagagggtgcagtttactttaaacatggttcgtgacttgctgtaaatagtagtattaatcgatttgggcatctagtaactaaattaagggtgtgtttggtttggcttttgatttctaaaagacaaaagccaaactaaagagctggatccataaaatagcattttctaaaaaaaaaaaaaaaaaacgcgacagtcttctagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggg

SEQ ID NO: 740 - DNA, 1296 bp, Zea mays
gaacctcgccggcggccgcagccgcatagaccggaagagaaaggaagcagagatcggaggcaggcgaagatggggcgcggcaaggtgcagctgaagcggatagagaacaagataaaccggcaggtgaccttctccaagcgccggaacgggctgctgaagaaggcgcacgagatctccgtcctctgcgacgccgaggtcgccgtcatcgtcttctcccccaagggcaagctctacgagtacgcctccgactcccgcatggacaaaattctagaacgttatgagcgatattcctatgctgaaaaggctcttatttcagctgaatctgaaagtgagggaaattggtgccacgaatacaggaaactgaaggccaaaattgagaccatacaaagatgccacaagcacctgatgggagaggatctggagtctttgaatccaaaagagctccaacaactagagcagcagctggagagctcactgaagcacatcagatcaagaaagagccaccttatggccgagtcaatttctgagctacagaagaaggagaggtcactgcaggaggagaacaaggctctacagaaggaactttcagagaggcagaaggcggtcgctagccggcagcagcagcagcagcaggtgcagtgggaccagcagacacaggtccaggtccagacaagctcatcgtcttcttccttcatgatgaggcaggatcaacagggactgccacctccacaaaacatctgcttcccgccgttgagcatcggagagagaggcgaagaggtggctgcggcggcgcagcagcagctgcctcctcctccggggcaggcgcaaccacagctccgcatcgcaggtctgccgccatggatgctgagccacctcaacgcataaggagggcgagcaaatggcgtgcgaagtgattgattgctcaccgttgattgaacgatagcctaagttcatggcggcagcaaactaagctaaaactattgttatgtttgcaaggaagggtagggtaacccgctgtgtaatctttgtccagctagcatgtaccaactgagatgcatgcatgcttattattgtccaattacccgtgaatctagcggtgcttttggtgagaggccggccgggcgggtgcagtttacttcaaatatggtttgtgattttgtgtaaatagtattaactaggagtcctatggtaagtaaattaattaatgggaggatgcatgaataaaacctctcttgtgctgcaaaaaaaaaaaaaaaaatactagaagaaaacggaaacagccatactaaagaatac

SEQ ID NO: 741 - DNA, 495 bp, Glycine max
tccttgctgtgacaaagttggcatcaagaaaggtccatggacacctgaggaggatatcatccttgtctcttacatccaagaacatggtccaggaaattggagatcagtgcctactaatactgggttatcaaggtgcagcaaaagttgcaggcttagatggacaaattacctcaggccaggaatcaagagagggaacttcactccccatgaggaaggaatgataattcacttgcaagctctactgggtaacaagtaattctcaaatatcataattttctttagttttctcaacaaagttaaagagatcaatcaataccatgataattaaagttcacatacttttcattgattaattttgacaaagaaataactttttaatctataattttagcatatgatatgcctgaatttgtgaagttgttgacttttggagcagatgggcagccatagcttactatcttccacaaagaacagacaatgacataaagaattatt

SEQ ID NO: 742 - DNA, 1308 bp, Oryza sativa
gagagagacgaccgatcgatcgatcagctagctgcagcttccagaaagagtagttagctcgatcgatcgatccgggaaggatcagagttaattagtgagtgaggaattgtagccatgggccggccgccgtgctgcgacaaggaggggatcaagaaggggccatggacgcccgaggaggacatcatcctcgtctcctacatccaagaacacggccccggcaactggagatcggttcccatcaacactgggctgatgaggtgcagcaagagctgcaggctgcggtggacgaactacctgcggccggggataaagcgcggcaacttcacggcgcacgaggaggggatcatcgtccacctccagtcgcttctcggcaaccgctgggccgccatcgcctcctacctcccccagcgcaccgacaacgacatcaagaactactggaacacccacctcaagaagaagctcgccgccgccgccaactccacttcatcctccaaccgccaccccatcttcgccgacgccaccttcccctccgccgccggcggtagctacacggtgagcagcaactccgatgtcacccagatggcagccattgctaggcgctcccccttcgccgactgcccatcctcctcatacgcctccagcatggacaacatctccaagctgctcgacggcttcatgaagaccaactccccgtcgccgccgccgccaccgctgcagcactatgacagcggctattacgacgacgtcaagcccgccgtcgatgtcggcggcaaccccttgctgtcgtccttcgactgcatgtccggcgccgacctggactgctgcttcgacgttcatcagcagcaccagcagcagcagccggcgtcgttcatggagtacggcggctatggcggcggctacggcgacgagagcaagcagcagctgatgaaccaggcagctccgccgctgtcatcgatcgagaagtggctgttcgacgaggcggcggcggagcaggtcgccgacctcatggacctctccgacggttgctgctccgtcccaatgatgttttaattagctcaagtaatgaaagaaaacactgtcacattcgatacgtatactgtgcacatcaataattaattttacattaattagctagatgcatgtttaggttaaactattgttgttactatacttgaagctagaagatttgttttatttgtagttttggatgtgtgaccggttgtacgtgtgtcactggcatcaaacgtcagcacaagaataagagatatcaacaggaattaaaaaaaaaaaaaaaaaaaaaaaaaaaaa

SEQ ID NO: 743 - protein, 311 aa, Oryza sativa
MGRPPCCDKEGIKKGPWTPEEDIILVSYIQEHGPGNWRSVPINTGLMRCSKSCRLRWTNYLRPGIKRGNFTAHEEGIIVHLQSLLGNRWAAIASYLPQRTDNDIKNYWNTHLKKKLAAAANSTSSSNRHPIFADATFPSAAGGSYTVSSNSDVTQMAAIARRSPFADCPSSSYASSMDNISKLLDGFMKTNSPSPPPPPLQHYDSGYYDDVKPAVDVGGNPLLSSFDCMSGADLDCCFDVHQQHQQQQPASFMEYGGYGGGYGDESKQQLMNQAAPPLSSIEKWLFDEAAAEQVADLMDLSDGCCSVPMMF

SEQ ID NO: 744 - DNA, 648 bp, Oryza sativa
acatcatcctcgtctcctacatccaagaacacggccccggcaactggagatcggttcccatcaacactggtacgtcctaattccccaattctgtgtagtttcttactttcttttgtagatgaactatagctagccaagtagccatggtgatcgatgatgaactgagaagaagctgaagctgtgggtggatggatggatgcagggctgatgaggtgcagcaagagctgcaggctgcggtggacgaactacctgcggccggggataaagcgcggcaacttcacggcgcacgaggaggggatcatcgtccacctccagtcgcttctcggcaaccgctgggccgccatcgcctcctacctcccccagcgcaccgacaacgacatcaagaactactggaacacccacctcaagaagaagctcgccgccgccgccaactccacttcatcctccaaccgccaccccatcttcgccgacgccaccttcccctccgccgccggcggtagctacacggtgagcagcaactccgatgtcacccagatggcagccattgctaggcgctcccccttcgccgactgcccatcctcctcatacgcctccagcatggacaacatctccaagctgctccgacggcttcatgaagaccaactcccc

SEQ ID NO: 745 - DNA, 465 bp, Zea mays
  misc_feature (383)..(383): n is a, c, g, or t
ccggccgggccgggctattcaaaattcaacttaacctaaaccgaacgaacaaggctagaagctagctagccaagttattagctactacatactagtggccggccggacacgatcgatgggaaggccgccgtgctgcgacagggcgggggtcaacaaggggccatggacgccggaggaggacatcgtcctggtgtcctacgtccaggagcacggccccggcaactgtgcgccgtgcccgtcagcacgggcctcatgcgctgcagcaagagctgccgcctccgctggaccaactacctccgccccggcatccggcgcggtaacttcacaccccacgaggaaggcatcatcgtccacctccaggccttgctaggcaacagatgggnggccattgcttcttacctcccgcagagaaccgacagcgacatccagaactactggtacccccaactcaagaataagatccgg

SEQ ID NO: 746 - DNA, 858 bp, Zea mays
ttgggaccctcgaggccggccgggagggagaagagaagggagggcgaggccactggctgtgtaggcagcagccagccacacagacacagcttcgttcccatctcttctcgttcttcatcacctacttgcctactatatctactagccacgctagctagactagccttagacgtagctagctcactagctgcttgctaggtgtgtaccgatcgtccgaggtaggagacacagcacgcagcaggggtatggggaggccaccgtgctgcgacaacggcgtcggcgtcaagaaagggccttggacgccggaggaggacatcgtcctcgtctcctacatccagcagcacggccccgggaactggcggtccgtgccagagaacacagggttgatgaggtgcagcaagagctgcaggctgcggtggaccaactacctgaggcctgggatcaagcgtggaaacttcactcctcatgaggaagggatcatcatccacctccaggcgttgcttggcaacaagtgggcagccatagcctcctacctccctcaaaggaccgacaacgacatcaagaactactggaacacacacctcaagaagaaggtgaagaggctgccacagccggcagccgactccttcccagacaactgcctccaatgcagtcacctgcagcccaaactactacagccccagcagcagtcaccacagcctcccaggaatgcagccgatgagcagctacccccacaccacctgcagcggcggagccccaagcaacaatgaggcgacgactggatactactaccggcgtcgtctcccactctccccagcatggatgagggcatcaccagcagcagcgacagctaactgc

SEQ ID NO: 747 - DNA, 842 bp, Glycine max
ttcggctgcgagaagtcgaccgcaggcgctcaccgcgtctgatatttttcatacaacacattctttctagacacgcaacacctagaagatttccttattctttttggtgctaaaccgttgggatatagcaacaacatgttaggaatgaagagacatagagataatgaagggtcagagagcttagatttggcaaaatgtcttgtgctgttctcttgtccaatagaaagcaacaaggcacaacagaaaggttttggggctgtggaatttgagtgcaagacgtgcagccgcaagttctcttcttttcaagcactgggagggcacagggcaagccacaagaggcagaagctagagggggaagaactcaaagaacaagccaaaactcttagcttgtggaacaaaccaaaaatgcacgagtgctccatttgtggacttgaattctctctgggccaggctctgggtggccacatgagaaaacacagagctgctctcaacgaagggtttcctataattccttctatcgaccaagttattgcgaaaatcccggttctgaaaaggtcgaatagcaccagagttatgtgcttggacttggagttacacctgtagagaatgaatgactgaactaccaagtcacccaagctcctttttctttgttcttattaacttttctacattttttacctgtttctggacacatgtattctttcattttttgtgtgaaaattttattgacttttcccttatagatgattgattctttattctggacacatgtattattttgttaatacgattatcaaaagttcttagtgttttaataaaaaaaaattttcccccgcggccgc

SEQ ID NO: 748 - DNA, 870 bp, Glycine max
tacggctgcgagaagacgacagaaggggatccatcgaaattctagacacacaacacataaaagatttccttgttctttttactgcttaaccgttcggctatctcatatatgaacaacaacatgttaggaatgaagagacggagagatgataatgaagggtccttggatttggcaaaatgtcttatgctgttttcttgtccaatagaaagcaacaagacacaacagaaaagttttggttctgtggaatttgagtgcaagacgtgcaaccgcaagttctcttcttttcaagcactgggagggcacagggcaagccacaagaggcagaagctggagggggaagaactgaaagaacaggccaaaagtcttagcttgtggaacaaacccaaaatgcacgagtgctccatttgtggccttgaattctctctgggccaggctctgggtggccacatgagaaaacacagagcttccctcaacgaagggtttcctattattccttctatcgaccaagttattgcgaaaatcccggttttgaaaaggtcgaatagcaccagggttatgtgcttggacttggagttacacctgtagataatgactctgtgcttggaatcaactatgaaatcaccacctcagcttctttttctttgttctgactaactcttttttacctctttctggacacatgtagtattctttcatttttgtgtaaaaatttcattgacttttcccttataaagatcattgattctttatttgttagcacctttggttctcacatattatttagttggtgttggctaaccggtacgtcataccaccgattatcaaaaagttctgaatgttttaatagtattgatttttaattattttttt

SEQ ID NO: 749 - DNA, 496 bp, Glycine max
atactacacaattcacaatcccaacacccattttggagaatcagaatctaactagccaatagccatgaagagacagagagagaacgaagtaacaacgttggaaagctgggacatgcaaatttgttcaacttcaatcacacccgacacaagtgtttccagttccaccatatctccggaagatgtatttgagtgcaaaacgtgcaaccgcaagttcaactcttttcaagcgctgggtggccatagggcttgtcacaacaagagggtgaagatggaaggtgaagaacaacaactcaaaacaagggcaaaatatctgggtttgggaaaacacagtgagcccaaaatgcataattgctccatttgtggtcaaggtttctctctgggccaggccttgggaggacacatgagaagacacagagcttcgaccaacgatgttttctcttccataaaccaggttgttgcaaaagtttcggttttaaaaagatcgtgtaatgacaag

SEQ ID NO: 750 - DNA, 752 bp, Glycine max
ccacgcgtctcattcacaacacaaacacattcaacaacatggtagcaattctcaagagacagggagaaaacgaatccgaagaaaccatcataggcttggcaaaaagtctcatgcaactctcgcgtgtccaacaacaaagcaataagcctcttctcaaaaccttttctccaacggagttcgagtgcaaaacctgtaaccgcaagttttcatcttttcaagctcttggtggccacagggctagccacaagaagcccaagttcgaagctgaagaactcaaagaagaagccaagaagactaaacccaaaatgcacgagtgttcaatttgtggcatggaattctctctgggccaggcactggggggtcacatgagaaaacacagaggtgccattagtgagaacgacaataataatgaagcgttgtcttctataaagcaagcaattgcaaaagctccggttttgaaacgatcgaatagcaagagggtcatgtgcttggagatggacctgaatttgacgcctttggagaatgacttgaagttgttgttcggaaacaaggctcctagagtcgatctttctttgtagaggattaattgattattcctgtatctttcgattcattatttgtgtaaaaatttagtgttatttgacttcttaatttcagttcttcgtgtaggacgatttattttgaaattgatttcgctgtatagtttgattgattaattaattaggaatattgatggttgatcggagtttcgt

SEQ ID NO: 751 - DNA, 713 bp, Glycine max
cgttcacaacacaacacaaccaaatccaacatggtagccattctgaagagacaaagagaaaccgaagccgaggagagcatcataagactggcagaaagtctcatgcaactgtcgcgagtccaacaaaaaagcaagcctcttctcaaaaccttttctccaacggagttcgagtgcaaaacctgtaaccgcaagtttccatcttttcaagcccttggtggtcacagggcgagccacaagaagcccaagttcgaaggtgaagaactcaaagaggaggccaagaagggtctgagtttggggaacaaacccaaaatgcacgagtgttccatttgcggcatggaattctctctgggtcaggcactggggggtcacatgagaaaacacaggggtgccaccagtgagaataataacgaagcgttttcttcttctataaagcaagcaatttcaaaagttccagttttgaaacgatcgaatagcaagagggtcatgtgcttggagatggacctgaatttaacgcctttggaaaatgacttgaagttgttgttcggaaacaaggctcctagagtcgatctttctttgtagaggattattaattaattcctgtattctttggattcattactattgtttaaaaaattgtcattgacttctttcagttcttcgtgtagatcgattagttttggaattgatttcgttgtatagttgattgattgatt

SEQ ID NO: 752 - DNA, 816 bp, Glycine max
ttgattgtgaagaaaataaaaaccaattctcacgttaaaaaaaattaaagaatacactacaagacttcaaaaacaggactactaactaaatacaaattctcaccccgaaaaagaaaaaaaaaaaactaaatacaaatcagcgttgatcacaaaactgataacaataaagaatcaggcaaaggcaccagcattcggtgccatctttccaaacaacaacttcaagtcgttctcaagcggtgttaggttcaagtccaagcacgtaaccaccctcgtgctattcgatcttttcaaaacaggcatttgtgtaataacctgttttattgaagaaaaatcttcgtggatggttgttctgtgccttctcatgtgacccccaagtgcttgtcccaatgagaattcttgtccacaaatggaacactcgtgcattttgggtttgtttgccaaacttagagatatagcatgtgctttgagttcatgatctccctcaagtttcgaccttttgtggctagccctatggccacccaatgcttgaaaggaagagaatttgcggttgcatgtcttgcactcaaattccacagcctcaatttttttttgaagtagtttctcattttgttggggatgagagagcatcattagacaatttgccaaatctatgctctcaaaccccttgaaatctctctgtctcttcatggatacgtacgaagaattaattacaatatggaatgtaataaattaatgagagtgtgtaaacaagaatttagaaaaatgagatgtgattggtgacaaaatgaatatttgagaatgagttgtgctcgagcc

SEQ ID NO: 753 - DNA, 1088 bp, Glycine max
gtactaagtgaaataaataattcgcttgaaaaaataggaagtgaatatgaaaatgtacactatatgaagctgaaacagccatgatatgcctttaaacggcgcgtcaagcctgaacaaagagactactattagactcacagtcacagaatttcaagccgagccgagagatgagggcgcagctggcgcaagactaaggtgcaagtccaagccccatgcatcatcaaatttgggcccactgtcacctttggaaaacctactcaaagagggcccatcaatcctagcgtggtgggcccgggcctgaacctgcaccgttgacaaagctaatgacgaagaatctcctacaacgccaacatagggaaacatcccagcacccgcagatttcacacccgttgttatggtcacgttattactattattactactactgctgctgaagccgttgttgttgctgttgccaggcgccgacgggaacgcacaaccgtgcgacactgacacgtggaagggaggaggcgcggcacgtggtggcacgtacacccacgagggaggtgccgccgggaccaccacggtccccggcggagccagaaggtgcggcggaggggcgaaggcggagatcatcggattccgaacgaacgaaacggcggcgtttcgggaggcctgtaactgcgcccgcttcagctgctgacgctccttcttgtgcgcgttctggtgtccgccaagtgcttgtgaatttgcgaactctcggcagcagtattggcactcgtatttccggtcggcggaggaaggtggtccggcaccggcgacggaggagtccggcgagtcagacggggaagaaggggaagtggaagaagtgaccttggtggtggagtctgccacgtcatcatgcgccacctcgtcttcgtccatgatgtcttcgtggtgtacgctgaaaccgaagagcttcaagcgcgttggggaagtggggtttgtttttttagtgttgtagtcaagttgggtggtttccatgagaaggaaggaaggggtagtagtgaaagtgtggaacaagaaagaagggtagttaatgtgtttcccgagccggatcgggctcgagc

SEQ ID NO: 754 - DNA, 1020 bp, Glycine max
  misc_feature (935)..(935): n is a, c, g, or t
cccacgcgtccgtacggctgcgagaagacgacagaaggggattgctaaacaaaagaagcatgtctaatcatcatcacgtagttcagacctcgccaccgaaactattcggtttcccactaacagagcaggaggaattgaattcagatgcagaaagaaaatacgaggttggagaggacagaaaattcagatgccactactgcaaacgagtattcggaaactctcaggccttagggggccaccaaaacgcccacaagaaagagcgtcagagggcgaggcgtttccaaatccacactcatagacgctccattgcagcaccatcttctgcttctgttctcaactcacatgcaataataagatcagtaccttcagttacagttactacgctaccctcctccatttacttacgaggaggccctcctactacttcttctcttctacccatcttccatcctcgtcaacccaataacactaagcacttcccatcacggcccattttgattccttcttccacctaccaccgtgctaattgcactccatcctttccttttcagctttatgcctcaccctctgtactgcaatctgctcctaacgtccgtgatttttctgctgagagcagggaagttgatgtccatctcaaattataactcttagattgattattattaatttttttagtgctagtttctagctgcttcagccttctttgctccaaatagatcttatctttttttctcgccccttcagattatgcgagcttgctttaccaattattggctcgaatagttaaacagtactttccagagtaggagctagacactgtagtgtggtaaatcccccagtccttatatttcattttactactatatagccaaaacttgcatgtaaatcagatcagcaaaaaaaaaaaaaaaatgaaacattagcattccctgctnaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 755 - DNA, 676 bp, Glycine max
tgccactactgctgccgcaacttccccacctcccaagccctcggcggccaccagaacgcccacaaacgcgaacgccagcacgccaaacgcgcgcacctccagtccacgatggtgcagggcagcaccttctccgacgcgcaccatgtctacaatctcatgaactaccgctacggttcttccattccaacaccaccaccaccaacaatgccttatccaacatggaacaacaacaacaacaacacgcgcttctacggaacaacaacaacgacgtcgttttctcaccaccaccaacaccaacaacaacctattaacggaagccccttagcattttggcgaattcctaatggcaccaccattaataataataaccctagtttcagccacgagcgttcttcgacgttgccgcctttgttcgcgactgaggaaatagcgaacgtgagagcctcctcgcaggttgttgtcggagcctcggggccgatgacgacgcaaaaccgctacgtgtatgactcgaaacaacgcgaccatgtgagtttggatcttcatctgtaatagtagtaacatgtttcatgttttcgtacatagtattatcatgagccagtaataacaactctattatgatgatgatgatggcatggcgctacgagagaatcgagggatttgcaggcagcgactcttt

SEQ ID NO: 756 - DNA, 882 bp, Glycine max
tttttacttattaaataaaatttacattcacatacaattcagagtacaaaggttgctattaacaagtcgatacttttaaggaagattttatgtttgagtacctgaagaaaaaaaatatgaccgagaagagattcactaaagtgacttgtcaggttcaatctttatagcagagacacaccaacaacatggtgataaaaagaaaaaagaaaaaaaaaatagaaaagctgctacacatttggtgctaaattgaatgaaaaaactgattcacaaaactcacaggctaagatgcaaatccaaacctaaccctcgttcacgaccaccaccactaccttcacccccgttgaagccaccgaactgcggcagagggtggcggtgaccatggccatcagtgatggaggcaccagctgctgcaacatagattcgtcttccagaagccacaaaggcagctcctgaatgatatgcaccaccatgtggtgtgcataaccacgacaaaggtggctgagactgtggtgagaagcttgatatgattgtgttgtgaatctgtgaagaaacaaaaccacgagcagcttgcatttgggcacgtttcaagagctgtctttctttcttgtgcgcgttttgatgccctcctagtgcctgtgagtttgcaaattctctgcaacagtactgacactcgtactttcttgaactgaaaggctcagaattcgaacctgcttcatgagtttgatcttctggggacttgctaatgttgatgccaaagagctttaggggttgagtgttagtattggattttgcatggtattcaatttcagccatgatgaattgtgtgagggaaaaagaaaagatgcaccaaaatatgtggttaagtagtaacagcggctcgag

SEQ ID NO: 757 - DNA, 619 bp, Glycine max
cggttcggaatttccggttttacttacgcgtccgccactcgtccgcccacgcgtccgcactaacagaggaggaggatttgaattcagatgcagaaggaaaatacgaggttggagaggacagaaaattcagatgccactactgcaaacgagtattcggaaactctcaggccttagggggccaccaaaacgcccacaagaaagagcgtcagagggcgaggcgtttccaaatccacactcatagacgctccattgcagcaccatcttctgcttctgttctcaactcacatgcaataataagatcagtaccttcagttacagttactacgctacccttctccatttacttacgaggaggccctcctactacttcttctcttctacccatcttccatccttgtcaacccaataacactaagcacttcccatcacggcccattttgattccttctttcacctaccaccgtactaattggcactcatcctttccttttaaagtttatgccttaccctttgtactgcaatcttgttctaacgtccgtgatttttctgctgagaagcagggaagttgatgtccatcttaaattataactcttaggatgatcattattaaattttttta

SEQ ID NO: 758 - DNA, 531 bp, Oryza sativa
cgatgtggtggtggtagttgaagaggccgtacatgtgccccggcatgtagcggtgcatggcgagggaggcctggaggtgagctcgcttggcgtgctgccgctccctcttgtgcgcgttctggtggccgcccagcgcctgcgacgtcgggaagttgcggcagcagtagtggcactcgaacttgcgctccgccgccgccgtcgcggcgccgccgttcttggtgccgccgttgctgccctctgacgtgaccgtgctgccgttggccgcgtcgggggagcctgcaccggcctccgtgggccgcagctgcaggtcgttggagaattcgcagccgaacagccggattgtgtcccgcgcctgctgctgcggcggcggcgccggccggatgaacggcagctgcgagaacgagtcgacgctgcgcatgtcctgcggcttcgccatggccgtctaaccaaccaaccaagctatctgcttctacgtgaaccaaaaccaagaattccaccacccaactcggggcattcttgctagctgctgcc

SEQ ID NO: 759 - DNA, 463 bp, Oryza sativa
  misc_feature (439)..(439): n is a, c, g, or t
  misc_feature (452)..(452): n is a, c, g, or t
ccatttctcatcactgagctgagctcagttcagttcagttcatggaagtatatctccttcttggcttcatttgacaacttccaacacaagcagaacaaggtgatcaaatcatcctcaaggcttgtcttttttttccttctctggttatctccaatggaggctcccccttctctttccatcgtcgacgaagacggcttcgtcatcgacctctcgctgacgctgggcctgacatcgcctccgccctctccaggcggcgcgtctccttccattcctccgggaagaggcggcggcggcggcacgagtggtggtgacaacaacagaggcagcagaggtggtggcaatggtggtggtggtggtggtgtgaagctcttcccttgcctcttctgcaacaagaagtttctcaagtcgcaagcgctaaggggacaccagaatgcacacnagaaggagaagancgtcgggtgga

SEQ ID NO: 760 - protein, 242 aa, Oryza sativa
MAGVVQTVQCDQPSKQQLTEAAEAAAAAAAAASLRIFGYEVGGGGGGGGVAAAAGARREAADVVVGAGRRFECQYCCREFANSQALGGHQNAHKKERQQLKRARLQLAVAAAGTPAGMGFAAAQAPAPPPGHVIAVGHHAGSVASYALPRWVYLAAHHLQPPAVGLPFHATVQAAAGACHGGGDVETRLLSVAAAGRGSSTAGSSAHSYEVCAPAAPADDSDEEASAMGLDLHLSLAPASSA

SEQ ID NO: 761 - protein, 267 aa, Oryza sativa
MSMTSPRLKLFGFDVSEEETAEHEEQYSAEPESAPVCGGNGGGGGGGSDSSSSSTTTTTTATAGGDGRRYECQYCCREFANSQALGGHQNAHKKERQQLKRAQLQAAAAAAGRVAGGAAALYPRANPMVSAFAPTPHLLGGGEAGPTSWVYFSPRAAAVAGGAQGQQFHVSHGCVFPARGAGPAAVAAASPAVFSYTPATSAAAVAAASAPYVTTDEHHGRRIHASSAASLARYPGPAMVVAEPVATVPEDTCLGLDLQLSLAPAGL

SEQ ID NO: 762 - protein, 128 aa, Oryza sativa
MSMTSPRLKLFGFDVSEEETAEHEEQYSAEPESAPVCGGNGGGGAVGSDSSSSSTTTTTTATAGGDGRRYECQYCCREFANSQALGGHQNAHKKERQQLKRAQLQAAAAAAGRVAGGAAALYPRANPM

SEQ ID NO: 763 - protein, 279 aa, Oryza sativa
MAKPQDMRSVDSFSQLPFIRPAPPPQQQARDTIRLFGCEFSNDLQLRPTEAGAGSPDAANGSTVTSEGSNGGDGGTKNGGAATAAAERKFECHYCCRNFPTSQALGGHQNAHKRERQHAKRAHLQASLAMHRYMPGHMYGLFNYHHHIGGRFDHHPPPPPPPPPPAHYPMWTSAAPGAFAGPGSMAQPINGSPVQAGLWSVPPPTENFGSTAGRQGADKLATTVAGTPAAGEVACKDEMVPMSLLSSSPSLSSCSSTSPEMLGRCELGQKEGVSLDLHL

SEQ ID NO: 764 - DNA, 824 bp, Zea mays
  misc_feature (731)..(731): n is a, c, g, or t
gccggccgggccgggatcagagcagctcgcaccatgccaacataccaccataaacgcaacagcagccgggcagtcgagagaactcctggagccgtgggtgcctgggtggctagctgtaggtcttccttcttgcttccctacacatccgatcccttaccctaggggcacatctcgcgctcttgcgctgcgacggcgaattggcaatgagtgagcaagacgggcagcacgtcgggggcagcccgccggacgcggccatcgagtccttctcacagctccccttcgtgcgccccaagcccccgcagccggcgtcctcgtccagtccgtcgtcgatccggctgttcggcttcgaggtcccacccgacgccgccacgtcctccaccgcaaccagtgacgctaccgccgccagcgccaccgtagcgggccaggcggcggcgtcgggcgcggcgggtgcaggtgcaggtgcaagcgatggcaccggcggagggcgcaagttcgagtgccactactgctgccggaacttcccgacgtcgcaggcgctgggcgggcaccagaacgcgcacaagcgggagcggcagcacgcgaagcgcgcgcagtaccagagcgcgatggccatgcatcacgcccactacccaggccacccccacgcggaccccgccttcactagctaccaccagcagcagcgcttcggcatggcgcgctacgagcccccaccgccgggaccgccgccgcantaacccctcgtggtccccgcaggctgctccgccagtggtgccagatactacgggaggggctgctccctgtcgcagcccatcacggcaccccat

SEQ ID NO: 765 - DNA, 1414 bp, Zea mays
tacctcgaggccggccgggccttcagctcctcgctctcctcagtccttaccatccatcgatcgcgaaggaagggtgctgaggaggctttcccatgcaccctcgttcctactagccacaccagctatgagacaccccggctacttccttcttggtacgtactggtggcggtactgaaaactactccgcagagatacacgagaagacgtatagttctgtacctagccaagccaagctacctccctcgctcgctccacacctgcctgcatgggcggcggcggcgaaggcagagacagcggcggcggcggcggcgcggcgagctttcgggaggcggctcgtgacttcagcaacgtcgcgtccttctccgagcttccgttcctgcagcgctccgccgccccgccccgtggaagcccccacaactccggcatccgcatcttcggcatcgacgtcccgcactccccaccggagagaaactctaataaagatgccacggccgctactactactaccgccgccgcttccgccacgcagagcagcggcggcggcggggccaccaccgacagcagcagcagcagcagccgcaagttcgagtgccactactgctgcaggaacttcccgacgtcgcaggcgctcgggggccaccagaatgcgcacaaacgcgagcggcagcacgccaagcgcgtgcagatgcagtccgcgatggccgccgccgcagccgcggcggcggcggctggcggcgcgcaccaccaccacctactcggctacccgcagcaccgcttcggcgtcgcaggccccacggtggcgacattgtacccctcgtggccaacaatgaggcctccagctccagcaggcgccggtgccggtgccgtcgccatcggcggcccgcagttctacagcgggatcggctcgatcgcccagccgatcaacgggagccccctcctcacggctgccgggctctggaggggcccgccgccgcctgctgccgggcatgggaacgcgagcttgccgtcgtcaccaggcggagagcgccgccggccggtcgcgctctcgtcctcgtcccccgtgttccgcggagacgatccgagggcttccacttctcttttggcggcggcgtcgtcgccctcctcttcctcctctttgctgctatctccacaaggtcagtttgtctgtgagcagcctgctgccaccactgcggccgagggcgtgagcctagatttgcatctataattgtttccttttggtcgtctatgctgcttttagcggacgacggtggtgtgagcctagattttcacttgaattcagatcgtgccttgtttcctgacacgggtgcacaagaatttcatctatcgaagtttcggaactttttgtctgtgtgcatacacatatacagaaagattcagacaatatgttagggtt

SEQ ID NO: 766 - protein, 561 aa, Oryza sativa
MDADEAAGSSRRMDLNLYLGLPRAPRPRRSDLGSDLALSTPMPSSPSFSAASVDAPPPPPELSHPPYSPSHADLSPPLQEVYSLYNPDDPPASETHLPPYAPPPAPVVSELPDDLEFGLHPPPPLVRASELLGWEDRPSSSTASSSFLPDTAARYWRLLEQTGSRWLRARRFRSDLPPLSSEAYPAGRDAAAVPVLQHEPMNDTVEHNKVAADGAEVGASEESEEQGRSAATFECNICFDMASEPVVTSCGHLFCWPCLYQWLNVYSNHKECPVCKGEVTEANITPIYGRGNSCLDAEKAVEGGKQTGPTIPPRPHGNRLESFRQQFHHLRPISRRLGEAHGLLSSWRRLLDQQIMNTASRFEGPPESAVQEMVDTAHAQHTSRLSRLASRMRARRLLREADNPNPPDGGSTSPDSGLIRNNASDPSRNGPSSLLPDGIDWLRGLTLLGYEDTERFASAMSDFRRITGPSQYGASASSSNPPNLESTFDRTHVVAAPSADQASNSSTAAVIQGDAGISESAGEPSNAGSSRSLRRRGRSSALGSLDADGGGLQRNKRRRIN

SEQ ID NO: 767 - protein, 520 aa, Oryza sativa
MPSSPSSSAASVDAPPPPPELSHPPYSPSHADLSPPLQEVYSLYNPDDPPASETHLPPYAPPPAPVVSELPDDLEFGLHPPPPLVRASELLGWEDRPSSSTASSSFLPDTAARYWRLLEQTGSRWLRARRFRSDLPPLSSEAYPAGRDAAAVPVLQHEPMNDTVEHNKVAADGAEVGASEESEEQGRSAATFECNICFDMASEPVVTSCGHLFCWPCLYQWLNVYSNHKECPVCKGEVTEANITPIYGRGNSCLDAEKAVEGGKQTGPTIPPRPHGNRLESFRQQFHHLRPISRRLGEAHGLLSSWRRLLDQQIMNTASRFEGPPESAVQEMVDTAHAQHTSRLSRLASRMRARRLLREADNPNPPDGGSTSPDSGLIRNNASDPSRNGPSSLLPDGIDWLRGLTLLGYEDTERFASAMSDFRRITGPSQYGASASSSNPPNLESTFDRTHVVAAPSADQASNSSTAAVIQGDAGISESAGEPSNAGSSRSLRRRGRSSALGSLDADGGGLQRNKRRRIN

SEQ ID NO: 768 - DNA, 3416 bp, Glycine max
ccacgcgtccggaagaacaaccgctaactgtggttgcactaaaatatactcactctttttctctgtctccattcgtttctctccgctttaacgttgccccagttaagttttcttatgtaaaggcacaccctttacctaattactagtaccaacaccaaacaaccttgcctttttattctctccttcttgtgttacctttgttgtgtagtgagtgagtgaaagcatggctatggttgtggctcaacacagagaaagtagcagcagtggaagcattgacaagcacttagattctggtaagtatgtgaggtatactgctgagcaagttgaggctcttgaaagggtctatgccgagtgccctaagcctagttctctgcggaggcaacaattgatcagagagtgccccattctctccaacatcgagcctaagcaaatcaaggtttggttccagaaccgtaggtgtagggagaagcaaagaaaagaggcatctaggcttcagaccgtgaaccgcaaactcactgcaatgaacaagttgttgatggaggagaatgatcggttgcagaagcaggtgtcacagcttgtttgtgagaatggttttatgaggcagcaattgcatactccatcggcaacaactactgatgctagttgtgattcggtggttaccactcctcagcataccctgagagatgctagtaaccctgctggactcctatcaattgcagaggaaactttgacagagttcctttcaaaggctacaggaactgctgtagattgggtccagatgcctgggatgaagcctggtccggattcggttgggatctttgccatttcacaaagttgcagtggagtggcagctcgagcctgtggtcttgttagtttagaacctacaaagattgcagagatccttaaagatcgtccatcttggttccgtgactgtcggagcctagaagtttttactatgtttcctgctggaaatggaggaaccattgaacttgtttacacacagacatatgctccaacaacactggctcctgctcgggatttctggactctgagatataccacaagtttggaaaatggcagtcttgtggtttgtgagaggtccctgtctggttctggaactggccctaatccagctgctgctgctcagtttgtaagggctgaaacactccctagtggctacttgatccgaccatgtgaaggtggagggtcaatcattcacatagtagaccacctaaatctcgaggcatggagtgtgccagaagtgttgcggccactttatgaatcatccaaggtggttgctcagaaaatgacaattgcagcgcttcgctatatcaggcaaatagctcaggaaacaagtggtgaggttgtttatggattgggtaggcagcctgctgttctgcggactttcagccagagattgagcagaggcttcaatgacgctgtaaatggattcaatgatgatgggtggactgtattgaactgtgatggtgctgaggatgtaattattgctgttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcaatgttgatgcttattctgctgcatcactgaaagctggcacctatgcctatccagggatgaggcctacaagattcactggcagtcaaataattatgcctcttggtcatacaattgaacatgaagagatgctggaagttattaggctggaaggtcactctcttgctcaagaagacgcttttgtttctagggacattcatctcttacagatatgtagtgggattgatgagaatgctgtgggggcttgttcagagctcgtatttgctccaattgatgaaatgttccctgatgatgctccattggttccttctggtttccgcattatcccattagattcaaaaccaggtgacaaaaaggatgctgttgctacaaatcggaccctggatttgacatctggttttgaagttggtcctgcaacaactgctggtgcagatgcatcatcaagtcaaaacactcgatcggtgttgactattgccttccagttcccttttgacagcagtctgcaagacaacgtcgcggtcatggcacgccaatatgtccgcagtgtgatttcctccgtgcagagggttgccatggctatatctccatctggtataaacccatcaattggagctaaactttctcctggttctccagaggctgttacactagctcactggatctgccaaagttatagttactatttagggtccgacttactgagatcagattctcttgttggtgacatgatgctgaaacaactgtggcatcaccaggatgccattctatgctgttcactgaagtcattgccagtgttcatatttgcaaatcaagctggccttgacatgttggaaacaaccctagttgccttacaagatatcacattggataaaatatttgatgaggctggacgcaaggcattgtgtacagactttgccaagttaatggagcagggttttgcttatctgccagctggaatctgcatgtcgacgatggggcgccatgtgtcatatgaccaagccattgcatggaaagttcttactggggaagacaacactgttcactgcttggctttctctttcataaattggtcatttgtatgaaaaatccaattcgtgtgccctgctttttcccacttgaacataaaaatgaaagggttaaaagggagacaagacaagtttggggggaaaaagaagtcgtaaatttttgtataacacatcaggatcaggtttgcatttaattcgatttaatttatttcttatttagtgcagagaccaaattgaattaatcttgtaaattatttagtgctagagtgaagttgagacttttgaatgacacatgttgagtactttgtttttgtctctactatctttccctcgaccttgagctcatacacagaagaacttgtgtgatgacaaagcgcgtttgtaatgtttattcttacacaatcacagttctgacttgtgtgtccaatgtagtactttgtttttgtatgtagtatgatcatatctttcaactcgagttaaatattagcacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccccccttttgggtctcgtccccccggaatttaattccggcccggtccctgggggggtcccagttttccttttaggggggcgttttaaagctgggggaaaaaagggaaatagttgt

SEQ ID NO: 769 - DNA, 2837 bp, Glycine max
cggacgcgtggccggccgcctgcgtgcttggcagatcgttgcacagattcctccatcctagtttagtgctagaaagagtaaagtatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacacccagattactacgcaggcaaccaaagacacaaactgtgaatcagttgtgacgagtggtcagcagcacaatttgataactcaacatcccccacgggatgcaagtcctgcagggcttttgtccattgcagaagagactttagcagaatttctttctaaggctactgggactgctgttgagtgggtccaaatgcctggcggctgcgagaagacgacagaaggggggaatcgttgctatttctcacagttgcactggagtagcagcaagagcttgtggtttagtgggactagaacccactagggttgcagaaatcctcaaagatcggcctttgtggtttcaggattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggcagcttagtgatctgtgagaggtcacttaaaaatactcaaaatggtccaagcatgcctcctgtgcagcattttgttagagcagagatgctgcctagtgggtacctgatcagaccttgtgaaggaggtggttccatcatccacattgttgatcatatggatttagagccatggagtgtgccagaagtgctacgcccactgtacgaatcatcaacagtactggctcagaagacaactatggcggccctacgtcatctaaggcagatttcacatgaagtttctcagtccaatgtcactgggtggggtagacgaccggcagcactacgagctcttagccaaagattgagcaggggtttcaatgaggcactcaatgggtttaccgatgagggatggacaacaattggcaatgatggtgtagatgatgttactattctagtgaattcatcccctgacaagttaatgggtctgaatctttcctttgccaatggatttccgtctgtcagtaatgcagtgctatgtgccaaagcatcgatgctattacagaatgtgccccctgccattctcctaaggttcctgcgggagcatagatcagaatgggcagacaacaatatggatgcttacacagctgctgctattaaagttggcccttgcagcctatcaggatctcgtgttggaaactatggaggtcaagttatactccccctagcacacacaattgagcatgaggagtttttggaagtcattaaattggaaggaatagctcattctcctgaagacacaataatgcccagagaaatgtttcttttgcaactctgcagtggaatggatgagaatgctgttggcacctgtgctgaacttatatctgctccaattgatgcttcctttgctgatgatgccccccttctaccttctggatttcgcatcattcctcttgaatctggaaaggaagcttccagccccaatcgcacccttgaccttgcatctgcccttgacgttggtcccagtggaaaccgagcttcaaatgaatgtgctggaaattccagctatatgagatctgtgatgacaatagcatttgaatttgcatttgaaagccatatgcaagagcatgtagcatctatggcacgtcaatatgttcggagcattatatcatcggtccaaagggtagcattagcactttctccttctcatttgagttcacatgcagggcttaggtcaccattgggtactcctgaagcgcaaacccttgctcattggatctgcaacagttataggtgctacttgggtgtggagctacttaaatctaataacgaggggaatgaatctttgctcaagtccttgtggcatcactcagatgcaatattgtgctgcactctaaaggcattgccagtgttcactttctcgaaccaggctgggcttgacatgctggagaccaccctagttgcattacaagatatacctttagagaaaatatttgatgatcatggacgaaaaattctcttttcagagtttccacagattattcaacagggttttgcatgtcttcaaggtggtatttgtctttcaagcatggggcgacctgtctcgtacgaaagagttgttgcttggaaggtgctgaatgaagaagagaatgctcattgtatttgctttatgtttgtgaactggtcttttgtttgacatcttgttctgagtacactagtgcttattgtaatctaaagtgttagataaagatttactccagacacttgtgctttgttggttggtgttttactgtatttgcactaaatacttggattgcacatttaatgactatttatgtgttattagcttatgtaacttgtttccttattcaacatccagctaatatttatgcattcttaagaagtgttgcagcttcttatgtgtgtgg

SEQ ID NO: 770 - DNA, 3118 bp, Glycine max
ccacgcgtccgctcttataagcaaccccatctctctgtcccaatcccaacataccccccactggtccttttccattctttatacagacacacacaataaagaaaaagaaaaactacgttttcctttcactattctttttcaccctctccctctctcccatatatgatccaatatattgctataatacaatagaaccaacaactgtgacagacaaactctgagtagtacctcttttattctcctcctccttctctttcattctcaaaccactctgccatagtcttttctttcacctcttaatgaaacctcttggtttgtgtggttgaaacaaacaaagataagtcataataataaatcgggttggattcggaagggatgatggcggtgagttcagcctgcaaagatgggagcaaggtggcactggacaacggcaagtacgttaggtacacacctgaacaggtggaagcactggagaggctctaccatgaatgtccaaaaccaagttctcttcgccgtcaacaactcatcagagagtgtcccattctctccaacatcgaacccaaacagatcaaggtttggttccaaaaccgaaggtgcagagagaagcagcggaaagaagcgtcacggctgcaagctgtgaacaggaagctaacagcaatgaataaattactgatggaggaaaacgacagattgcagaagcaggtgtcacacctcgtctatgaaaacagctttttccgccaacagacacacaacaacaacgctacgcttgccacaacagacacaaacacaagctgtgagtcggtggtgacgagtggtcagcggaacttgacaccgcagcagcattccgcgagggatgctagccctgcaggacttttgtccattgcagaggagactttagcagagtttctttcaaaggccactggaactgctgtcgagtgggtccaaatgcctgggatgaagcctggtccggattccattggaatcgttgctatttctcacggttgccctggagtggccgcacgtgcctgcggccttgtgggtctagaacctgccagggttgccgaaatcctcaaagataggctctcatggtttcgtgattgccgaactgtggatgttctaaatgtgatgtccactggaaatggtggaaccattgagctgctttacatgcagttgtatgcgccaacaactttggcacctggtcgtgacttctggttgctgcgctacacatcacttttggaggacggtagtcttgtggtctgtgaaagatcacttaacaacactcagaatggtcctgctatgcccccagtgcagcattttgttagagcagacatgctgccaagcgggtatttgataagaccctgcgaaggagggggatccattattcatattgtcgatcatatggttctagagccctggagtgtacctgaagttttgcgcccactgtatgagtcatcaatgctgctagctcaaaggacaactatggcggccttacgtcatttgaggcagatttctcaagaggtttctcagccaagtgtaactggatggggaagaaggcctgcagcttctgcgtgcgctgagccagagattgagcaagggctttaatgaagcagtcaatgggtttgcagatgatggctggtccatgttagagagtgatggcattgatgatgtcacccttcttgtgaattcctcacctagcaagatgatgggagttagccttgtctataacaacaatggatttccttctgtgagcagttctgtgctatgtgccaaagcatccatgttgctgcagaatgtccctccagcaattcttcttagattcttgcgggagcaccgatcagaatgggcagacagcagtattgatgcttactcagctgctgccatcaaagctggtccctgtagcttgccaggggcccgatcaggaggttttggcgcgcaggttattcttccactagctcacacaattgagcatgaagagttcatggaggttatcaagcttgaaaacatgggctactatagggacgacatgagtatacctggtgatgttttcctcttgcaactttgcagtggagtggatgagcatgcggttggcaccagtgcagaacttgtttttgctccaattgacgcatctttctctgatgatgcacccattttaccttctggttttcgcatcatacctctagattctggcacagatgctgctagtccaaaccgtacacttgatttggcttctgcacttgaggttggcacaacagcaaacaaagcagctagtgacaactcagctcattctgggagcacaaagtctgtgatgacaatagcattccagtttgcattcgaagttcaccttcaagagaacatagcaaccatggccaggcaatatgttcgtagcatcattgcatctgttcagagggtttcattagcactttctccttcgcgctttggttctcacaatgcttttcacttaccacctggcactcctgaggcacaaacacttgctcgatggatctgtaacagctatcggttctatcttggggtagaacttctaaaatgtgaaggcagtgagtccattctcaagtctctttggcatcactcggatgcagttttgtgctgctctttaaaggcattacccgttttcacgtttgcaaatcaagctggacttgacatgcttgagacaactttggttgcacttcaagacatcactctggaaaagatttttgatgacaatggaaagaaaactctgtgcactgagttcccccagataatgcagcagggtttcatgtgtattcaaggtggtatctgtttatccagcatgggaaggccagtgtcctatgagagagcagttgcatggaaagtgttaaacgaagaagaatccgcccattgcatctgttttatgttcatcaattggtcctttgtctaatatattaaacagtattaggatgtaggaaagaaaagtagagcacaagagtacctaactttggcgaatccctagaatgctttaaaactctagtgggcatatgcgccaccaagatctatctatggccccatttgttttatttttaaaaaaaaaaaaaaaaaaaaaaaaaaaaaaaaaaaaaaaaaaaaaaaaaaaaaaaaaaaaaag

SEQ ID NO: 771 - DNA, 1045 bp, Glycine max
  misc_feature (103)..(103): n is a, c, g, or t
ctacctaagctcttttttcggctcgagctttgctgagggtgggcggctgtttaccttctggatttcgcatcattcctcttgaatctggaaaggaagcttccanccccaatcgcacccttgaccttgcatcttcccttgacgttggtcccagtggaaaccgagcttcatatgaatgtgctggaaattccagctgggggggatctgtgatgacaatagcatttgaatttgcatttgaaagccatatgcaagatcatgtagcagctatggcacgtcaatatgttcggagcattatatcatcggttcaaagggtaggattagcactttctccttctcatttgagttcacatgcagggcttaagtcaccattgggtactcctgaagcacaaacccttgctcattggatctgcaacagttataggtgctacttgggtgtggagctacttaaatctaataacgaggggaatgaatctttgctcaagtccttgtggcatcactcagatgcaatattgtgctgcactctaaaggcattgccagtgttcactttctcgaaccaggctgggcttgacatgctggagaccaccctagttgcattacaagatatacctttggagaaaatatttgatgatcatggacgaaaaattctcttttcagagtttccccagattatccaacagggttttgcatgtcttcaaggtggcatttgtctttcaagcatggggcgacctgtctcatatgaaagagttgttgcttggaaggtgctgaatgaagaagagaatgctcattgtatttgctttatgtttgtgaactggtcttttgtttgacatcttgttctgagtacacttgggcttattgtatccaagtgttagataaagttttactctaagactaaaaaaaaaaatgttggttggtgttttactgtatttgcactaaatacttggattgcactttaaatgactatttgtgttattattagcttatgtaacttgtttccttattcaacctccagctaatatttaatgcaatcttaagaagtgttgcccctttt

SEQ ID NO: 772 - DNA, 1005 bp, Glycine max
  misc_feature (972)..(972): n is a, c, g, or t
ccaaaaaagacattgttgcttttcattttggcatcacagagtatcagagagaaagagagagagagcggttttgcagaaaaaatccaagtaaatttaaggagccaccactgttccaatcagcccctttcattttgcagtgcccgtttattttttcgtgtttgcattcaccgttccacagaaggaaaaaagagtgctttgttccatctctttctgtggtgtgtctcaagataaaaagctcactcactcacagcagcaacaacccttttaccttaactcttgaaactttgttcagagtttggattttgagagagcatgatctgatgaaggagtgtggaggctctcttgggggagagggcaaggaagaagaggactacacaaaacaagtgttgtctttttgaaccccaaaaaaaaacgtttttttttgttttgttgttatggcactttgtatgcagagtcagcagagagattcagcatcaaacaagctgctcatggattgtggcaagtatgtgaggtacacacctgaacaggtggaggctttggagagggtgtatgttgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggctntcctttcaaaagctactggaactgctgtcaact

SEQ ID NO: 773 - DNA, 2252 bp, Glycine max
cctcgtgcccacgccgccgcctcgggagaccctggcggcgttcctttccaaagctactggaactgctgtcaactgggtccagatgattgggatgaagcctggtccggattctattggaatcgttgctgtttcccgcaactgtagtggcgtagcggcaagagcctgtggccttgtgagccttgagcccactaaggttgccgagattctcaaagatcgtccatcatggtatcgtgactgtcgatgcctcaatgtactgagtgtaatccccacagggaatgggggcacgatagagctcatgtacatgcagacatatgcaccaacaacattggcagctgcaagagacttctggactctgagatacactactagtttggaagatggaagtcttgtgatttgtgaaaggtccttgacttcttcaactggtggccccacagggcctgctgcttcaaacttcgtgagagctgaaatgcttcctagtggctatctaattagatcctgtgagggtggtggatctattattcacattgttgatcatgttgatttagatgtttggagtgttcctgaagtacttagacccctctatgaatcaccaaaattcttggctcagaaattgactactgctgccttgcgacatgtaagacagattgcacaagaatcaagtggagaagttcagtatggtggtggacgccagcctgctgttttaagaacatttagccagagactttgcaggggctttaatgatgctgtgaatgggtttgttgatgatggctggtcactgatgggtactgatggagtggaagatgtgactatagccataaactcatctccaaacaaatttttgggctccaattacaacgcatcaatgtttccagcatttggaggtggggtcttgtgtgccaaggcatcaatgctcctgcagaatgttcctcctgctttgcttgttcggtttttgagggagcatcgatcagagtgggctgattatggagttgatgcatactctgccgcatgccttaaagctagtccctatgcagttccttgtgcaagacctggaggcttccccagcacccaggtcattttaccccttgctcatactattgagcacgaggagttcctggaggtagttcgaatagagggtcatgcattttctcctgaggacgtagcgatggcacgcgatatgtatctattgcagctgtgcagtggagttgatgaaagtgcagttggggcatgtgctcaacttgtgtttgcacctattgatgagtcatttgctgatgatgctctgttactgccatctggttttcgtgtcattccgttggatcctaaatcagatggtccagctccaactaggacattagatttggcatcaacgatggaagtaggttctggtaatgcccgtccagctggggaagcagacttgaatgggtacaaccttaggtcggtcctcactattgctttccaatttacctttgagaaccatacacgggacaatgtggctgctatggctcgccagtatgtgcgtagtgttgtgggatcagttcagagggttgccatggctattgctccctccaggttcaatacccagctggggccaaagtcactttctggatcacccgaggcccttaccttagcgcgatggatctgtagaagctacagggttcacactggcacagagctttttaaagctgagtccacagctggtgatgcaatccttaagcaactttggcaccatcccgatgcaatcatatgctgttctgtgaaaacaaatgcatctccagtgttcaccttttcgaaccaggctggtttagacatgcttgaaactactcttgtttcccttcaagatataatgcttgataaagttcttgatgaatctggcaggaagattctctgctccgagttctccaagataatgcaacagggttttgcatctctccctgcaggaatatgtgtatctagtatgaatcggccagtgtcctatgagcaggttgttgcatggaaagtcctcaatgatgatgattctaatcactgcctagccttcatgttcatcaattggtcttttgtatgatggatgaaccatatctagagactactacttattttatctactaatcagatgatactatcacagacagatgtactgatgtcagcttttctttatgccctatgtatgaagtatgctaatgttacttattcgctatatatataaaatatctagttaatttggtgaaaaaaaaaaaaaaaaaaaaaaaaaaaaaaaa

SEQ ID NO: 774 - DNA, 1824 bp, Glycine max
ccacgcgtccgctctttctcctttctttttctctctttctctacaatctcgagattggtgtgccgcgcgcccgaaagaccactgtttcccccctttagtttctcttctaagttggattttgaaggaactgagcagcatctaatgaaggagagtggaggctctcttggagaagagagcctgcccgagactaacaccaagaacagtgaagaagaagaaccaattaactagttcctttttttctttctttctttctcactcactccctccctcccaatcccattttcttcaaatagtgtgcgtgtgtgtgttaagagaagaatagggtgtgtgtgtttagagtgatggcactttctatgcacaaggactcagccaacaaccagatggattcaagcaagtatgtgaggtacacaccagagcaggttgaggctttggagagggtctatgctgaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggtttctcatctggtgtatgagaatggttacatgaagcaacagatacacactgcttctgcaggtactaccacagacaatagctgtgagtctgtggtaatgagtggtcaaaaccaacagcaaaacccaacacctcagcatccggctcgaggattatttgtttgtttcagtcttctcgccatagctgaggagaccctggcagagttcctttccaaggctactggaactgctgtcgactgggtccagatgattgggatgaagcctggtccggattctattggaatcgttgctgtttcccgcaactgtagtggcgtggcagcacgagcctgcggccttgtgagcctagagcccactaaggttgctgagatactaaaagatcgacagtcgtggtatcgtgactgtcgatgcgtggatgtgttaagtatagtccccactgggaatgggggcaccatcgagctcctgtacatgcagacatatgcgcccacaactttggctgcagcacgggacttctggacactaagatacacgacaagtttggaagatggaagtcttgtgatatgtgagagatcattgacatcctcaactggtggccccacagggcctccttctacaacctttgtacgagctgaaatgcttcccagtggttttctagttagaccttgtgagggtggtggatccattattcacattgggctccaggttgatttagatgtctggagtgtccctgaagtactgaggcccctctatgaatcaccaaaattcttggctcagaaattgactactgctgccttgcgacatgcaagacaaattgcacaggaatctagtggagatgttcattatggtgggggtcgtcaacctgctgccttgaggacattaatgcaacggctacgcaaagggtataccgatgcctgcaacgggtttgtggatgatggttggtcactgatgggtaatgatggggtggaagatgtgaccatagccataaactcgtctcccaacacgatattcggttcccattacaatacatcaatgctttcagcatttggaggtggggtcatgtgtgccaaggcatcaatgctgctacagaatgatcctcctgctttgcttgttcgttttgtaggggagcatcgttcaaagtgggctaattatgaagttgatgcatactctt

SEQ ID NO: 775 - DNA, 1271 bp, Glycine max
  misc_feature (255)..(255): n is a, c, g, or t
ccccggcttttgcctttaaggtttcgggtcggattttttttgggaattggaacgggaaaccattttcccccgggaaaaggtaaggccatggttttgcccaggtttaattttaattcctataaggaaaaatgggacgccttcaggttccggttccggatttattttcgggttgggggggtccatatttggggggcgccccttttctttttttttttttttttctgtgttttttttctcagtatttcaatttttatnttttttttttaatttttttttattttgccagtgttggtttttttttaggaataagtaggctatacttcaacaaggagtttatatagtaagaaaggtacatccttggtaaaagcataaagcaaagctaatctaatggcacacacaaccatgagttcatgaaatccagtcattagttacattcgttgttggtgtgacaatatcttagtaaagtactcaaaatataaattaatagatataataaagtatctaaatgatggttcccccatcagacaaaagaccagttcatgaatacgaaggcaaggcagtgattggaatcatcatcatcgagaactttccatgcaatggcctgctcataagacactggtcgattcatacttgatacacatattcctgctggcagatatgcaaatccctgttgcattatcttggagaactcaatgcagagaaacttcctgccagcttcatcaagaactttatccagcattatgtcttgaagagcaacaagagtggtttcaagcatgtcaagtccagcttggtttgcaaaggtgaacactggagatgcatttgtttttacagaacagcacaatattgcatctggatggtgccaaagttgcttcaagattgcatcaccagatgtggactcaacgctgaaaagctctgtgcaggtgtggagcctgtagcttctgcagatccatcttgctaaggtaagagcctctggtggaccaggaaatgactttggccccaactgtgtactgagcctagagggagcaattgccatggcaaccctctgaacagatcgcacaacattacgcacatactggcgagccataacagccacattgtcccgcaaatggttctcaaaggtaaattggaatgcaattgtgaggaccgacctaaggttgtagttattcgagtcactttcaccagctgagcgggcattaccagatcctgtttccagtgttgatgctaagtccaatgtcctagttgaagccaaaccatctgtttatgcaaccaat

SEQ ID NO: 776 - DNA, 628 bp, Glycine max
ccacgcgtccggaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggtttctcatctggtgtatgagaatggttacatgaagcaacagatacacactgcttctgctggtactaccacagacaatagctgtgagtctgtggtaatgagtggtcaaaaccaacagcaaaacccaacacctcagcatcccaaccgggatgctaacaacccaactggtcttctcgccatagctgaggagaccctggcagagttcctttccaaggctactggaactgctgtcgactgggtccagatgattgggatgaagcctggtccggattccattggaatcgtagctggttcccgcactgtagtggcgtggcagcacgagcctgcgggcttgtgagcctggagccccttaaggttgctgaaattctcaaagatcgacagtccggggtttcgtgactgtcg

SEQ ID NO: 777 - DNA, 739 bp, Glycine max
  misc_feature (704)..(704): n is a, c, g, or t
catgcttggcagatcgttgcacagattcctccatcctagtttagtgctagaaagagtaaagtatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacaccacccaaaatactaagcagcagccaaccaaagacacaagctgtgaatcagctgtgacgagtggtcagcagcacaatttgacaactcaacatcccccacgggatgcaagtcctgcagggcttttgtccattgcagaagagactttagcagaatttctttctaaggctactggaactgctgttgagtgggtccaaatgcctggaatgaagcctggtccggattccattggaatcgttgctatttctcacagttgcactggagtagcagcaagagcttgtggnttagtgggactagaacccactagggttgcagaaat

SEQ ID NO: 778 - DNA, 1129 bp, Oryza sativa
gtaaaagatggctgcagtgcatgcagcagtgtaaaaaaaaaaaaaaaaaaaaaaaaaaaaaaaaaaaaaaaaaaaaaaaaaaaaaaaaaagggggggggggcatgtccagtcctgctttgttggcaaatgtaaacaccggtttttccttgaatgagcagcacaaaatagcatcttggtaatgccatagcatcttcaacaattgttctgcatctccatctgattgactaagtaactctacccctagatggtaatggtagctctggcaaacccatcgagcaagggttgctgcttcagggaaaccagagattatcctctgtccggcatttagaccagtttgagagggagagatagccattgacactctttgcacagcagaaacaatgctacggacatattggcgagccatagctgcaacactgtcttggagatgcaactcgtaagggaattgaaaagcgatcgtcagaacagatcgcaagttacaatcatctgcagatgcatctccggaggcttgagctgttgctgaacctacttcaagactagatgccaaatctaatgtcctaccagaggatgcaccatctgttttcatatcaagtggtataacacggaagccagaagaaatcaatggagtttcatctgggaaatcatcaatcggtgcaaagacaagctgaaaggaggatcccacagacttctcgtctattccagtgcagagctgaagcaggtggatatcccttgaaagaagagcttcatcatgagtaagaggttgaccctcaaggcgaacaacttcaagaatctcctcattctcaactgtgtgagcaagtggaatgatgatttggctcccagaaaatctcatgggtcgcaacccaggaagtgaacatgcacttgttttcagagttgaagccaaatatgcatcaatattgtaatcggcccattcagatctatgctccctcagaaatcgaaccagtactgctggaggaacactctgcagtaacattgatgccttagcacatataatacctccgggggctccaaaggcgatgccagcattgctgttactcctaattttcttagttgagttgcaagcaatcactacatcttcaacaccgtctccgcccattatagaccacccat

SEQ ID NO: 779 - DNA, 1154 bp, Oryza sativa
gtggatcccccgggctgaggaatcggcacgaggctaaatttggtctgcatttcgaagaatctcgccaatgccaatgcagttttcgacgccctacaggatccgattttacattgctggaaggaacccaagtacccaaccgtcaggattgctccgatccccctacaactaaaaccacttggccactgccttgtacttgggtacttgatggaatgggagcgagattacatttacataagcgagaaatttcgcaaatactactagattctcaggtctagatctagtgcaaaacagtcttgaacaagcaaaaatgaatcttcacttcgcagtggatgtgggatggtcacacaaaggaccagttgacgaaacagaaggccaggcagtgaacattgctatcctcggcaagcactttccaagccacggcctgatcgaaagaaacatgccgacccattcctgacatgcacacgcctgatggcaggtagacatggccctgctccatcaatttgggaatgtttgagaacaatgcttcttttccaggctcatcaaagatcctgtccaatgtgaggtcctgtaaggcgacaagggaagtttctagcatgtccagtcctgctttgttggcaaatgtaaacaccggtttttccttgaatgagcagcacaaaatagcatcttggtaatgccatagcatcttcaacaattgttctgcatctccatctgattgactaagtaactctacccctagatggtaatggtagctctggcaaacccatcgagcaagggttgctgcttcagggaaaccagagattatcctctcccccgccccggggcccctctgagagggagagatagccattgacactctttgcacagcagaaacaatgctacggacatattggcgagccatagctgcaacactgtcttggagatgcaactcgtaagggaattgaaaagcgatcgtcagaacagatcgcaagttacaatcatctgcagatgcatctccggaggcttgagctgttgctgaacctacttcaagactagatgccaaatctaatgtcctaccagaggatgcaccatctgttttcatatcaagtggtataacacggaagccagaagaaatcaatggagtttcatctgggaaatcatcaatcagtgcagagctg

SEQ ID NO: 780 - DNA, 666 bp, Oryza sativa
gcacgagggttggtattgtggccatttcacatggttgccgtggtgttgctgcccgtgcctgtggttgggtgaacctagaaccaacaaaagtggtagagatattgaaagatcgtccatcttggttccgtgattgtcgaaacctggaagtctttacaatgattccagcaggaaatggaggaacggttgaacttgtctacacacagttgtatgctccggcaactttagttcctgcacgagatttttggacgttacggtacacaaccacaatggaagatggcagtcttgtggtctgtgagagatctttaagtggttcagggggcggtccaagtgctgcctctgctcagcaatatgtgagagcggaaatgcttccaagtggatacctggttcgcccatgtgaacgtgggggatcaattgtgcacatagtggaccatctggatcttgaggcatggagtgttcctgaggtgcttcggccactctatgaatcttccagggtagtcgctcagaaaatgactactgcggcactccggcacatcagacaaattgctcaagaaacaagtggggaagtggtgtatgccttggggaggcaaccagcagtgctacggacttttagtcaaaggctgagcagaggctttaacgatgccattagtggtttcaatgatgatgggt

SEQ ID NO: 781 - DNA, 712 bp, Oryza sativa
tgcaggaatcggcacgaggctagtgcgcccatgcgagggtggtggctccatcgtgcatattgtggaccatctggatcttgaggcttggagtgttccagaagtgcttcggccactctacgagtcatctagggtagttgctcagaaaatgactactgcagcactacggcacatcagacaaattgctcaagagacaagcggggaggttgtatacgctttggggaggcaacctgctgttttgcggacatttagtcagaggttgagtagaggcttcaatgatgctataagtggtttcaatgatgatggttggtctgtcatgggtggggatggcattgaagatgtgatcattgcttgcaatgcaaagaaggttaggaatactagcacttcggccaatgcttttgtaactccaggaggtgttatatgtgctaaggcatccatgctactgcagagttgtcccacctgcagctttggttcgatttttgagggaacatcgttctgaatgggcggattataacttcgatgcatattcagcttcatctctgaagacaagctcatgttcacttcctgggttgcggcctatgagattttctgggagccagatcattatgccacttgctcacacggtggagaatgaggagattttagaagttgtccctcttgaaagacaaagtggtcacacatgattgatgtacttaagtgttaagatattgaccct

SEQ ID NO: 782 - protein, 148 aa, Oryza sativa
MAASDRPPAQDCRGEGGNFGGGGGRSGGWRQRWRCPMRSGSGSDGSGYDKAGMDSGKYVHYTPGQVEALERVYAECPKPRFSRRQQLLCELSILANIEPKQKIKVWFPKQKWKELIGVPLLKWLLCILIVSHVCFISVFKGLALLKVV

SEQ ID NO: 783 - protein, 886 aa, Oryza sativa
MDASKYVRYTPEQVEALERLYYECPKPSSLRRQQLVRECPALANVDPKQIKVWFQNRRCREKQRKESSRLQALNRKLTAMNKLLMEENDRLQKQVSQLVYDHGRHGVAAAGMMRRVPAFPPQAAAAAGHQLATATDTSCESVVTSGHHHQQQQHNVVQPPPRDASPAGLMSIAEETLTEFLSKATGTAVEWLQMPGMKPGPDSIGIIAISHGCAGVAARACGLVGMEPAKVAEILKDRPLWLRDCRSMDVVNVLPAGANGTIELLYMQARTHKPENSEPEPEILKLKFVFDLQLYAPTTLAPARDFWLLRYTSILDDGSLVVCERSLSSKQGGPSMPLVQPFIRGEMLPSGFLIRPSDVGGSVIHIVDHMDLEPWSVPEVVRPLYESSAMVAQKISMAALRYLRQVAHEDTRSVITGWGRQPAALRALSQKLTRGFNEALNGLADDGWSVIESDGVDDVCISVNSSKVIGCNATFSSGLPIVSTGVLCAKASMLLQDVSPPSLLQFLREHRSQWADSNLDAFFASTMKPNFCNLPMSRLGGFSGQVILPLAHTFEPEEFLEVIKLGNASNYQDTLVHRDLFLLQMYNGVEESSAGTCSELIFAPIDASFSDDSPLLPSGFRIIPIDSPLDTSSPNCTLDLASTLEAATPRSRISGVNGGGGGCAAAAASSSSKAVMTIAFQFAFDGHLQDSVAAMARQYMRNIISSVQRIAVALSSSRLVPPGAGAAAAQLSPVTPEAATLPRWICQSYRFHFGDELIKSVDANSSNESILKAVWHHPSAILCCSLKAMPVFTFANQSGLDMLETTLVALQDMTLEKVFDDQGRKNLCTELPNIMEQGMACMEGGVCVSSVGRAASYEKAVAWKVVDGDGGGAHCICFMFINWTFL

SEQ ID NO: 784 - protein, 855 aa, Oryza sativa
MAAAVAMRSGSGSDGGGGGYDKAGMDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTPQNPLRDASNPSGLLTIAEETLTEFLSKATGTAVDWVPMPGMKVDCQLLRFTLPASNDPGPDSFGIVAVSHGCRGVAARACGLVNLEPTKIVEILKDRPSWFRDCRSLEVFTMFPAGNGGTIELVYMQMYAPTTLVPARDFWTLRYTTTMEDGSLVVCERSLSGSGGGPSTASAQQFVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNAKKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVSAPIDELFPDDAPLISSGFRVIPLDMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 785 - protein, 806 aa, Oryza sativa
MAAAVAMRGSSSDGGGYDKVSGMDSGKYVRYTPEQVEALERVYTDWPKPTSSRRQQLLRECPITANIDPNRSRCRDKQRKESSRLQAVNRKLTAMNKLLMEENERLQKQVSQLVHENAHMRQQLQNLYQLGPYASVPLELIYELILRMLLSIAEETLTEFLSKATGTAIDWVQMPGMKPGPDSVGIVAISHGCRGVAARACGLVNLEPTKLYAPPPLVPARDFWTLRYTTPMEDGSLVVCERSLSGSGGGPSAASAQQYVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSIMGGDGVEDVVIACNSTKKIRSNSNAGIAFGAPGGIICAKASMLLQSVPPAVLVRFLREHRSEWADYNIDAYLASTLKTSACSLTGLRPMRFSGSQIIIPLAHTVENEEILEVVRLEGQPLTHDEALLSRDIHLLQLCTGIDEKSVGSSFQLVFAPIDDFPDETPLISSGFRVIPLDMKTLELIEAFGFKYSLGKIKQDGASSGRTLDLASSLEVGSATAQASGDASADDCNLRSVLTIAFQFPYELHLQDSVAAMARQYVRSIVSAVQRVSMAISPSQTGLNAGQRIISGFPEAATLARWVCQSYHYHLGVELLSQSDGDAEQLLKMLWHYQDAILCCSFKEKPVFTFANKAGLDMLETSLVALQDLTLDRIFDEPGKEALFSNIPKLMEQGHVYLPSGVCMSGMGRHVSFDQAVAWKVLAEDSNVHCLAFCFVNWSFV

SEQ ID NO: 786 - DNA, 687 bp, Oryza sativa
gagcaagaagccgaaaggtaaggatcaggctataacgttggggcattggcaactcaattaaaaggggtagggtagttgtctggttgttcatgttctgatttaactcattagtgttgtgctaaatggaaggtcaagctgctctacatgcaggcaagaacagacaagcctgaaaatttttgtggcaaattcttagctcaacctgaaattccgaagctgaaatctgtattcagtcttcaactctatgctccgacgacgctggcgccggctcacgacttctggctgctgcggtacacctccattctcggtgatggaagcttagtggtgtgtgagagatcactcagtagcaagcaaggaggcccaagcatgccacttgtccagccttttatcagagatgagatgcttcccagtgggttcttgatccgacctagcgatggtggaggcagcgtgatacacatcgttgatcatatggacctggagccttggagcgtgcctgaagttgtgcgacctctgtatgaatcttctgccttggttgcgcagaagatatcgatggcggttgcctacaaagatacccgttctgtgatcacaggatggggaaggaagcttgcggctttgcatgctctgagccaaaaagctcaccacaggcttcaatgaagttctcaatgggcttgcggatgatggatggtccgt

SEQ ID NO: 787 - DNA, 370 bp, Oryza sativa
aattgctgcgtgagtgccccatacttgctaacattgagcccaagcagatcaaggtctggttccagaacagaaggtgccgggataagcagcggaaggagtcttcacggcttcaggctgtcaacaggaaattgacggcaatgaacaagctacttatggaagagaatgagcgactccagaagcaggtctcccaattggttcatgagaatgctcacatgcgacagcagctgcagaatactccgctggcaaatgatacaagctgtgaatcaaatgtgactacccctcaaaaccctttaagggatgcaagtaacccctctggggctcctttcaattgcagaggagaccttgacagagttcctctcaaaggctactg

SEQ ID NO: 788 - DNA, 3498 bp, Zea mays
attgagccaagcagataaggtctggttccagaaccggaggtgccgcgataagcagcggaaggagtcttcgcggcttcaggctgtgaacagaaagttgacggcaatgaacaagcttctcatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctgtgagagatccttgagtggttctggtggtggtccaaatgcagcctctacacaacaatttgttagggctgagatgcttccaagtgggtatttagttcgcccatgcgaaggtggaggatcaattgtgcatatagtggaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcaatttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgaagtccaacccgtcgggtggttatggcgagctgacccatttttttttttgtatggaaaatcatcagctgtgacaaaaggcatatgttgcatgcactagttgaagaaactggtccaattgcttttttggtctgtcattccattcagatgttgctaggtgtggagtggaaatggggcaatagtgatgcacggctacacatgacccagcattaaccaaacaaccgcgtcgccagtttctttctattcgatcagggagatgcatttttctggcaaaaatcttccattttttttcgttgcaaatttggtctgtatatggaactgctgctggacgccgagaaagcaaaacatatgcggaaactcactatggctcgaggaagatatatgcctacactgtcttcagaaaacataatgcagtaatgcttttcgaacccgaagcacactagacacaaaagccagatgagcaggtaggtccctcgcaaggctgatgccaacaattaaaccgacgacccttcacaacaaaattacgattctttcttctcatcctgctccagttgaggctccttctctgcagcctcctcaaatgtctctccttggacaagctcagggacgtcgtcatcatcctgtgcagctgcttcagcaccaggtacctgcctctggaaaatctcagccagcttcttaaggttgtccaggttatcaggacccagttggttgataattgatggcagaaggtcttgcagactttttgtctggggtactccactaaccacccatgtatttgcaggaatggatgcttgcactttagggttctgaaactggataacaacatcgtccttgaagatgttgacctcctcgataccaggaatggtgttccccccgatccttttcaaggtgctctgaagccgcttgtcatctgtggtcgtggtcttgtgaactgccttcttcttcctgcgcatgctgcccttccctccggtgcgtacagcgccagccatcttcttgagcttctccacattcatcttgcacaggcggcggcggcggcggcggatggagtggtggatggggaggcggaaggggtttgagctacagcaggaagcagatagagatagaagaaggagagtcgagtcggaaggccagtcactgtaacatttaggggctttttccggccgaacctcggggg

SEQ ID NO: 789 - DNA, 3126 bp, Zea mays
gtcgacccacgcgtccgcccacgcgtccgcctgctcccgcccctcaatcaatcacgacgccacagccgcacccccgcgaaccctagctcgcagtcgcaccgcgcgccggacgctgaccaggtgcctgctctatctcctgcggtggccgtcgcgctgccgccgccagacccgatccgtccgaccgtgccaagcgccccccctccggcgatcgatgcgaggcgccgcgggaggcggctcgggctcgggcaggctgtgagctggagcctgtccgctcgctgcgtcgtgcgcctgccttccctctcacggtcggcctcgccgcgcgtttgctttcccgcccacgcagggatcttcgcgggcggggagttgaagcgcgagatttgcgcggctacgattctgcgttgccgagggagcaagggaaccaatggctgcagcggtggcgatgcgagggggaagcagcgacagcggaggatttgacaaggttcccgggatggactcggggaaatacgtgcgctacaccccggagcaagttgaggtgctcgagcggctctacatcgattgccccaagccaagctcctcacggcggcagcaactgctgcgcgagtgtcctatactctccaacattgagccgaagcagatcaaggtctggttccagaaccgaaggtgccgcgataagcagcggaaggagtcttcgcggcttcaggctgtcaacagaaagctgacggcaatgaacaagcttcttatggaagagaatgagcgtcttcagaagcaagtctctcagttggttcatgaaaatgcgcacatgcggcagcagctgcagaacacttcattggccaatgatacaagctgtgaatcaaatgtcactgcccctccaaacgctataagggatgcaagtaacccttctggactccttgcgattgcggaggagaccttcacagagttcctctcaaaggctactgggacagctattgattgggtccagatgcctgggatgaagcctggtccggattcggttggtattgtggccatttcacatggttgccgtggcgttgctgcccgcgcctgtggtttggtgaatctagaaccaacaaaagtcatagaaatcttgaaagatcgtccctcttggttccgtgattgtcgaagtctggaagtgtttacaatgtttccagctggaaatgggggaacaattgaacttatctacatgcagatgtacgccccaacaactttagttcctgcacgtgacttttggacgttgcgatacacgacaacaatggaagatggcagccttgtggtctgtgagagatccttgactggttctggaggcggtccaaatgcagcttctgcacagcaatttgttagggctgagatgcttccaagtgggtatttagtgcgcccatgcgaaggtggaggttcgattgtgcatatagtggaccatctagatcttgaggcatggagtgttcctgaagtgcttcgaccactatatgagtcttctagagtagttgctcagaaaatgactactgtggcactgcgccaccttagacaaattgctcaagaaacaagtggagaagtagtgtatgccttgggaaggcaacctgcagttctacggacctttagtcaaagactaagcagggggtttaatgatgccattagtggtttcaacgatgatggttggtctgtaatggggggagatggcattgaagacgttgttgttgcttgcaactcaaccaagaaaattaggaataatagcaatgctgggattacatttggagcgcctggaggcattatttgtgcgaaggcatccatgttactgcagagcgtcccaccggcagtactggtccgatttctgagggagcatagatctgaatgggccgattacaatattgatgtgtatttggcttcatcactgaagaccagtgcgtgctcacttcctgggttgcgacccatgagattttctggggggcagatgatcatgccacttgctcacacagtggagaacgaggagattcttgaagttgtccgccttgaaggacaacctcttactcatgatgaagcccttctttcaagggacatccaccttctccagctttgcactggaatagatgagaaatctgtgggttcctccttccagcttgtgtttgcaccaattgatgagcattttccggatgatgctccattgatttcctctggctttcgtgtcataccacttgatatgaaaacagatggtgtatcctctggtaggacgctagatttggcatctagtcttgatgtgggttctgctgcaccccaagcctcaggggatgcacctccagatgactgtaatttgagatctgtgctgacaatcgcctttcaattcccttatgagatgcaccttcaggacagtgttgctactatggcccgtcaatatgtgcgtagtgttgtttctgctgtgcaaagggtgtcgatggctatatctccctcccaatctggtctaaatgctgggcagaggatgctttccggcttccctgaagctgccacacttgctagatgggtttgccagagttatcactaccatctaggtgtggaattacttaaccaatcagatgaagctggtgaagcattgttgaaaatgctctggcatcatccagatgctattctgtgctgctcttttaaggagaaacctatgtttacgtttgcaaacaaggcagggctcgacatgttagaaacatctcttattgcgctgcaagacctgacgctagacaagatcttcgacgagtcaggaaggaaagcaatattctcagatatctcaaaactaatggaacagggctacgcgtacctgccgtcgggcgtgtgcatgtcaggaatgggtcggcatgtctcattcgaccaagctgtagcgtggaaggtgctcggcgaggacagcagcgtccactgcctggcgttctgcttcgtcaactggtccttcgtttgacacgccatcccatggcctgtgtgatgagcaggccaatttttttgtatggtgatcccaatatggggaaaccatcagctgtgacagaaggctttatgttgcatgcactagttgtacgtcttgaatcgagtgtatttatgaagaaattggatactgcgcaaaaaaaaaaaaaaaagggcggccgc

SEQ ID NO: 790 - DNA, 1816 bp, Zea mays
ccggccgggtggttgcccagaagatgacaaccacagcgctacggcaccttagacaaattgctcaagaaacaagtggagaggttgtatatgcgctaggaaggcaaccagctgttctacggacatttagtcagaggctgagtagaggctttaatgatgctataagtggtttcaatgatgatggttggtccgttatgtgtggagatggcatggaagatgttatcattgcttgcaactcgaagaagatcaggagcagtagcaatcctgctactggttttggagcccctggacctggaggtatcatatgcgctaaagcatcaatgttgctgcagagtgttccaccagcagtccttgttaggttcctgagggaacatcgatctgagtgggcagattataactttgatgcgtattcagcttcagcattgaaaacaagcccttgttcccttcctgggttgcggcctatgaggttttctgggagtcagatcatcatgccccttgctcacacggtggagaatgaggagatcttagaagttgttcgtcttgaaggacagactcttacacatgacgagggccttttgtctagagatatacatctgcttcagctttgcactggaatggacgagaaatcaatgggatcctgcttccagcttgtctttgcaccaatcgatgagcttttccctgatgatgctccattggtatcttcaggctttcgcgtgatcccgttggacataaaaacagacggaccaccctctggaagaacgttggatttggcctctagccttgaagttggcgcaaccacgcaacaagtggcaggggatggatctcaggacgtttgcaacctgcgatctgtgctgacaattgcctttcagtttccctatgaaacacatctccaggacaccgttgcagctatggcccggcaatatgttcgaagcatcgtttctgcggttcaaagagtatcaatggccatttctccctcccattctggcttgaatactgctgggcagaagctaatttctggctcccctgaagctgctacacttgttcgctggatttgccaaagctaccggtatcacttgggggtggatttggtcagccactcggatcaagctggggaatcacttttgacaatgttctgggaccatcaagacgctgtcttgtgctgctctttcaaggaaaagcctgtgtttactttcggcaaccagatgggagttgacatgttagaaacgactttagtcgctctgcaagatctcacccttgacaagatctttgacgagcctggtagaaaggcactacatgcggaggttccgaaactgatggaacagggctatgcgtacctgccggctggggtgtgcctgtctgggatgggccgccatgtctcctacgagcaagctgttgcttggaaagttctcggtgaggacggcaacgtgcactgcctcgccttctgtttcgtcaactggtccttcgtctgatgtgatccaatgcaccgcggaaactttacgatcagcgtccatttttgcattctctgtagacgagaatggtgcggtgttgctgctactgttagctaggcaacggcatgttcaggtaaggtagtcttggggaaagccagtattgtgaagatgtaaatttgcgcccgtttccgctaatttaacccgctgaacttgctgttgtttgttaaggccaggggcactcgtacgtgagattaaatgttgtgaaattgtatgtgctgaaacataggtttacattgaaattggcataaaaaacggaatcatgtgggctaaacggcccctaaaaagttttgatattaattaaggggggtttg

SEQ ID NO: 791 - DNA, 2346 bp, Zea mays
gatcacaaagattcaatgataacagcagtagtaatagggttaagtctcacacataaacagacagcaggggcattgttctccaactcccgatccaccacagtagacttaggccataaacagacagcaggggggcattgtctcgagcagttgtagtacacaggtgcaacggaaagcaactagtaatacgtagtcggataggataggataaaggcggcaaccgatctgacgctgccgagtgaggcatcgaggctgtgaacgtcaagagcggaggagcatcagatgaaggtccagttgacgaacatgagcgccaggcactgcggcgcgccgtcgtcgcccaccaccttccacgccaccgcctgctcgtacgacgcttgccgccccatgctcgacctgcacacgccgccggggaggtacgccaggccctgcagcatgatcttggggagctgtgcgaccagggccttctgtcccccgtcatcaaggaccgcctccagcggcaggtcctggacattcgccaccgtcgtctccagtatgtcgaagccggcgcggttggcgaacttgagcgtgaaagccggctttagagagcagcagattatggcgtcgctgtgcttccagaacagcgtcaggggagagcccgccgcgtcttcagtgtccgaccagcggatctccgatccagtgtgcgccctgtagctcctgccaatccacgaagctagtgcgagtgcctcgggagagcctggcggatgcttcagttcgacatgcgggccaaggcgagagggagaaatcgccatggccaccctctgcacgatcgccatcactgccctgacatactgcctggccatcgctgccacgctctcgcggaggtggttctcgaacgagaactggaaggcgatggtcaggaccgacctcgtgctgcgcgtgcctgacccgctatcgcttaaagcacacagacctccgcctgatccgacctcgagcgcagaagcaaggtcaagggtacgtgtggcagatggcacatccgtcttagcatcaagcggtatcacacggaagccagagggtagcaacggtgcatcgtcagcaaaagattcatcgataggagcgaagacaagctgtgcacaagcacccggcgcatcctcatcgatgccgctgcacaactgcagaagaaacatatccggggacataagaacctcgtcatggctaaagccatgtccttgaagtcgaataacctccaagcactcttcatgctccacggtgcgtgcaaggggtagtataacctggttgcccataaacccaccagcccttaaacccggaacattatatgggttggccctcagagaggcagcggaataagcatcaacaccagggtcagcccattcagagcgatgctccctcaaaaatcgcacaagtagagcaggtggcacattctgcagtagcattgacgcttttgcgcacatgatgccgccccccatggcagaaaagaatggggaagggctgacatcagacccaataagtttgtttggagatgagttgattgtaattgaaatatcctcagcaccatcactgctcaacaaagaagaccagccatcgtctggaaagccactcacagcatcattgaagcctctgctgagcctttgactgaaagttctgagaacagctggctgtcgcccagcaccatagggcgtttcaccacttgattcgtgtgcaatttgcctaatgtgacgcaacgccgcagcagtcatcttttgtgccagtatcttaggagattcatagagcggtcgaagaacctcagggacactacaagcattcagatcaacatgatccacaatgtaaatcatggaacctcccccatcacaaggtcgaatcagataaccactaggaagcacctcagctcttataaaatctggagttttaggtccagaaggacctccagtggagtgggtcaatgacctttcgcagatcacaagactgccatcgtcaagaccactagtgtatcgtagtgtccaaaagtcgcgcggttccgccagagttgtcagtgcataagtctgcatatagatcagctcaatcgttccaccgttacccgtagggataacatggaggatatcaacacgccgacaatcgcgataccacgatgcgcgatccttaaggatctcggcaacctttgtgggctcgaggctcacaaggccgcaagctcgtgctgctacgccgctgcagttgtgcgaaacagcgatgattccaacggaatccggaccaggcttcatcccaaccatctgcacccagttgacagcagttccggtcgccttggacatgaactccgccaatgtctcctcagcaatagcgagtagaccggacgcgtgg

SEQ ID NO: 792 - DNA, 1669 bp, Zea mays
cactcccccagttttttttttttttttttttcgagcaagcagaactagcaaatagtaatactgcaacctgcaacagtgatcaatgtcgccggcgacaagccggggagacgagaccacgaccaggcacgcatacagctgttgtagttgtttgtcacgcgcacacacacaaacaaacagagtcagttctcgatcatccacacagtacacaaattcttaacataggcggcacaacggaaaagcaactaatgatacgtagtagggcaaaaggcggcatccggtctggcgctgccgagcgatgttgcgagcctcagatgaaggtccagttggcgagcatgagcgccaggcactgcggggcgccgtcgtcacccaccaccttccacgccactgcctgctcgtacgacgcctgccgccccatgctcgacctgcacacgccaccggggaggtacgccaggccctgctgcatgatcgcggggagctgcgcggacagggccttctggccctcctcgtcgaggaccgcctccagcggcaggtcctgggatgttcaccatcgtcgtctccaggatgtcgaagccggcgctgttggcgaacttgagcgtgaaagccggcggcttcagagagcagcagagtatcgcgtcgctgtgcttccagaacagcatcagtggagagtccgcgccttcggtgtccgaccagcggatctccgttccagtgtgcgccctgtagctcctgccaatccacgtagctagtgcaagtgcctcgggagagcccggcggatgcttcagttcgatacgcgaaccgaggcgagaaggagcgatcgcccatggccaccctctgcacggagggccatcacggcccctgacgtactgcttggccattgccgccacgctctcgcgaaggtggttctcgaacgagaactggaaggcgatggtcaggaccgatctcgtggcgcacgtgccggaaccatcgcatgaagcgcgcatgccgcttccacctgatccaacctcgagcgcagaggcaaggtcaagcgtgcgtgtggtggcggcagttggcacatccatcttagcatcaagcggtatcacacggaagcctgagggcagcaacggtgcatcgtcggcaaaagattcatcaataggagcaaagacaagctgtgcacacgcaccaggtgcatcctcgtcgacgccactgcacagctgtagaagaaacatatcccgggacataaagaacctcgtcatggctgaaaccatgtctttgaagtcgaataacctccaagcactcttcatgctccacggtgcgtgcaaggggtagtataacctggttgcccataaacccaccagcccttaaacccggaacagcatatgggttggccctcagagaggcagcggaataagcatcaacaccagggtcagcccattcagagcgatgctccttcaaaaatcgcacaagtagagcaggtggcacattctgcagtagcattgacgcttttgcgcacatgatgccgccccccatggcagaaaagaatggggaagggctgacatcagacccaataagtttgtttggagatgagttgattgtaattgaaatatcctcagcaccatcggtgttcaacaaacaagaccagccatcatctggaaagccactcacagcatcattgaagcctctgccggacgcgtgg

SEQ ID NO: 793 - DNA, 3186 bp, Zea mays
ggtccaatcaatttttcaggagcaaaccaggatccatcataagatagcaagcaagcgaagacgaacaactagtacaaagctgtttgttccacgggggtgatgaacaactacaaaggtgtgtttcataggttgcctggacacaggcaaaagcgacggtacatggggtacagagttcaaacaacagagccgcaaacgctaggcaacttggctctactgactactaggggaccgggttctcacacgaaggaccagttcacgaacatgaaggcaaggcagtgcggggtgtcgtcgtcgctcaggaccttccacgccaccgcctgctcgtacgacaccggccgccccatgctcgacacacacacgccaccggggaggtacgcgaagccctgttgcataatcttagggtactcggtgcagagcgcccttcctgccatcgtcatcaaggatcttctcaagggagatgtcctggagcgcaatcagcgtcgtctccagcatgtccaggccggcttggttggcaaaggtgaacacgggagcagccttcagggaacagcacatgatcgagtccgagtgttgccacagcgctttcaaggaagcatccgtgcatttgggtgtcccgtgcggaggagttcggctcccagtgtggaacctgtagctcctgccgatccaccttgccagcgtgtgtgcctcaggagatcctggagtttgcttcatttcaagctgtccaccaatgcgcgaaggagcctattgccatggctaccctctgcaccgatgccaccacggtcctgacgtattgcctggccatggctgcgacgctctctcgtaggtgattttcatatgagaactggaaagcaatggtcagcactgatcttgtgttgcaggtgctggaggcgtcactcgaaagcacgcgttgttccccaccagatccaactcgagggggtagatgcaaggtcaagtgtgcgtgtgcctgatggtggatccgtctttgcatcccagtggaatgacacggaagcctgagggtagcagtggcgcctcctccgcaaaagattcatcgatgggtgcaaacacaagctgtgcacatgccccagctgcattttcatccaccccactgcacaactgcagaagacacatatctcgtgacagaacaacttcgtcatggcagaggctgtgtccctcaagcctaataacctctaagaactcctcgtgctctaaaggtatgtgcaaccggcagaataacctggctgcccgtaaacccactagcacgcaaaccaggaactgcatatgacccagccctcaaagcagcagcggaataagcatcaacaccaggatcagcccatttgggagcgatgctccctcagaacccgtactagtagggcaggtggcacattctgaagcagcattgatgccttagcacacaggatgcctcctccaattgcggtaaacagctgggaggagttgacatgaggaccaataagtttgtttggagaagagttgatagcaatagtaacatcctcagcaccgtcactgctcatcagtgaccaaccatcatctggaaacccattgacagcatcattgaaacccctgctaagcctctggctaaatgttcttaaaactgctggctgtcggccccctaagggaggcatttcccccactcgattcatgcgcaatttgcctaatgtgacgcagtgcagcaatagttgttttctgtgcaagaatctttggggattcataaagtggtctaaggacctcaggcacactccaagcatctaaatcaacatgatccacaatgtgaatcatggagccacctccctcaccagggtcgaattagatagccactaggaagcacttcggctcttacaaaatttggagtgttgggtcctgatggacctccagtcgattgtgttagtgatctctcacagatcacaagactgccatcctcaagaccactagtgtatcggagagtccaaaagtcgcgcggtgccgccaaagttgtcggtgcgtaagtctgcatgtagataagctcgatagttccaccattacccgtagggataacatggagaatatccacacaccgacaatcgcggtaccaagaagggcgatccttgaggatctccgcgacctttgtgggctcaaggctcactaggccgcaagctcgggctgctacgccactacaattgtgcgaaacagcgatgattccaatggaatccggaccaggcttcatcccaaccatttgcacccaatcgacagcagttcctgttgctttcgacaggaactctgccaaggtctcctcagcaatagctagtagaccagctgggttattcgcgtcccgctgaggacgcgggagctgctgggttttgctgttggtggtgctgaccacttgtgaccacagactcgcagctcgtgtctgtagtcgcagcagaaggattatggagctgctgtcgcatgtacccattctcgtagacgagtcgggagacctgcttctgcagcctgtcattctcctccatcaacagcttgttcattgcagtcagcttccggttcacagtctgcaggcgcgaggcctccttccgctgcttctcgcggcatctgcggttctggaaccagacccttgatctgcttgggctcgatgttgctgagtatggggcactccctgatgagctgctgcctgcgcagcgagctgggtttggggcactcgctgtagacgcgctcgagcgcctcgacctgctcgggggtgtagcgcacgtacttgcccgtgtccacctgcggcgccgccgccgccgccgggcgacggccggtccttgccgcccccgaccaccgccagcgccgtcgacatctggctagcaccgccgcccagggaggagtcggagtcggaggaggaggggttgtcgtcgtcgcggggagacggagaatacggagagccacggccacgggcggcgccgagtcatagcctcggggcgagagcgcagccgcccgacgccatggtggtggtgcgagagagagagagagagagagagagagacgagagagagagaggagtggcggcggtgctggggggttgtgcagctgttgcttgcttggctgcctgccgagccgcgcggcgcgcggggagggtgaggaggaggacggaggggaggagcagcggggggaaagggaaagctagcggcgagacggggatgggagagcccggccggcctc

SEQ ID NO: 794 - DNA, 721 bp, Zea mays
  misc_feature (512)..(512): n is a, c, g, or t
gtcagccacggtgctcctgctgctggtccggaggcagccacgcttgcaagatggatctgccagagttacaggttccatttcggggctgagcttatcaaatccgcagacggtagcggctgtggtgaagcagtgctgaaaactctctggcaccatgccggcgctatactctgctgctctctcaaggccttgccagtgttcacgttcgcgaaccagtccgggctcgacatgctggagacgacgctggtggcgctgcaggacatcgcgctggagagagtgttcgacgaccaagggaggaagaacctgtgcgcggagctccccggcgtcatggagcaggggttcgcgtgcgtccccggcgggatgtgcgtgtcgggcctaggccggccggtgtcgtacgagaaggcgctggcgtggaaggtgctcgacgacggcagcggcggcgtgcactgcgtctgcttcatgttcgtcaactggtcgtttgtgtgacgcgtctgctaccaggtccgtcgcgctcnaggggaaaatcagttgatcggtgacgtgcttgagggtacgtacgtctcaaatcgccctttggttattgggatgtaaaatggtttcggttttttttttgttttttttttgaagaaaaatgtgaaatggtagaaggaaggacctgaatagcagtattgtacacggatggatcgtgtgatgtcaaacaagaatgactttttgtttgatggtg

SEQ ID NO: 795 - DNA, 674 bp, Zea mays
tccaatggcggccttgcgctatctcaggcaggttgctcacgaagataccgcccattctgtgataaccgggtggggacggcagcctgctgctctacgggctctgagccagaagctcaccagagggttcaatgaagctctgaatgggctcgctgacgacgggtggtctgtgatcggaagtgacggggtggacgatgtctgcgtctctgtcagttcatccccgagtagagtggtcagctgcaatgcaactttcagtaccggacctgtagtcggcactggcagcagcagtgtgctctgcgcaaaggcatcgatgctgagctaggacgtttctccgccagagctcctgcgcttcatgcgggagcagcggtcgcagtgggccgacagcaatctagacgcgttcttcgcttctgcgatgaaaccggatttctgcagcttgcctattcctcctcgccttggagggtttggtggccaggtcatacttcctctagcccacacgtttgaccctgaagaattcctcgaggttataaaagtaggaaatgccggtaactaccaagacgcgctcctgcaccgtgatctgtttctgttgcagatgtacaacggggtagacgagaacatggcaggcacttgttcagagctcatgctttgcccctatagacgcatcgttcagcgacgactcg

SEQ ID NO: 796 - DNA, 348 bp, Zea mays
ggttttcttgaaagatcgtccatcttggtttcgtgattgtcggagtcttgaagtctatacagtgttaccagctggaaatggcggaaccattgaacttgtttacatgcagatgtatgctcctactactttagttcctgcacgtgacttttggacactgagatacacatccactatggaggacggctgtcttgtggtctgtgagagatccttaagtggttcaggagatggacaaagtgctgccacaacacaacaatttgtaagagctgagatgctttctagaggctatttaattcgccaatgtgagggtgggggctcgattgtgcgaatagtggaccatctggatcttga

SEQ ID NO: 797 - DNA, 467 bp, Zea mays
ggttccagaaccgcaggtgccgggagaagcagcggaaggagtcgtcccggctgcaggcggtaaaccggaagctgacggccatgaacaagctgctcatggaggagaacgaccgcctgcagaagcaggtctcgcagctcgtctacgagaacggctactaccgccagcagacgcagagcgcggggctggcgaccacggacacgagctgcgagtcggtcgtcaccagcggcccccagaacgtggccgcggtgctgccacaagcccagccgcgcgacgcgggccctgccgggctcatgtccatagcggaggagacactgacggagtttctgtccaaggccaccggcaccgccgtcgagtgggtccagatgcccgggatgaagcctggtccggattctattggaatcattgccatctcgcatggctgccccggtgtcgccgcgcgagcttgcggcctcgtgggcatggagcct

SEQ ID NO: 798 - DNA, 1131 bp, Glycine max
attcggctcgagataatccagagagaggagagagaagtaaaaaggtggaggaagaagcgaaaagcgagtgagggcagtgttgcttaataaaagaaaacgaacggtggtgataggcttcagtctagatctcaatcgtctccaccttgctttcttctccagcgtccgattctctcaccgatctcgcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtaggtatcaagtttattattgaccctcttgttgtaacgtatgttttctacgccagttaccaagtgctcacggcatattgaatgtctttttatgttatgtgaatactgacaggagatgttggttcttgtgtccgtttttttttttaaattaaggtttgtatattatctttggattcgaattattatttgaaagttattattatattgtaaatcctagagccctgttgtctgaatccatcaggcggcttggtaaagaccgagattttaggactgattgtaagcataaatccgaatattcttttcctaatttctttgcgcaataatgtatgaaaaaggctcgagcttctttttaaaaaaaaaaaaaaaggaacaaaaaaaaaaaaggggggg

SEQ ID NO: 799 - DNA, 993 bp, Glycine max
attcggctcgggaggaacgtgaaagtaaaacggacggtggcgatagaagcgtctctcatctccatcgtctcctcactcctctcttctccagcgttcattttttctcgcgcccaaatacaaaatcacatcacaacagggttccggcgaccatgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaagggtggagatgcatctgctaagagagatgtttatcagagtcctaatggccaggttgctcatcaaggttctttctcacaaggtgttaattatacgaattcttagccccaggctcaacatatgatagttccgatgcaaggccaagagtagatattgatcctctccttcagtgtttgacatgtgtgatctaaatgccagtggaacttttatgtcaatatgtgcccttggtatattgaatgcattttatgttatgtaaacactacatgcggggatgttggttcttgtgaccagatattatttattaagacttacatttatctttggaaaagaatcattattcataagttatattgtaaattctggaacaatgcttgtctgattccatcaatcgtcctggtaacgattttatgtacctgattggaagcataaattggtatattctttcccttcgttgtctgtt

SEQ ID NO: 800 - DNA, 1000 bp, Glycine max
taataaggttgtatatggtttggtgggatggctcgagagtctttagaaaagatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagcaccagcaccagggacacgtgtatggatctggatcagcatcttctgcaagaactagataacatgtgtcatctgtttaagcttaattgattttattatgaggatgatatgatataagatttatattcgtatatgtttggttttagaaatacaccagctccagcttgtaattgcttgaaacttccttgttgagagaatatagacattattgtggatggtgatgtggcatatgtggcatacacagaatttttgtattcttctttctctctatggatttttgtgtaagggcaggactatggctttgtttgctgatcgtatagctagtatggtgctatctaggttcggatttttttctttttcatgtataatgaaaaattaacggaggaaattactcttacgttactttgaaattaattaactaaatcccgcttctgcctttttttttttctcctttctgag

SEQ ID NO: 801 - DNA, 620 bp, Glycine max
  misc_feature (560)..(560): n is a, c, g, or t
tgaagaagattcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattcgccactccctagactttntatattatattatttaattaaactctcttctccactcaacctttgcaagatcactgggtt

SEQ ID NO: 802 - DNA, 1818 bp, Glycine max
tttttaaataataaaatgtttctttggaaatttcttaaaaagtatgaacataaatttaaattattattttatattaaatgcacttatgttaatttatttgtcttgcatacacatttaatgttatccttctttatatctatattaaactatatatataaagaaaagattttgaaatttgaataagataagagtgtccaggtcagaggcgagcacgtgccagataccaaagcaacggtccagatcatggagcactcaccaaatccaagggctccaattcgtccgtggacactcacacttatcgactaacaacggtccacaaatcgccacgtgtcctcaagataaagcgttattaacccttctgatccaacggatcctgctcattatctcccaaacaaacccctccgttccgtttcacctttccccttcccgccggagccgccgtcaccggtcgctggccaccgtatccgaccctcccaatacaccctttccgagtcccacacaaaattgcacgattctgtgatttcaattttcaggtctcgaggatttcgtttcagaagcgcttccatttgacgcagaaccaccgactcaaaccgattcgcgccgagttcgtgactcgaattttcaacttctcattcatattccaaatcgaatttgaaactccgaagaaaaattcaccgaacactgaatctcagtttccaaggagcttcttctacgaagagcgcttcaattccacgcagaaccaccaagtcaagccggttcgtgactcggattctcaattcctcgttcattcccgaacgaattttaaattccgaagaaaaccgcaccgaacactgaatttcagattctgaacaagtttcttccgcgaaacagcacagcacttcaatttcacgtggaacagagacaaagggattcgtggttcgaattctcaatcgattttcaaattccgaacagcgaacagtacttcaatttcacgtcgaactagtcaaagcgattcaaatcgatttcgcgaactcgtccgatattttccctgcactgacttagtgattcgtttcatctttctcagcgcgtcttcgatttttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcggagttcatcagcttccattcaccggggggcctcgccggtgagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatctggaactactactggatcagcatcttctgcaagaactagataacaggtttatgcatgtgttatctcatctgtttaagcttattaagggtggtctttttggatggtgattttgtttgattttagaaacaccccagctccagcttgtaattgttgcttgaaacttcgttgttgagagaatatagccattattgtggatggtgatgtgacatgcacagaatttttgtattcttctttcttccaatggatttatctcgggccc

SEQ ID NO: 803 - DNA, 1872 bp, Glycine max
aacataaataataaaatatttctttgaacatttcttaaaaagtatgaacataaatttaaattattattttatatttaatgtatttacattaatttatttgtcttacatacacttgtaatgttctccttatatttattaaactataatatagtatatataaagaaaagattttgagaatttgaataaaataagagtgtccaagtcagaggcgagcacgtgccagataccaaagcaacggtccagatcatggagcactcaccaaatccaagggctcctatttgtccgtgcaaactcacacttatcgcccaacaacggtccacaaagcgccacgtgttctcaagataaagcgttattaacccttctgatccaacggatcctgctcattacctcccaaacaagcccttccgttccgtttcacctttcctcttcccgccggagccgccgtcacccgccgccggcaatcgtatcagaccctcccaatacaccgtctccgacttccacgcagaattgcacgattcattgatttcaattttcaagtcttgaggatttcgtttcaacagcgcttcaatttgacgcagaaaaactgagtcaaaccaattctcccagagttcgtgacttggattctcaatttatcgttcattccgaatagaatttgaaactccgaagaaaactgcaccgaacactgaatctcagttaccgaggagcttcttctacgaaccgtgcttaattccacacagaaacaccgagtcaaactggttcgtgctgtgttcgtggttcagattctcaatcgaaatttgaaattcagaagaaaaccgcaccgaacacagaatttcagaatctgaacaagtttcttccgttaacagcacttcaacttcacgtggaacaagaatcaaaccgtttcgtggttcggattctcaattcctcgtccattcgcaatcgattttcaaattccgaagaaaaccgctccgaacactgaatttcagactctgaacagcgaacagtacttcaagttcacgtggaacgagtcaaagcgattccaatcaatttcgcgaactcctccacggtgaactccgatattttcctgcactgacttagtgattcgtttcatatttctcagcttcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagaccgtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttattattattattattattcttattcgtaagttaaaagaaatgtgagattcaaagtggtgattaagtgaattagtaacaaaaaagtgcgactcagttgattaaaaatatatataaattattataagtcttttaatatgtttttgattctcacacat

SEQ ID NO: 804 - DNA, 521 bp, Glycine max
agactttagctttacacaacatattattgtaaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctggggttcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatc

SEQ ID NO: 805 - DNA, 1156 bp, Glycine max
gaagttaggtaaaaatagtggaaatgagtatcttctttgttccatgtcttgcattgtctgcttagatttgtttttgtaaatcgattccaccaatcatcgctgtccttgtcgcgccaaatacaaaaaccaccacttctacctctctccttctgactctctcactctcaccgggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatcttatttatttccctttaatgcttgtacgcatggcatgggtggaaacaattgtctggtgatttaatatttaggttctcgtgtagaagggtgtcagaattttgttacggtactaatgtagatttttattaatacatgtcttatttagctttgtaatacctactcaagggagagatgtgtttagggttatgctagtgattcgccatgtagcttgtcagggtgagaagcacttgcttttagagttttctttagattattatataatatataatatttgcagacactgcatttgttagtttatttagtttaggccatacagtttgcttctctcttaatgatgtaaaaaatattcacttgtcattcatctagaaaattcgtaatagtgtaatagaatctttaaagacttgctaaaaaaaaaaaaaaaaagggcggccgcc

SEQ ID NO: 806 - DNA, 939 bp, Glycine max
  misc_feature (596)..(596): n is a, c, g, or t
  misc_feature (762)..(762): n is a, c, g, or t
  misc_feature (767)..(767): n is a, c, g, or t
  misc_feature (769)..(769): n is a, c, g, or t
  misc_feature (775)..(775): n is a, c, g, or t
  misc_feature (786)..(786): n is a, c, g, or t
taatatagtgcggctcgagctctgctttctgtgttattgtctggcttttggagccgatccaaccaatcatcgctggcgccaaatacaaaatctcatcccttcccctttctcttactgactctctttgtcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcaggtgcaaccacaacantctggttatgccttcaatgcaaggccatgaatagtttagatgcttctacgcatcttatttatttcccttgaatgcttgtacgcatggcatgggtggaaccaattgtctggtaaaaaaatgggggggctctcgtccccccgggtgggggggttttgtttcggtactngtgtngntttttnttaaaacacgncttgtagcgggtgtttctcttctcaagggagagatgtgtttagggttatgctagtgattcgaaatgtagcttgtcagggtgagaagcacttgcttttagagttttctttagattattatataagagagaatatttgcagacaaaaagacttac

SEQ ID NO: 807 - protein, 229 aa, Oryza sativa
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPQPPHHHHHQMVMGGKGKVEEVQSKGKIRDFLQLQASMLELIQGEN

SEQ ID NO: 808 - protein, 241 aa, Oryza sativa
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYREGDTKGSRASELPVKKDVVLNGDPGSSLVNYGAQRADANANHLDLFFLLRKNPESTTANCMREDEAKPVTVKIIETVYVEADTADDFKSVVQRLTGKDAVAGDAPELNSAQRFGSGREASRHGDHKVRIYE

SEQ ID NO: 809 - protein, 297 aa, Oryza sativa
MKSRKSYGHLLSPVGSPPLDNESGEAAAAAAAGGGGCGSSAGYVVYGGGGGGDSPAKEQDRFLPIANVSRIMKRSLPANAKISKESKETVQECVSEFISFVTGEASDKCQREKRKTINGDDLLWAMTTLGFEAYVGPLKSYLNRYREAEGEKADVLGGAGGAAAARHGEGGCCGGGGGGADGVVIDGHYPLAGGLSHSHHGHQQQDGGGDVGLMMGGGDAGVGYNAGAGSTTTAFYAPAATAASGNKAYCGGDGSRVMEFEGIGGEEESGGGGGGGERGFAGHLHGVQWFRLKRNTN

SEQ ID NO: 810 - protein, 137 aa, Oryza sativa
MKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQDIFTGHVVRLV

SEQ ID NO: 811 - protein, 285 aa, Oryza sativa
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQSNFHILVVLQSFAFPYMYQVAQIYCNKYEVSREQIWDTPQIMELSPWIPYTINRIWKETHGSQDIRIQGRPREAANSALDWQWPSKHSSLASNFYGTRVVGGHHEYQRSTKKDTTHVNFASGLGDLG

SEQ ID NO: 812 - DNA, 693 bp, Oryza sativa
taattttttttttttgaatttgaaacccaactttgcataaacttgtgtcagcatcacacctgcttgcgtaatagagtttagaaaagtttctcttagatctctttacccctctgaatttagcatatgcaggacagccggaaacggccaaatatggttagacacaaccacacaacacacgactgaactagaacctacaacaaatttggacatcctggctaacacaagaacatttcaaaaagaacgacgactaacattcgtggtaacaaggtattggaactttggaagcatcctgcttacaacataacaggatgctggagcgttctttccctaaaaacgatggttctccttcctagatgccattagcgtgccaatcagtatcacactcctcgtcctacatgccttcaaacgatgatccaggatctccattaagtacaacatctttctttactggcagttcagaagctcttgaaccctttgtgtcaccctccgtctcccggtagagcctgaggtagagcttgagaggctcgacatagtcctcgaatccgagcgtgcccattgaccagatcaggtcgtccccattgatggtcttgcgcttctccttgaggcacttgtcgcttgcttcgctggtgatgaagctgatgaactcggagacgcactcctggacggactccttggagtccttggcgatcttgc

SEQ ID NO: 813 - DNA, 523 bp, Zea mays
cccagcgtccgaggaaggctacgggcaccagggccacctgttgagccccgtgggcagcccgctgtcggacaacgagtccggcgccgcggcagcggccggcggcggcgggtgcgggagcagcgtggggtactgcggcggcggcggcggtgagtcgccggccaaggagcaagaccggttcctgccgatcgccaacgtgtcgcgcatcatgaagcgctccctgccggcgaacgccaagatctccaaggaggccaaggagacggtgcaggagtgcgtgtccgagttcatcagcttcgtcacgggggaggcctccgacaagtgccagcgcgagaagcgcaagaccatcaacggcgacgacctgctctgggccatgaccacgctcggcttcgaggcctacgtcgccccactcaagtcctacctcaaccgctaccgcgaggccgagggcgagaaggccgccgtgctaggcggcggcgcgcgccacggcgacggcggcggcgcggcggacgacgccggcccactcgccggg

SEQ ID NO: 814 - DNA, 1199 bp, Zea mays
cccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattatgccactaataattttctctctgtacgcactcagtaccacaatggggaaacctaataaagggctaatacagcagcaatttatggtaatattattgctccctgaattttgttaactaaagattctgtatcatgctatatgtatgtttccttttttcttcttctttgttttgacaattgcttctttctctacggtgtttatccatcagctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaaaaaaaaaaaaaaaaaaaaaaag

SEQ ID NO: 815 - DNA, 564 bp, Zea mays
gccttctcttctccagcgtccgatctctcccactcgccttcctcaccgcagctctcccggctcggtcgcttcgccacctccgtcctccccccgcgctcggtcgctcgccacctgctctcccctccctccacgttgctcgcgcccgcgcttatataagtgcacgaggaggagctcatggcggacgctccggcgagccctgggggcggaggcgggagccccacgcagagcgggagcccccagggccggcggaggtggaggcggtggcagccgtcagggagcaggacaggttcctgcccatcgccaacatcagtcgcatcatgaagaaggccatcccggctaacgggaagatcgccaaggacgctaaggagaccgtgcaggagtgcgtctcggagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagt

SEQ ID NO: 816 - DNA, 1053 bp, Zea mays
cattgggtacctcgaggccggccggcatcgcacccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaagtcttttatcaggctactcgttttctggaacaggattcatgcttagctttccctcctgtctgaatgtgatggttgcctgaatcctaatttgcc

SEQ ID NO: 817 - DNA, 1178 bp, Zea mays
gtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagttaacttcaaaatccagcgatggctccattaaaaaggatgcccttggtcatgtgggagcaagtagctcagctgtacaagggatgggtcaacaaggaacatacaaccaaggaatgggttatatgcaaccccagtaccataacggagatatctcgaactaatgaagacatggaccttttctgcgacagctgctcttccctgaggcgattttttggtctcagttatttactaagtaagacaccttgcggtgaccattaaagagtaaccaatcaccctcggtaggtccgtttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacaaaaaaaaaaaggaggaaaaaaaaagggcggccgc

SEQ ID NO: 818 - DNA, 2109 bp, Zea mays
ccacgcgtccgcccacgcgtccgggcttgctgagctggagctgatggatctagggtttgggttgcggtgatggtcctgcagcgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctacagaagtacagagaggtgcgtacggtgtttgggaatttgggggtcaggtcgtgcaatcgccaatctgtcacctggccgatcgtacctctgattgaacttaaataatcctgttgggcatcagcacgctaataagtgataagtgagctatccacttcccttccaatgcttcggccacatatttatacttctttagttgaggacataaagagaccccctgttcctgtgtactactccagtaaatacagctagtaaacacattatttttataaggtgaaccaattcgaaagcacttttatccatttaatactgaacagtgatcgaaacctctatttgatgttcttacatgggattgagttagcactcgtgcttggtaagatattataactactcacagccctatgtggctgtgtctgttctatgatgaaaagtagatgtaatgcaaatggataagagcggaaagagctcctacagtagtgtaattagagcatgttgtagtgcaagcttttggttgtttacacaaaagatacatgaaaccattccactgtaggtcatatacaatcttgcttagggtcctgaacatatctggtgcacatggttcacatattaaattatcaccatccattctagatctaacgtctttagttgtccattctagatctaacatctttagttgctctgtataattgtatattttgcaaagaaccccttccaccactactctctaccacttctaccctgctccgagggtgttctctgcaaaaatatatagaacacccatagatgttagatataggatgaatgatggtgatctaatatgtacaccatgtgcaccaaactcagtgcaccagatatattctcgagtttatttagctgtatttttctatacgctcttcgtattggttgaataatctgtctaatgaggtttctcttttggtcttatgtctggtggatgacatcacggattgcagatggagggtgatagcaagttaactgctaaatctagcgatggctcgattaaaaaggatgctcttggtcatgtgggagcaagtagctcagctgcagaagggatgggccaacagggagcatacaaccaaggaatgggttatatgcaacctcagtaccataacggggatatctcaaactaatgaaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattatatgtatttgtatcgggaggcataaatattgtgtaatttgtgttaaagactagtgtaattgaactatgggaagagctgctttggttgtaaccatattttgatgcccgtatattaggcaaaaacagaaggctgtgggcgtgcacaacatatttactgttcaccgaaatacttgtattgatgtatttccgcatcaattatagtcatcgtcagcttgtaactacggcaatgaataaataaaaattcactgagtaaaaaaaaaaaaaaag

SEQ ID NO: 819 - DNA, 1255 bp, Zea mays
aattcggcacgaggcaccctcccgggccgcccgcgcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatgaaggcatggaccttttctgcgacagctgctcttccccgaggcgggtttttgtgtcgcagttatttactaagtaagacaccttgcggtgaccattaaagagtaaccaatcaccctgggtaggtcaatttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatttggaggcataagtatcgtgtaatttgtgttatgactagtgtattgactattgaattatcagaagagctgctttagttgtaagatcacacaaaacagcctggaaagtataacaagattaaaactgaaccaaaaatgggcaataaataaattatcacatttacagtgaataaaaaaatccctgaacatggggcgttcattctaaagaatccaaatttacttgcactgcctggcaacttttttactcttttatgctgaaccctaagtttaat

SEQ ID NO: 820 - DNA, 1173 bp, Zea mays
cattgggtacctcgaggccggccgggattccccatctcccttcattgctcgctcgctcgctcgttgctcttctccagcagcagctccttcaaatgcaaatctctttgctgccgacgcagagactcgccaaatttccctccctcctcctagccttctcgtcgctcctgttcttctcgcatccccagcccaggtggtgtcccctgtcgcgttgatgcatgctccctcggcggtggccttgagctgaggcggcggagcgatgccggactccgacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtgagttgcgacgatacgttcagaatcagaatcgctgatactcctacgtagaattatacctacctaattgatgacaccgcaccgcacctcgttgtgctgcctgtccttgtacgtttactaattattgctgcctgtatgtaaatcaaaatctgaggctcccatttcgaaaaaaaaaaaaaaaaaagcggccggtgaactactcttcccgtttcgtttcatacgagaatcgaactcgttttcaattaaaaa

SEQ ID NO: 821 - DNA, 1064 bp, Zea mays
ctcagtctcaaactccccgctctcccccgcccgtccagctcgtgctccgcctccgctgctctgtcctcttccctcctctgcgtttctcctcagagctgtttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagaccatcaacggcgacgacctgctctgggccatgaccacgctcggcttcgaggactacgtcgagccgctcaagctctacctgcacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggctcggctcccgccgccggcttcttgcttggtgtcggtaattagcgctggtggcctgcgctggttaagttaaccttcggtttttcccccttttcttttcgtggtaagtaatgttgtgctgaatggagacagtgatatggttaagatagctccataacctctcggtaattaatcctgtgatttgtactcccaagctgctgctaaactgagctatgacacaatacaaatgctgccattaac

SEQ ID NO: 822 - DNA, 1158 bp, Glycine max
ctttctctctcttctgttttcctttttctcgagaaaattgtgttagggtttctgtgattgagcctgcaaacacttccttgagggcacaaaagattccattgtttgcttctttcagattaatttttttgtcagttcagatcttcaagaagaagaatccagagaagctatatatacatcatcgttgttctttgccaagacaaagaagaaaaatggtgagggggaaaactcagatgaagcgcatagaaaatgagacgagtaggcaagtaacgttctccaagagaaggaacgggttgctcaagaaggcctttgagctttcggtgctgtgtgatgctgaagtcgcactcatcatcttctctaccagagggaggctttatgagttctccagttcaagaggtgcctaagaaacttttaattcgttgtctattggagatgctccagtataaacaaaacagttgaacgctatcaaaggaagatcgaggacctgggtgtcagcaacaaaggaatccatgaaaatacacagcatctgaaggaagttgatatgagcatggcaaagaagatcgagcatctagaagattcaagaagaaagcttttgggagatgaattggataaatgcagtattgacgagttacaacagctagagaaccagctcgaacgcagcctggacaaaattagggcaacaaagaatcaattgttcaggaagcgaatcgagaagctaaaagaagaggaaaagtgcttactcgaagtaaataaacgcttacgtgagcagtaccggattgaacgacaacgttgtttgagtgatcaggatgtcgaattcgccacaaaaaaggagggagaagaggtggagacggagttattcataggaagacctgagagaagaatgccgttaaagttgaaacctacaacatatagtgctcatgcatacatagcgtaatctaaagattaaaaattactaatgcccatacaaacgctgctagcttccttgcagactgttatattcatgtcttattaagatatgtaattcttgttgtaccccaaatcacaacggcggttgtgaacgcctacttaaataatttatgtacaacagtcattatttcaaaactgttcgttagagtactatatatatcagtttggaatttttttaaaaaaaaaaaaaaaagg

SEQ ID NO: 823 - DNA, 683 bp, Glycine max
  misc_feature (644)..(644): n is a, c, g, or t
ctctttctctctcttctgttttcctttttctcgagaaaattgtgttagggtttctgtgattgagcctgcaaacacttccttgagggcacaaaagattccattgtttgcttctttcagattaatttttttgtcagttcagatcttcaagaagaagaatccagagaagctatatatacatcatcgttgttctttgccaagacaaagaagaaaaatggtgagggggaaaactcagatgaagcgcatagaaaatgagacgagtaggcaagtaacgttctccaagagaaggaacgggttgctcaagaaggcctttgagctttcggtgctgtgtgatgctgaagtcgcactcatcatcttctctaccagagggaggctttatgagttctccagttcaagatgctccagtataaacaaaacagttgaacgctatcaaaggaagatcgaggacctgggtgtcagcaacaaaggaatccatgaaaatacacagcatctgaaggaagttgatatgagcatggcaaagaagatcgagcatctagaagattcaagaagaaagcttttgggagatgaattggataaatgcagtattgacgagttacaacagctagagaaccagctcgaacgcagcctggacaaaattagggcaacanagaatcaattgttcaggaagcgaatcgagaagctaaaag

SEQ ID NO: 824 - DNA, 1777 bp, Oryza sativa
  misc_feature (53)..(53): n is a, c, g, or t
tcggcacgagggcgaggaggtgggacgagagacgacggcgatccacggccaantggcgattgccggtctcggtcggtcgcactcgcgctcgcgcgcgggcgcctcgtgggtcgcgggtttcccaggacgggaagtcgctcgcgcggtcgccttctttatttggctaccgccgccccccggccccccgcattccgcacgaggctcgtctcgtctcgtctctccactcccccacctcccatccgctactgctagtactactactacccggcctctcgccttctcgcgcggccgcgatttccgttcgcaaatccgcacccacggcggcgcgaggtcgccgtcgtcgtcgagccatttcgggggggtagtttataagggcttgcgcgaggagggggaggagtagcgggtagcggcggctcgagtcgagtcgagtcgccgtcgtcgtcggcggcggcggtcgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccagcctacagaaaaccatcgaccgctataaagcatacacaaaggatcatgtcaacaataagacaattcaacaagatatccagcaagtcaaagatgatactttaggtttggccaagaaacttgaagctcttgatgagtccagacggaaaatattgggagaaaatttagaaggatgctctattgaagaactgcgtggtctagaaatgaaacttgagaagagcctccacaacataagactaaagaagaccgagcttctggagcggcagatagccaagctgaaagagaaggagcggactttgcttaaagacaacgaaaatttacgcggaaagcatcgcaaccttgaggctgcggcgctggtggctaaccacatgacgacgacgacggcgccggcggcgtggccgcgggacgtgcctatgacgagcagcacagccggcgccgccgacgccatggacgtggagactgatctgtacattggattgcccggcactgagcgctcctccaaccggtcggagacaggttgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaaacggaaacaaagaattaacaaagctgtagcagaccagatcggcaaattgaaatgccaggtaatccagtatatatttcgcttccgttattcagggtggtggtgattgggcctctgacgtgtgggtgcttgggacggaggatttcttgggggttgttttttccccgagccaaatcaatctgctcgtgcccttgagatttcagttccgcccataagaactcccacgcacatttagcattcggagagtaattttgttaggttaaaagtatggtaagttataggtggtatgttatgtttttctttttcttttctcaatgttatctggtacctaagtttgtcaagaaaatcatagtggacacagtcaagtatttggggc

SEQ ID NO: 825 - DNA, 1065 bp, Glycine max
agttccttatgaacttcttgaagaataacagaaatacctcaaagaagacatgaatcctgtaaagaattaatgaaataagtgcataaactttttctatacagtttggaatcttcactctgaagttgaattgcagtttgaactttaaacctctgctggaatgaactatgataggtttactttagttagaaatgaggccaaccagtgcctcctgcttgtgatttcctcctactacccaccaaggtttgtaatgctcagcatggcgatggccagtgccttcttcctctgtagaagcaggaaggttaaggtcaaaaaagtccctaatttctggtgctgcttcctcaagtacaattgtttgactttgaaaatttcttgcactctcagacccaccagccaagtgatgagatctcttgtggccacccaaggcttggccagatggaaaaaccttgtggcaaattggacactcgtgccctttccccttcttggaatctctcactgtttcaacctcattgtcaaattgagtagtagtagtagcagtagtaacattagtaaccatttcatgttcttccacatactcgttcttcaggagcttactttctgttgtagggtctggggagagttctgcctccaactcagtgctgttctcactgctctcatttcttgaagcaaagcaacccttgatcctcttgtgactagccctgtggcctccaagtgcttgatatgagtggaagattttcttacaagtagtgcactcaaactttcctctcttattggagcttttgctgaattcaccttctgagttcttgttgttgttcacccaactcttcaaaggacttgacttcaactcagagtccataaactttgccttgattgaagtgtacttattgttactattatgattattatctgttccattgtcctcaaatgcagaattagaaaccatggtcttgctgaccccaaatccacttccaggactctgagtagtacccaaaagctctgaactcgtttttccttttgagttgagatttgaacaatccaaatttcccggacgcgtgggcggacgcgtgg

SEQ ID NO: 826 - DNA, 1341 bp, Glycine max
tacggctgcgagaagacgacagaaggggacacaagaagtcatcttttattgtacgccaaagaaaagaaaagaaagaaatcatagtttttttgggttgtgtgtgtcttttggtggaggaatgcttgtcacctactccttttaagttcccccaaaaacacttttgtgagtgagagaaagaagaagaagaagaagaagaagaagtagcataagtgatggatagacacaaatgcaagctttgttcaaggtctttctccaatggcagagcccttggtggccacatgaaggctcaccttgctactctccctctccctccaaagcctcactcttattcctcttcctctgactcagaacaagaacaagaacaagaatctcttaattatgctttaagggagaatcctaagaagagcttcagggttgcggatcctgaagacagagagagcgaaacagagtctagaaaccccactcgccaacgatccaagcgcaaccggaaatccaccatgccgaagctcacaccgccaccccaccccgaacccgagcctctcagctccgtctccgacacctcccccgaagaagacgtcgccatgtgcctcatgatgctctcccgcgacacgtggcagcaacacaagcacgccaatgcagctacacctaagaggcgctgcagtagcggatcagagatcaagaaaaatgtccgcgggaaccacctctgccacaaatgtcacaaatcctttcgatcttctcgcgcgttcggaagccacagaaatgtgtgttgtccccgcgaggaaggccaaaataattacaacaacaaccgtagcactaaggttttcgaatgtccgttctgttacaaggtgtttggctctggccaagcgctcggtggacacaagagatctcacctaattccttcctcgtcttcaaccgttaacgattctgttaagttgaaacatagcttcatagatctcaacttgccggctccggcggaagacgacgaccttagcgttgtttctgatgcgtaattcgatctcgatatgtttaattgttcaatgtttagttgtctggtggtgttactgataaagtggattttttttcttcttcttctttttttttttaaaagtaggtgagaatatttcattgtttattaacagatcaaatgctcttgattctacaatgatagctgagtataagccatgttctgtgtcttttttttttaacttttcgacaggtagaagatatgactagagttataacttacatggtgaattttattggtttatacgcaacttggttcatcgtactattaggttttaaacgtagtttcaatgcaaatttgagatttggttgtggacc

SEQ ID NO: 827 - DNA, 1056 bp, Glycine max
ccacgcgtccgtacggctgcgagaagacgacagaagggggagtgagtgagagaaagaagagaaggagttgaagtggttgttgtattgtagtagtgtgtaaagtcttggtgatggatagacacaaatgcaagctttgttcaaggtctttcagcaatggcagagcccttggtgggcacatgaaggctcaccttgcttctctccctctccctctccctccaaagcttcactcttgtttctcttcctctgactcagaacaagaacaatctttaagggagaatcctaagaaaaccttgaggattctggatcctgaagacagagagagcgagacagagtctaataagaacccgactcgtcaacgatccaagcgcaactggaaatctaccatgcccaagctcagcctcggacaccccgaagccgaacctctcagctccgtctccgacacctcccccgaagaagacctcgccatgtgcctcatgatgctctcccgcgacacgtggcaggaacacaaactcgccaatgcaggtccacccaagactcgctgcagcagcggatcagagatcaagctcaagaacaaagtccgctccaagcacctctgccacgcttgtcacaaatcctttcgatcctctcgcgctcttgggagccacagaaccctgtgctctccccgtcaggaagcccaaaataacagcatcattagtaataacaacattaaggtttttgaatgccccttctgttacaagctgtttggttctggccaagcgctcggtggacacaagagatctcacctaattccttcttcctcttcaaccgttaatcattctgtcaagttgaaacagagcttcatagatctcaacttgcctgctccggccgaagacgacgatcttagcgttgtttctgatgcctaattcgatctggcatatgttttaattgtttaatgtttagttgtctggtggtgttactcataaagtgaatttttcttcttcttcttcttcttctttataaaagtagctgagaatatttcattatgtttattgcccgatcaaaaaaggaaaaagaggg

SEQ ID NO: 828 - DNA, 1341 bp, Glycine max
gggaaatcaaagtaatgatgatggagttaagtagaattatacttaaaaacacaaacttgagatcagggtaattaaaataaaataatcttatattaattgattacgatgttacctagagtaacaatttagttgagaatctaggcacaatagagcataaattataagctatgattgtagcatcaaaagcatctgatctaacaatgaaccgcaatgaaatatcgttacctactataaaaaaagaaaaggactttacccaattgctgcagagaagaacaagtaattatcaggcatcagaaacaacactaaggtcgtcatcttcgggcggagctggcaagttgagatctatgaagctctctttcaatctaacagaatcattattagcggttgtggaagaagaaggcatgaggtgagatctcttgtggccaccaagtgcttgaccagacccaaacaccttggaacaaaaggggcattggaagattttactatcgttacccgaaccttcgcaaatgcttctgtgactgcccaatgcgcgtgaagatcgaaacgtcttcccgcagctctgacactggtgcttcccgcgaactctcctcaactttatctctagtactgatctcccaccctcctcctcctcttcttcttcttcttcttcctcttcgacaacatcctcatcattaacattaacaacgttgatgttgttgttcttactccatcggtctctcgacaacatcatgagacacatggcgacatcttcctcgggggaagtgtcggagaccgaactcacgggctcaggcgactccatgaaactcagtttgggctttttttgttccaaattcacgggccttcgggttcgcttggatcgtcggcgagttgggttctttgactcggtctcgctctccctgtcttgaacgacagagcccgtgtcaaactcgggatctgcgagcctgaagcatttcttgggattctctcttaacccataaatcagggacttttcatcgtgtgtggcttgttcttgttctgaagaggaattagaagagaaggaagcagcagcagagggagaaagtggtggttgttggttttgggggggaagagggagggtggctaagtgagccttcatgtggccaccgagggctctgccattggagaatgttctggagcagagcttgcatttgtaccgctccattagagagaggactttctttgtttattctgatacgtttggtttggtttggccttaggcttctttggggaatttgggaacttaaaaaggagtaggtaacaagcattcctccaccaataggacaccccctacagaggccctctcgcagccttcgtacgagtggt

SEQ ID NO: 829 - DNA, 1096 bp, Oryza sativa
ggtcgatgcgcgtgccggcgcccgtgcgcgacgagttcgtcgtcgacgaggagccggaggacgtcgccctctgcctcgtgatgctgtcgcgcgacaccggccggccatggaactcgagaccaagcgacgagtactcatctctcatgtacaacagcagctaccaccaccaccacgacgccgtctccgacgacgatttggagttgtccctctcctccccgtacgcggacaccgagatcaggaccaagaagaggaggaagacgacgggtgcggcgagcaccgccggcggcgagaagcggggccggtacgagtgccacggctgcggccgggctttcctgtcctaccaagctctcggcggccaccgcgctagccacaaacgtataaacagcaattgcagccttgtcaaacctccggccgatcagccggagccgagcatcgaaacatcgttcagctctgcctcgacgtcggtgtcaccagctgacaccatgatcagcgcggccaccatctcgaagacggtgaagaaagcaactaaattcgtgtgcccaatctgctccaaggagttcggctccggtcaggctctcggcgggcacaagcggtcgcactcgatcgcaggcgagctctacgagcgcggccacgccgacggcattgtcaagctggagcaacctttgctcgccgacaggtttcttgatctcaatctgccagctccaggaggagatgatggctgaagcttaattaggaggagatgatggctgaagcttaattttggttcctccaagttttgacattttttggggagagcatgggtatgtacagattcagattcaattcattcttttggagtttcagcttagttgatcatgagggattaaataattatattgttaggtctttagttaattactccagatttttcgaccagttttgttttgaatttagtgctttttgttagctctgttctgtttttgctccacattgggaggaaaataagaacatcatatgatctcaattgagaactggtacaatgaaatgcttccagaaaagatttcagttgaaaaaaaaaaaaaaagggcggccactcgcgatctagacggacgcgtgg

SEQ ID NO: 830 - protein, 232 aa, Oryza sativa
MKCSGIFQGGHHLSNTTATAKNYALDHMMVSSVSDATSEEDVALSLMMLSRDTWPATPPPPPPYRLRGAGYDDGSDGGDAPPAPAAAAAQKRTRFQCPACKKVFRSYQALGGHRASHMRGGRGGCCAPPPNPPPSPATPLQPLPECDGGEEEGAKPHPHECPYCFRVFASGQALGGHKRSQLCSAAAAAASGDDIPAMIKSNGFIDLNLPAPFDDVELSAVSDPFLSSKPGS

SEQ ID NO: 831 - protein, 311 aa, Oryza sativa
MAKNTCKLCYRRFGNPRALAGHMRSHSVAASRSQISSTSSASTSVAVGDDDGGGDAKRPIQGYVLREKPKRRVRLAESDFSDRESETEYYSSPPHGKRANTGSGDVEQVSSVSDATSEEDVALSLMMLSRDTWPATPPPPPPYRLRGAGYDDGSDGGDAPPAPAAAAAQKRTRFQCPACKKVFRSYQALGGHRASHMRGGRGGCCAPPPNPPPSPATPLQPLPECDGGEEEGAKPHPHECPYCFRVFASGQALGGHKRSQLCSAAAAAASGDDIPAMIKSNGFIDLNLPAPFDDVELSAVSDPFLSSKPGS

SEQ ID NO: 832 - protein, 317 aa, Oryza sativa
MSLASTSSTEIEMDEKKEMTKKTEQEKTLTSYVLRENPKRSYKVSAGEFSGGGGGGGGGGESSVVQDGESDTESSPPRGGAGSFFAVSRRRSKRARRRRRAPDPEPASSVSDATTEEDVAMSLLMLSRDSWTRSRSEHETHHRGASSEAEQNNNNVVNVFDEEDEDARDVAGEDHDEELSYGGGEAAAARHRTSRFQCGACRKVFRSYQALGGHRASLKRGKGGGCVPPPRPAPASSAAAPAIHECPFCFRVFDSGQALGGHKRAHMPSGGARPSPSPSPAKCGESSGSIDLNMPATMEDDFELSAVYDAEFASTRQ

SEQ ID NO: 833 - protein, 600 aa, Oryza sativa
MAMVVAGSHRPPPPPQSLRLVPPPPPQPPPPPLTYRHHCKVCKKGFMCGRALGGHMRAHGIGDDNDTMDDDDGRDDDHSLSPCDGGGEPSEAAGSPTTTTTKRMYALRTNPGRPRNCRTCENCGKEFTSWKTLLDHGRCGLDEEDGRLDVSLRSPPLHDGGDENDGEEEEEGDDLTLAAGGWSKGKRSRRAKVMAVGTGSVSELQLPAPSTEEEDLANFLVMLSSSSSSSSRVAQPAIVVDDADQESCASAPMMAQMTVIAPQVVPQHISTVPRGMFECKACKKVFTSHQALGGHRASHKKVKGCFAAKLESSRNETSQTQTQQQHVSAAPHDNTRATTSHVITSDISMDANTIGASADADGKAAASGVGAGEIVLAGASSTDMAMMMSVEDFAPTPLAPSAVSPFKKKGKVHECSICHRVFTSGQALGGHKRCHWLTSGATDPLTKLQPVAQDHAMMAAMCHQLTLGRPIFDPTDQRILDLNVPTNPLAEAVAARQQQQQQVAALNDGALCLNAAASVYLQSWTGHSNGSHVNKTTATSSRINDAAGGVTTEDDEADSTSAKRAKIGDLKDMKVAGESLPWLQVGIGISSESKEKNTQE

SEQ ID NO: 834 - DNA, 670 bp, Zea mays
  misc_feature (350)..(350): n is a, c, g, or t
ggtaccggcgcccctctctcgagtttttttttttttttttttttttttaaacaaaaaatgctcaactgttactctccgtctaattcttgcatggattggaagggacccaagccctttaccgcagcagctgcgcaagagcatcagccggtctgaagttggcgtcgtagcagtaagtatcggtcggatcgggtcagcagctggcctcactgtctggtgccgccgaactcggtgtcgtacacgggggagagctcgaagtcgtcgtccgtcgcggccggcacgttgaggtcgatggacatggagctgtcgtcgcatttcgctgctgccgtccaaggggacgggggccgcggggncgggcgcgccggacagcatgtgcgcgcgcttgtggccgcccagggcctgtccggactcgaacacgcggaagcagaacgggcactcgtggaccgccgggccgttctcggcgcggcgagccttggacgacggcgcggctggaggcggcaccggcaccggcaccggcacgcacccgccctttcctctcttgacgctggcgcggtggccgccgagcgcctggtacgaccggaacaccttcctgcacgcgccgcactggtgcctgcccgtggtccgagcgcgcgacgccgtgctcgtgatcggcatcgtgcgcgccgacgaacga

SEQ ID NO: 835 - DNA, 487 bp, Glycine max
aagaattcgcggccgcaggaatttttttttttttttttttaatgaatcacactttgttgaaaagaagcgcattagataaaacaattagcaaagccctggaaaaacatatttggaaggaaggaaggaaatgccaatggctagaaacaaaaataacagaatccatttaaccaaccccaactaacagtaacagactcaattcaatagaagaaaccataacacattctcactcatttccttttccaacattcggacattccctcgcaaaatgcccttcctccccacagttaaaacaccctcctcctcctccaccaccaccgccgcgtctccgattcctaccatcatcaccaccaccaccaccctgtccatggtaacaatcccttgccaagtgacctattcttccacagttataacactcagggcctcctcctctccgaccgaaccctctgccacggccttccccgcccccgtagcgtcctcctcctctgcc

SEQ ID NO: 836 - DNA, 860 bp, Glycine max
ggctcgaggaaaaagaggcgcaagatgagtggtagggtttctgggaaggtgaagtggttcaatgatcagaaggggtttggattcataagccctgacgatggcagcgacgatctcttcgttcaccaatctcagatcaaatctgacggtttccgaagcctcgccgaaggagagtccgttgagttcgccattgaatctgaatctgacggacgcgctaaggctgttgatgtcactggccccgacggcgccagcgtccagggaaccagacgaggcggtgatggtggccgaagctatggcgggggacgaggaggtggtggaggtggctacggtggaggcggtggctacggtggtggtggtggctacggtggaggcggtggttacggtggtggtggaagaggcggtggaggcggtgcttgctacaactgtggtgaatcgggacatctggctagggattgcagtggaggcggtggtggggacaggtaccgaggaggtggtggtggcagatatggaggcggcggtggcgggaggtaccgtggtggaggcggcggcggcggcggcggcggaggaagctgctacagctgtggagagtctgggcattttgccagagattgcccatcaagtgctcgttgaatttactgttagggttgtttatgttttgcggattgttttaagttttcactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgttatcaatt

SEQ ID NO: 837 - DNA, 992 bp, Glycine max
  misc_feature (978)..(984): n is a, c, g, or t
  misc_feature (987)..(987): n is a, c, g, or t
cccactcgtccgcccacgcgtccgaagggtttgtaagagaaagaaaaaagaggcgcaagatgagtggtagggtttctgggaaggtgaagtggttcaacgatcagaaggggtttggattcataacccctgacgatggcagcgaggaactcttcgttcaccaatctcagatcaaatctgacggtttcccgaagcctagctgaaggagagtccgttgagttcgctattgaatctgaatctgacggacgcgccaaggctgttgatgtcactggccccgacggcgccagcgtccagggaaccagacgcggcggtgatggtggccgaagctatggcgggggacgaggaggtggtggaggtggatatggcggtggcggcggctacggtggtggcggtggctatggtggaggcggtggctacggtggtggtgggcgaggcggtggtggcggggcttgctacaactgcggtgaatcgggacatctggctagggactgcagccaaggaggcggtggagacaggtacggcggaggcggtggtggtggtggcaggtatggaggcggcggtggcgggaggtacggtggtggtggaggaggtggtggcggcggaggaagctgctacagctgtggagagtctgggcatttcgccagagattgcccatcaagtgctcgttgaaattactgttatggtggtttatgttatgcggattgttttaagtttttactttaacatgttgtagggattttaatggtttctgtcaaagctgtggcttcttataagtagatgcgtgagatttttcttttttttggttatttaaatgaaagtttctgtgttatcgttacaatctgcaaacaaaatctgtttggacctacattttgctataatgaattggatgattgttatcaaaaaaaaaaaaaaaaaaaaaaaaaaaaaaaaaaaaaaaaaaaaaaaaaaaaaaaaaaaaaaaaaaaaaaaaaaaaaaaaaannnnnnnaanaaaaa

SEQ ID NO: 838 - DNA, 906 bp, Glycine max
ggctcgaggtgagaacaagaaaaagaggcgcaagatgagtggtagggtttctgggaaggtgaagtggttcaatgatcagaaggggtttggattcataagccctgacgatggcagcgacgatctcttcgttcaccaatctcagatcaaatctgacggtttccgaagcctcgcccgaaggagagtccgttgagttcgccattgaatctgaatctgacggacgcgcgaaggctgttgatgtcactggccccgacggcgccagcgtccagggaaccagacgaggcggtgatggtggccgaagctatggcgggggacgaggaggtggtggaggtggctacggtggaggcggtggctacggtggtggtggtggctacggtggaggcggtggttacggtggtggtggaagaggcggtggaggcggtgcttgctacaactgtggtgaatcgggacatctggctagggattgcagtggaggcggtggtggggacaggtacggaggaggtggtggtggtggcagatatggaggccggcggtggcgggaggtacgttggtggtggaggcggcggcggcggcggaggaagctgctacagctgtggagagtctgggcattttgccagagattgcccatcaagtgctcgttgaatttactgttagggttgtttatgttttgcggattgttttaagtttttactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgctatcaattattgttgtgatttgctatgaagattgaattgtat

SEQ ID NO: 839 - DNA, 795 bp, Glycine max
tgttagagaaagaaaaaagaggcgcaagatgagtggttgggtttctgggaaggtgaagtggttcaacgatcagaaggggtttggattcataacccctgacgatggcagcgaggaactcttcgttcaccaatctcagatcaaatctgacggtttccgaagcctagctgaaggagagtccgttgagttcgctattgaatctgaatctgacggacgcgccaaggctgttgatgtcactggccccgacggcgccagcgtccagggaaccagacgcggcggtgatggtggccgaagctatggcgggggacaaggaggcggtggaggtggatatggcggtggcggggcttgctacaactgctgagaatcgggacatcttgcttgggactgcagccaaggaggcggtggagacaggtacggcggaggcggtggtggtggtggcaggtatggaggcggcggtggcggcaggtacggtggtggtggaggaggtggtggcggcggaggaagctgctacagctgtggagagtctgggcatttcgccagagattgcccatcaagtgctcgttgaaattactgttatggtggtttatgttatgcggattgttttaagtttttactttaacatgttgtagggattttaatggtttctgtcaaagctgtggcttcttataagtagatgcgtgagatttttcttttttttggttatttaaatgaaagtttctgtgttatcgttacaatctgcaaacaaaatctgtttggacctacattttgctataatgaattggatgattgttatcggtt

SEQ ID NO: 840 - DNA, 704 bp, Glycine max
tgtgagaacaagaaaaagaggcgcaagatgagtggtagggtttctgggaaggtgaagtggttcaatgatcagaaggggtttggattcataagccctgacgatggcagcgacgatctcttcgttcaccaatctcagatcaaatctgacggtttccgaagccctcgccgaaggagagtccgttgagttcgccattgaatctgaatctgacggacgcgcgaaggctgttgatgtcactggccccgacggcgccagcgtccagggaaccagacgaggcggtgatggtggccgaagctatggcgggggacgaggaggtggtggaggtggctacggtggaggcggtggctacggtggtggtggtggctacggtggaggcggtggttacggtggtggtggaagaggcggcggcggaggaagctgctacagctgtggagagtctgggcattttgccagagattgcccatcaagtgctcgttgaatttactgttagggttgtttatgttttgcggattgttttaagtttttactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgctatc

SEQ ID NO: 841 - DNA, 840 bp, Glycine max
aattaagccgtccgttgcgcttcaatcttcatattcaagaggaggaacaagcctaatgaatcacactttgttgaaaagaagcgcattagataaaacaattagcaaagccctggaaaaacatatttggaaggaaggaaggaaatgccaatggctagaaacaaaaataacagaatccatttaaccaaccccaactaacagtaacagactcaattcaatagaagaaaccataacacattctcactcatttccttttccaacattcggacattccctcgcaaaatgcccttcctccccacagttaaaacaccctcctcctcctccaccaccaccgccgcgtctccgattcctaccatcatcaccaccaccaccaccctgtccatggtaacaatcccttgccaagtgacctattcttccacagttataacactcagggcctcctcctctccgaccgaaccctctgccacggccttccccgcccccgtagcgtcctcctcctctgcccctcccaccgccgccgccgcgaaatcctccgggaagacgagatctaacggctgaggtgacgtcgacggccatggtgcggccgtcgtcgccgtaatcgaggagaaactcaacggactgaccgtcggacaaagaacggtagccgtcggatcggatggaagtgaagtgcacgaagagatcatcggttccatcttggggagttatgaatccgaaacctttgtgcgcgttgaaccacttaacggtgcccgtggatctccgagtctcggccatggtggctcctgaaagaaaagaagtttctggaagattcttatttgggtttgggaaagttacgctgaattgagg

SEQ ID NO: 842 - DNA, 1056 bp, Glycine max
attcggctcgagaaagaggagaaggtatagactatagagagagagagagagagagatctgatccggagcgatgagtgagagtgagaagcagagggtaacggggaaggtgaagtggttcgatgaccagaagggttttggcttcataaccaccgacgacagcggcgaggaattcttcgtccaccagtcctccatccgatccgacggcttccgcagcctcgccctcggcgagtccgtcgagttccttattgactccgatcccgaaggccgcaccaaggccgtcgacgtcaccggccctgacgaatcgccagtccagggcacccgcggtggcggaggaggaggaagaggaagctatggtggaggtggcggaagaggtggctatggtggtggcggacgcggcggaagaggtggatatggaggaggcggcggaggctatgggggaggtggctatggcggaggcggtggttatggtggaggtggcggcggcggcggcggagggggatgctataagtgtggcgagactggtcacatagctagggactgcagccaaggtgggggtggcggtggaaggtacggcggtggtgggggtggcggcggaagctgctacaactgtggggagtccgggcattttgccagggactgcccttccagtgctcgttgatacaatagtacgggggtgtggccttgcttttgtgttctgtggttcttttgttttcttttttctaaatctgaatattaccctttagaaatagggttagctagggtgtggcttctttgcgttttcttttttcttttttcgggtttacattataagcaattagcttatgattagctcttggatttattggtttgctttttgggcttagggaaatgagagttttggtgaggttctgaaaccatcgactaaatactctgtttcctgtcgtgaacgtaatatgctctgccttaccttattttgttgaaatctttgaatatatcatggtatcatggtcctgctgttcggatggatggttgtgtatattttgaatatattgtgcaggaaatattgatttgttgtcg

SEQ ID NO: 843 - DNA, 655 bp, Oryza sativa
  misc_feature (1)..(1): n is a, c, g, or t
  misc_feature (7)..(7): n is a, c, g, or t
ngagcgnccgctcgcgtagcgagacgaggggaaaaaaaaatcaatcaaaccctaatcagatcagggagaggcgagggctagggtttcgactcctcggcgggcgatccatggcggcggcggcgaggcatcgggggacggtgaagtggttcaacgacaccaaggggttcggcttcatctcccccgacgacggcagcgaggatctcttcgtccaccagtcctccatcaaggccgacggcttccgctccctcgccgagggcgagcaggtcgagttcgccatctccgagagcgaggacggccgcaccaaggccgtcgacgtcaccggccccgacggatccttcgtcaagggcggcgccggcggcggcggcggtggcgggggaggcttcggatcgcgcggtgggggcggatctggcggtggcggccgcagctatggcggtagctggggccgggggaggagatccggcggtggtggacccggtgggggctgcttcaagtgtggggagtctggccacatggccagggactgcttcaacggcggcggtgtcggcgttggtggaggcggtggcggcggcggcggcgctggtggtggctgcttcaagtgcggcgagatgggccacatggctagggactgcttcaacagcggtggtggtggaagtgg

SEQ ID NO: 844 - DNA, 635 bp, Oryza sativa
gatccccgggctgcaggaattcggcacgaggcaaaccctagccatcgaatcgcgagagcggaagccaccgaggcggaggcggaggcggggaggagggcgcaatggcggggaaggaggagggccggatcttcgtgggcggcctgtcgttccacaccgacgagcgcaagctggccgacgcgttccgccgcttcggcaaggtcgtcgacgcccagatcatgctggagagacacacccaacgccatcgtggttttggcttcgtgacattttcagatccagaggcagttgatagcgctattaaagaaatgcactgtcaagaattagatggcaggactatatcagtgaacaaggctgagcctaagatgaatacagatgacacaaggtatgaaagtggtggtggacgaggagagtatcgtggtggtagaggtgatggaccacccccaggcaattgctttgagtgtggccgtgctggtcattgggctcgtgattgccctaatcctggtggtggtcgttctgcgcgatactcttcttctaagttcagcgctggtggcagaggagaccgtttttctggatcagataggtttggagaccgttacatggatgatcggtatgatggtgggtaccgggaaccctgtgat

SEQ ID NO: 845 - protein, 1433 aa, Oryza sativa
MALVPAGAGADPARGSSGSAFSYPQLTATNYTSWCIRVQAMMEDQGVWDAIEPVAGVAVDPRRDKKARSHLLQSLPEDLLMQVAKKRSAKEVWDCLKTRFVGADRVREARLQTLKGEFGAMVMEPGETLDQYAGRITAMSVRHSALGSTLGDSAMVKKLFDTVPEKFVSLVAGIEQFYDIDTMPFEEAVGRLKAYEERMRKKKAAAGGVTTDGQVLLTQAEWEAHFKKNGGESSPPQKNKPSGEGAGRGQGGRGRGRGRGAGGRGGTPRGDSGAGSGGGGRDKSHIKCFNCEEYGHYSNQCPHPKKKKGEAHLAQTEDAGPALLLAVTEDVPERASCGLVVREQRVWPKLLLADAGGHAGDVWFLDNGASNHMTGDRSKFRELDESITGRVKFGDASTVQIKGKGSILFSCKNGDQWLLQDVYYIPSLQCNMVSLGQLTETGHRVVMDEDVLEVFDKSPWRLVMKVRRTVNRLYRIELKLAHPVSLLSSLDDPAWLWHARLGHVNFQAMKLLVDKEMAGGVLAIVHPNQLCQSCLVTKQARAPFPAAAHFRAEEPLELLHIDLCGPITPSTMSGNRYFFLIVDDYSRWMWVFVLKTKDQSLDAFVKFKPLAENTAGRRVKTLRSDRGGEFLSGEFAQVCEEAGIQCHLTAPYSPQQNGVVERRNRTVMAMARSLLKGMRVPGRFWGEAVRHAVHLLNRLPTKAMGDRTPFEAWTGRKPQLGHLKVFGCTAHAKNTQPHLKKLDDKSAPYVYLGVEEGSKAHRLFDPRRGRIHVSRDVVFEENVPWEWTSAAGQEPTDFAMEEEPGEQLPSPATAAGVVPSYQAPSPGRRTGKEAVVAAEEVPSPASPVAASPTLPGTPTPGSPSTNSAGVVPSPGTDDNIDTDDGPRRYRSLADVLREAPRVDLVEDECDGEALLAESEEPSSYREAAGQPAWEEAMQREMEAIEKNKTWELAMLPAGHRAIGLKWVYKLKKNTAGEIIKHKAWLVAKGYVQKQGVDFEEVFAPVARLDTVRVVLAVAADRRWQVHHLDVKSAFLNGELEEEVYVAQPEGFARSGKEHLVLKLHKALYGLWQAPRAWNIRLDRSLRELGFDRCTQEQAVYTRGRGSDGIIVGVYVDDLIVTGENPSELKVFKEQMMGEFEMSDLGLLTYYLGIEVDQDESATTLKQTAYAKKLLSQFGMMECNSVSIPIDPRSQLSKDPEGHPVDATEYRRIIGSLRYLLHTRPDLSYAVGVASRFMERPTVMHFKAVKQILRYIKGTMDYGLVYAAGTGALKITGYTDSDLAGDLDDRRNTGGMAFYINQSLVAWSSQKQKTVALSSCEAEFMAATTAACQALWLRVLLAEVAGVEEKAVKLFVDNRLAIALMKNPVFHGRSKHIDTRYHFIRECVDGGQIVVEFVRTEEQRADALTKGLPAAKLATARHLLGVRSLGPRQN

SEQ ID NO: 846 - protein, 405 aa, Oryza sativa
MSFPDEEEDEAFLLAVAATEEAALASSDSSKRRRLSMTSSTSSSPTSATPPPAAVPEGPYLAALKGSHSSAWKQQQETLSQARKRPGGSQTLATPGSGSGSGGAQVARGGACFKCGDSCHWARECPQSVPATGGGGGGGAFGGSGGGGGGYGDAGGAVEEKACPCGAGSCLVLTSNTPRNPGRKFYRCPMRDNGGCNYFEWCDNPSPGPANVSGNTVFQSDTSVAHMLCPCGAGACLILTTKTGKNVGRQFYRCPANQGISYLFLNVRSGHISREVALVAISSGVMNNSLGQLLHCKLQHNIILMLLQVAKFPARGAPPPASNAGKRTIGQRTAQINLQILILTKVGEHLLLQALPMRVSSVVRAGTGPVIAPPQIVVLVPSPAMSSPLLLWAHGTATDTDSRYL

SEQ ID NO: 847 - protein, 1322 aa, Oryza sativa
MALVLATSDPARGSSGSAFLYPQLTATNYTSWVIRVQAMMEDQGVWEAIEPAAGAAVDPRKDKKAKSHLLQSLPEDLLMQVAKKRSAKETLKGKFGAMVMEPGETLDQYAGRITAMSVRHSVLGSTLTDAAMVKKLFDTVPEKFVSLVAGIEQFYNVDDMPFEEAVGRLKAYEERAEWEARFKKDGGESSSPQKGKASGEGAKGGQSGRERGRGRGAGGRGGAARGNSASGSGGGGRDKSHIKCFNCEEYGHYSNQCPHPKKKKGEAHLAQAEDAGAVLLLRVTEDAPARATQEMVVPQGCGAMAGNVWYLDNGASNHMTGDRKKFRELDESIPGSVRFGDASSVQIKGKGSILFSCKNGDQWLLQDVYYIPSLCCNMVSLGQLTETGHRVVMDEDVLEVFDKCPWRLVMKLCQACLVAKQIRASFLVVVNYRAEEPLELIHIDLCGPISPATMAGNKYFVLIVDDFTRWMWVFVIKSKDQAVEAFTKFKPLAENVAGRRIKTLRSDRGGKFLSGEFAQVCESAGIQRHLTAPYSPQQNGVVERRNRSVMVMARSLLKGMSVPGRLWGEAVRHAVYILNRLPTKAMGNRTPYEAWTGKKPHLAHLRVFGCTAHAKITTPHLKKLDDRSAPYVYLGVEEGSKAHRLFDPRRGRIHVSRDVIFEENAVWQWLGDAGEQVSVEFDVEEIVESPAGSATSLPGAVPRYQAPSPGRRLGKEPVVVEEEASSPAGTAEASPSLPTTPATPIGEQSTPHSAGEIDTDGAPVRYRHIADILRDAPRVDLVDDEQDGEALLAETEEPSAYREAAGHSAWEDAMAMEMDAIERNGTWELTTLPAGHRAIGLKWVYKLKKNTAGEVIKHKARLVAKGYVQRQGVDFDEVFAPVARLDTVHHLDVKSAFLNGELEEEEQAVYTWGIGSGGVIVGVYVDDLIVTGENPVELKMFKEQMMGEFEMSDLGLLSFYLGIEVDQGENGTTLKQTAYARKVLSQFGMLECNSTSIPIDPRMQLNKDADGHPVGYYWVYRQRPAGDVDDRRSTGGMAFYINGSLVAWSSQKQKTVALSSCEAEFMAATTAACHALWLRALLVEIVGGPAKVVKLFVDNKLAIALMKNPVFHGRSKHIDTRYHFIRECVDGGKVVIEFVRTEEQQADALTKVATVEGISLRLLADANDAVIESEEDRVGSVRDAGLQQRQEHERAHAGHVAGRGGVEPCHGGARGDLGVDVEEKAAAVERWSRQVVIARVAIDRSVEARRLYQTVFFEGFGERSGTVLMRIVNVGLVQLAVATKKAIVVRDSGAGKWWGRSMSRACLHEMNLYSLLQSMKPF

SEQ ID NO: 848 - protein, 1409 aa, Oryza sativa
MALVPAGAGADPARGSSGSAFSYPQLTATNYTSWCIRVQAMMEDQGVWDAIEPAAGVAVDPRRDKKARSHLLQSQPEDLLMQVAKKRSAKEVWDCLKTRFVGADRVREARLQTLKGEFGAMVMEPGETLDQYAGRITAMSVRHSALGSTLGDSAMVKKLFDTVPEKFVSLVAGIEQFYDIDTMPFEEAVGRLKAYEERMRKKKAAAGGVTTDGQVLLTQAEWEAHFKKNGGESSPPQKNKPSGEGAGRGQGGRGRGRGRGAGGRGGTPRGDSGAGSGGGGRDKSHIKCFNCEEYGHYSNQCPHPKKKKGEAHLAQTEDAGPALLLAVTEDVPERASCGLVVREQRVWPKLLLADAGGHAGDVWFLDNGASNHMTGDRSKFRELDESITGRVKFGDASTVQIKGKGSILFSCKNDDQWLLQDVYYIPSLQCNMVSLGQLTETGHRVVMDEDVLEVFDKSPWRLVMKPRRPGLAVACAAGTRKFSSNETAGGQGDGGGVPAIVHPNQLCQSCLVAKQARAPFPAAAHFRAEEPLELLHIDLCGPITPNTMSGNRYFFLIVDDYSRWIWVFVLKTKDQSLDAFVKFKPLAENTAGRRVKTLRSDRGGEFLSGEFAQVCEEAGIQRHLTAPYSPQQNGVVERRNRTVMAMARSLLKGMRVPGRFWGEAVRHAVHLLNRLPTKAMGDRTPFEAWTGRKPQLGHLKVFGCTAHAKNTQPHLKKLDDRSAPYVYLGVEEGSKAHRLFDPRRGRIHVSRDVVFEENVPWEWTSAAGQEPTDFAMEEEPGEQLPSPATAAGVVPPYQAPSPGRRAGKEAVVAAEEVPSPASPVAASPTLPGTPTPGSPSTNSAGVVPSPGTDDNIDTDDGPRRYRSLADVLREAPRVDLVEDECDGEALLAESEEPSSYREAAGQPAWEEAMQREMEAIEKNKTWELAMLPAGHRAIGLKWVYKLKKNTAGEIIKHKARLVAKGYVQKQGVDFEEVFAPVARLDTVRVVLAVAADRRWQVHHLDVKSAFLNGELEEEVYVAQPEGFARSGKEHLVLKLHKALYGLRQAPRAWNIRLDRSLRELGFDRCTQEQAVYTRGRGSDGIIVGVYVDDLIVTGENPSELKVFKEQMMGEFEMSDLGLLTYYLGIEVDQDESATTLKQTAYAKKLLSQFGMMECNSVSIPIDPRSQLSKDPEGHPVDATEYRRIIGSLRYLLHTRPDLSYAVGVASRFMERPTVMHFKAVKQILRYIKGTMDYGLVYAAGTGALKITGYTDSDLAGDLDDRRSTGGMAFYINQSLVAWSSQKQKTVALSSCEAEFMAATTAACQALWLRLLLAEVAGVEEKAVKLFVDNRSAIALMKNPVFHGRSKHIDTRYHFIRECVDGGQIVVEFVRTEEQRADALTKGLPAAKLVTARHLLGVRSLGSRQN

SEQ ID NO: 849 - protein, 205 aa, Oryza sativa
MADVEEYRCFIGNLSWSTTDESLKDAFGKFGNLTEAKVVFDKYSGRSRGFGFVTFDEKKAMEDAIEGMNGLDLDGRAITVDKAQPQGPGRDRNGDRDYDRDRGSRYDRGRDFGGGGRAPRGSGGGGDCYKCGKPGHFARECPSGDGGGRGDRYGGRDDRYGGGGGGGGRYGSDRGGDRYSGRSRDGGGYGGGGGDRYSRDRSGPY

SEQ ID NO: 850 - protein, 1433 aa, Oryza sativa
MALVPAGAGADPARESSGSAFSYPQLTATNYTSWCIRVQAMMEDQGVWDAIEPAAGVAVDPRRDKKARSHLLQSLPEDLLMQVAKKRSAKEVWDCLKTRFVGADRVREARLQTLKGEFGAMVMEPGETLDQYAGRITAMSVRHSALGSTLGDSAMVKKLFDTVPEKFVSLVAGIEQFYDIDTMPFEEAVGRPKAYEERMRKKKAAAGGVTTDGQVLLTQAEWEAHFKKNGGESSPPQKNKPSGEGAGRGQGGRGRGRGRGAGGRGGTPRGDSGAGSGGGGRDKSHIKCFNCEEYGHYSNQCPHPKKKKGEAHLAQTEDAGPALLLAMTEDVPERASCGLVVREQRVWPKLLLVDAGGHAGDVWFLDNGASNHMTGDRSKFRELDESITGRVKFGDASTVQIKGKGSILFSCKNGDQWLLQDVYYIPSLQCNMVSLGQLTETGHRVVMDEDVLEVFDKSPWRLVMKVRRTVNRLYRIELKLAHPVSLLSSLDDPAWLWHARLGHVNFQAMKLLVDKEMAGGVPAIVHPNQLCQSCLVAKQARAPFPAAAHFRAEEPLELLHIDLCGPITPSTMSGNRYFFLIVDDYSRWMWVFVLKTKDQSLDAFVKFKPLAENTAGRRVKTLRSDRGGEFLSGEFAQVCEEAGIQRHLTAPYSPQQNGAVERRNRTVMAMARSLLKGMRVPGRFWGEAVRHAVHLLNRLPTKAMGDRTPFEAWTGRKPQLGHLKVFGCTAHAKNTQPHLKKLDDRSAPYVYLGVEEGSKAHRLFDPRRGRIHVSRDVVFEENVPWEWTSVAGQEPTDFTMEEEPGEQLPSPATAAGVVPSYQAPSPGRRAGKEAVVAAEEVPSPASPVAASPTLPGTPTPGSPSTNSAGVVPSPGTDDNIDTDDGPRRYRSLADVLREAPRVDLVEDECDGEALLAESEEPSSYREAAGQPAWEEAMQREMEAIEKNKTWELAMLPAGHRAIGLKWVYKLKKNTTGEIIKHKARLVAKGYVQKQGVDFEEVFAPVARLDTVRVVLAVAADRRWQVHHLDVKSAFLNGELEEEVYVAQPEGFARSGKEHLVLKLHKALYGLRQALRAWNIRLDRSLRELGFDRCTQEQAVYTRGRGSDGIIVGVYVDDLIVTGENPSELKVFKEQMMGEFEMSDLGLLTYYLGIEVDQDESATTLKQTAYAKKLLSQFGMMECNSVSIPIDPRSQLSKDPEGHPVDATEYRRIIGSLRYLLHTRPDLSYVVGVASRFMERPTVMHFKAVKQILRYIKGTMDYGLVYAAGTRALKITGYTDSDLAGDLDDRRSTGGMAFYINQSLVAWSSQKQKTVALSSCEAEFMAATTAACQALWLRVLLAEVAGVEEKAVKLFVDNRSAIALMKNPVFHGRSKHIDTRYHFIRECVDGGQIVVEFVRTEEQRADALTKGLPAAKLATARHLLGVRSLGPRQN

SEQ ID NO: 851 - protein, 197 aa, Oryza sativa
MASERVKGTVKWFDATKGFGFITPDDGGEDLFVHQSSLKSDGYRSLNDGDVVEFSVGSGNDGRTKAVDVTAPGGGALTGGSRPSGGGDRGYGGGGGGGRYGGDRGYGGGGGGYGGGDRGYGGGGGYGGGGGGGSRACYKCGEEGHMARDCSQGGGGGGGYGGGGGGYRGGGGGGGGGGCYNCGETGHIARECPSKTY

SEQ ID NO: 852 - protein, 309 aa, Oryza sativa
MAEKEVGRIFVGGLSWDTTERTLERAFSEYGKVIETQMVVLERDTGRSRGFGFVTFSEPRAVDAAIRGMHNGELDGRTISVNKAQPRMNTDDGYGYGGGGGGGGTYSSGARGGYRGGGDAVPSANDDCFKCGRAGHWARECPYSSGGGGGRTGRYSPPSRYGSGTGGGRGDRFGGSDRFANRYVDDRYDGGRYVDDRYGGGGRDRYATDRYPPTADRFTGDRYGGSDRYASSGFTRERSYERDGGRSGGSYYRDEPRGSGGYDKGGMRMGSGDRYGTGGPARFAGSYRDRPAPYDRPSRAAARTYDDRY

SEQ ID NO: 853 - DNA, 469 bp, Oryza sativa
gagagtcatccatggcttccaccgtcgccctcaagggccgcccgctcgccaccctcctcaggcagctcctcgccgccgacgcgccgcccgccgccaccgggaggcccgtcgccgccgctcccgccgcctccgggaagcccgtgaccgcccccgccgccgcgaccgccaccaacgccgcctcccgccgcctgtacaacaccgagggcgcgccgctccgccgctacgacgtcgtcgacgagtccggcaccgacagcggcgacgagtacgacgccaccgctacggcggtgaccgcggctacggcggcggcggcggcggctacggcgggggcgaccgcggctacggaggcggcggcgggtacggcggcggcggcggaggcagccgcgcgtgctacatgtgcggcgaggagggccacatggccagggactgctcccagggaggaggcggcggcggtggctaccgtggtggtggc

SEQ ID NO: 854 - DNA, 1377 bp, Zea mays
cccacgcgtccgccattagctttatctactccagagcgcagaagaacccgatcgacaccatgagggtgttgctcgttgccctcgctctcctggctctcgctgcgagcgccacctccacgcatacaagcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggaggcggcggcggctacggctcccgcggcggtggcggatctggcggcggcggtcgcagctacggtggtagctggggcggcggccggagatccggcggcgggggcggtcccggcgcgtgctacaagtgcggcgagcccggccacatggcaagggactgccctagcgccgacggcggaggcggctatggcggaggcggctacgggggcggcggctacggaggaggaggaggaggcggtggctgcttcaagtgcggcgagcctggccacatggccagggactgctccagcggcggcggcggctacggcggtggcggcggcggtggtggtggcggctgctacaactgcggccaggccggccacatggccagggactgcccaagcggtggcggcggtggcggagggaggttcggcggcggcgggggtggaggcgaccgctcctgctacaactgcggcgaggccggccacatcgcccgcgactgtcccacgtgaggtgtgtccgcgtccgtccagccagccagatcggatcggatcgctccaccacctgctggtctgatggcgccgcccccttctagatctcgcttaaaaaaacatccccctctcgctgtgtgtcggagtaccgctttagttttgccgatccgggcacgagtgcccgctgcctctttcgtaagaggatcccgtccgccgttttcagatttcgttcggttcgtagaagaactctcaagttaagttaagttatcatggtgtgtgcttggtcgtcgtccgtcgttcgtcgtcgtcgttaaggttttaagagatgatttggtcctgtgttgccgaggggaagtccaatctgcttttcttttcttttttgtggtttgttccatcagactgaggaaggagatgagatgattattctcccagattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 855 - DNA, 1408 bp, Zea mays
cgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggcggcggcggcggcggctacggctcccgcggcggtggcggatctggcggcggcggtcgcagctacggtggtagctggggcggcggccggagatccgcgcccgacgccgctttcggctccgtcctctccggcaccgccggcgacgccgcccccagcgaccagtggttcgtcgacgcgctcaacgcccccgcgccgcaccccatcgagcgcgtccgatccgagtcctcctcgatcgtctccgacgtccccgactacctcttcagcctcgacagcccgtccgacgaccccagccccggcccctcggcggctcgcgccaagtccgacgccacggagactccgcaccaccacggcgacgacgtgccgccttccgctcgacagataccgcacgtcgcaggaggagcgtcatcgtggcccgccccgccgccgccgtacatggcgcagcctatgtactacttccccgtgccgccaccggtccactatctcgaccagtctgcgcagagtggctacatgcctcgcccgatctaccacattgtcggtggcggaggaagcgaggcgcctggcggagatcttcacgcggccggcggagtctacggcgtctcgcaccacatgcaggggttcccgccgatgatgtacgcgccgccgcgcgcggtcatctacaactacaagtcggaggggatgccatcgctgcctccggaaggtggggcacactcttcctaggcgcatcgactacttcacatctctgaatcctgattattgttgcagatgcctaagctaaggagttttgcgtggtattttttttatcgattcgtctaagtcttgttcgttgttttgtatagatggaggggttgatggtgatggatagatattaatgcagctttcgtctagtggaaatatattcgtgaaatgtatatcatactaaatagtatagcatttggtgtgattaattagtattctagttaatgtaatgtgggattcatataatctaggtggttctggtcttatagaaaccatttttgggcattttatatttacataaactggatgttgggtgaatgttctaagcagtatgtgctgtgttgaacctcaatcacttatgagtggttactaaatttgaatttgatgtcttc

SEQ ID NO: 856 - DNA, 1186 bp, Zea mays
gcagcgagagacgggcaggggaggaaaaaaatctaaccctagcatccgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggcggcggcggcggcggctacggctcccgcggcggtggcggatctggcggcggcggtcgcagctacggtggtagctggggcggcggccggagatccggcggcgggggcggtcctggcgcgtgctacaagtgcggcgagcccggccacatggccagggactgccctagcgccgacggcggaggctacggcggaggcggctacgggggaggcggctaccgaggaggaggaggcggcggcggcggtggctgcttcaagtgcggcgagcctggccacatggccagggactgctccagcggccggcggcggctacggcggtggcggcggcggtggtggtggcggctgctacaactgcggccaggccggccacatggccagggactgcccaagcggtggcggcggtggcggagggaggttcggcggcggcggggttggaaggcaaccgctcctgctacaactgcggcgaggccggccacatcgcccgcgactgtcccacgtgaggtgtgtccgcgtccgtccagccagccagatcggatcggatcgctccaccacctgctggtctgatggcgccgcccccttctagatctcgcttaaaaaaacatccccctctcgctgtgtgtcggagtaccgctttagttttgccgatccgggcacgagtgcccgctgcctctttcctctcatgcgtaagaggatcccgtccgccgttttcagatttcgttcggttcgtagaagaactctcaagttaagttaagttatcatggtgtgtgcttggtcgtcgtccgtcgtcgtcgtcgttaaggttttaagagatgatttggtcctgtgttgccgaggggaagtccaatctgcttttcttttcttt

SEQ ID NO: 857 - DNA, 1287 bp, Zea mays
cccacgcgtccgcccacgcgtccgcagcgagagacgggcaggggagaggaaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggaggcggcggcggctacggctcccgcggcggtggcggatctggcggcggcggtcgcagcctacggtggtagctggggcggcggccggagatccggcggcgggggcggtcccggcgcgtgctacaagtgcggcgagcccggccacatggcaagggactgccctagcgccgacggcggaggcggctatggcggaggcggctacgggggcggcggctacggaggaggaggcggcggcggcggtggctgcttcaagtgtggcgagcctggccacatggccagggactgctccagcggcggcggcggctaccgcggtggcggcggcggcggcggtggtggtggcggctgctacaactgcggccaggccggccacatggccagggactgcccaagcggtggcggcggtggcggagggaggttcggcggcggcgggggtggaggcgaccgctcctgctacaactgcggcgaggccggccacatcgcccgcgactgtcccacgtgaggtgtgtccgcgtccgtccagccagccagatcggatcggatcgctccaccacctgctggtctgatggcgccgcccccttctagatctcgcttaaaaaaacatccccctctcgctgtgtgtcggagtaccgctttagttttgccgatccgggcacgagtgcccgctgcctctttcgtaagaggatcccgtccgccgttttcagatttcgttcggttcgtagaagaactctcaagttaagttaagttatcatggtgtgtgcttggtcgtcgtccgtcgttcgtcgtcgtcgttaaggttttaagagatgatttggtcctgtgttgccgaggggaagtccaatctgcttttcttttcttttttgtggtttgttccatcagactgaggaaggagatgagatgattattctcccagattaaaaaaaaaaaaaaaaaag

SEQ ID NO: 858 - DNA, 656 bp, Zea mays
gtggaggcggtgaccgcggctatggcggcggcggcgaccgtgtctacggtggtggaggtgaccgcggctacggccgcggcggcggaggcggctacggtggtggtggcggcggcggtcgcggctgcttcaagtgcggcgaggagggccacatggcaagggactgctcccagggcggcggcggcggcggctacggaggtggcggcggcggtggttacggaggtggcggcggtggccgcgagtgctacaactgccaccaggagggccacatctcccgcgactgccccgagaagatgcgctaggcgcggcgccaccgtcgcgtcggatccggcggagtcccatgtcgtctctcgcccgcttccctacccgctcaaggtatcgctcggctgactctgcctgaagtcgtcggagccagttatctatcagtagtagcagtgtcgtgtttcgttctcgtcgatgctatcgtatcgtaggtggtggtagcaagaaaagcaagccgtatggggctatctttagtagtttggatctgtgttggagcagtatcagtttctttctgttggaatcgtcagttgtatggcagccattttcatggatggctctgcctaatctatcagtcatgaactatctataatatatcaatgcaatcgtgtcggttggcc

SEQ ID NO: 859 - DNA, 534 bp, Zea mays
tcgttccacacccctcaccgcgtccgcctcccctaccatctagggtttctagggttttccaggaggaggaaatggcgtctgatagggtgctcgggactgtgaagtggttcaacggaaccaagggcttcggtttcatcacccccgacgatgggagtgaggacctgttcgtccaccagtcatccatcaagtccgacggctaccgcagtcttaacgacggcgatgccgtcgaatacaccgtcggcagtggcaacgacggccgcgccaaggccctggatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacggtggaggtggcgaccgcggctacggcggcgaccgtggctacgggggaggcggcggctatggcggtgggtacggtggaggcggcggtggag

SEQ ID NO: 860 - DNA, 1273 bp, Zea mays
gggtacctcgaggccggccggggttcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacgggtggaggtggcgaccgcggctacggcggcggcggcgaccgtggctacgggggaggcggcggctatggcggtgggtacggtggaggcggcggtggaggcggccgcggctgcttcaagtgcggcgaggagggccacatggcaagggactgctcccagggcggcggctacggagggggaggcggcggcggccgcggcagcgagtgctacaactgcggccaggagggccacatctcccgcgactgccccaacaaaaggcgttaggcgcggcgccaccgtcgcgtcggatccggcggagtcccatgtcgcctctcgccgcttccctacccctccaaagtacccctccaaaggtatcgctcggccgactcttgcgtgaagtcgtcggagcaaactatctatcagtagtactagcagtgtcgtttcgttttggtctgtcgtggtggtaagaaatgcaagtagtaggtgtgaatgcaagtgagcagcaccagtatctttccgtttgaatcagttgtaaggcagtcatggtcatggttggctctgccggatctatctgtcatgaactatctatattatatcattatcaatgttgaaatatatatacttcatagactcgataggttccgatgcacgtaccctgacggtcagaatatcgcgtcccacatctacaaaggctgcatgctcatgtacccgtgcatgctggtgtagcatgctgcgatacgaccgctatcgttcgcttctggaagtacagctcaactagctctctcattggaagcccatgacgttctctagattagccgtccggacgatgtac

SEQ ID NO: 861 - DNA, 1878 bp, Glycine max
ggagggaagtggaagctagtagtccgtttcagcgtgtgtgatactttcctttcatcttcttcttctctctgcgataaaagcaaaacctaaaatttggtttaggcataggaatctgttgtagagttgatctacctggaatggagggagcatcgtggaatagtagtgtttgtgtggcaccgtttctgagcaagacctacgacatggttgatgatccttccaccgacttagtggtgtcgtggggcgaaaacaacaactcctttgttgtttggaacgttccccaattcgccacagacatcttgcccaatcattttaagcacaacaacttctccagcttcgtcagacagttgaatacttatggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagagcccatgcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcacctgctgttttgggtttctgtagaagtcaggggatggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgtttttaaggccaagcccacttacagaagacacagaggaaactaaatgtagctctctaggatgtggtttgactgaagatcagggtttgccttcagaaatgggaaataagcaggaaaattttgatacaatacaacatgttgactgtcttactcaacagatgggacttcatgcattggagtactgattgtgtgtatatatgttactcacaactgaaggttgaggtcccctttgctactgagcagacaaagccatcttacttatacaacaaagaaacctgacagatccaacaacttgatcggtgcttttatccgcttgtaatgtcgtcgtgtgttctgtttgtcattgggggcttaaaaacatacaagttcacgaaacttcatatatctccatgtattttgaattttaataactatgcccccgtttccaatgcgatgatatttttgtggggatgttccgtatacaaaaaaaaaacaaaaaaacaaacttggatcataactcttgaattgctgttgaaaaactaaagtttactg

SEQ ID NO: 862 - DNA, 2116 bp, Glycine max
attcggctcgaggtgtgatactttcctttcatcttcttcttctctctgcgataaaagcaaaacctaaaatttggtttaggcataggaatctgttgtagagttgatctacctggaatggagggagcatcgtggaatagtagtgtttgtgtggcaccgtttctgagcaagacctacgacatggttgatgatccttccaccgacttagtggtgtcgtggggcgaaaacaacaactcctttgttgtttggaacgttccccaattcgccacagacatcttgcccaatcattttaagcacaacaacttctccagcttcgtcagacagttgaatacttatgtgggcatcacatcactttttctcccatcattatcatcttatcttatttcttcttcttcttcttcttcttcttcttcttattattattattattattgctttttgcttatgctaaacccctctttttctattatggggtgaaaagggattgaaggattgttgttcttttctattggggttatatctgtgctttatgggaagccctatctgtcttcttgttgttttatttcgattcgatgtggcacattctacctttcatttctgtggcgtctcattgattggtattatgaatctcgaatttgcagggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagagcccaggcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcgcctgctgttttgggtttctgtagaagtcaggggatggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgcttttaaggccaagcccacttacagaaggcacagaggaaactaaatgtagctctctaggatgtggtttgactgatgatcagggtttgccttcagaaatgggaaataagcaggaaaattttgatacgatactacatgttgaccgtcttactcaacagatgggacttcatgcattggagtactgattgtgtgtatatatgttactcgcaactgaaggtaaactttttagcttgcagcctctcacttatgcataactttataagcatactggctctcttagttccctgaactgaaaccagtgtaaaatctcctgtcattgtcatcatacccaattgctgccattaaagagtgagaacagtgaggcagtaaatcaggagtgtttaaaacaattacagtgaatgtctacgaaaatgtctgatgtattatgatcttacatacacattattaggatagaaatttactacgtaacaaaaaaaaaaaaaaaagg

SEQ ID NO: 863 - DNA, 1675 bp, Glycine max
gggtgaaaagggattgaaggattgttgttcttttctattggggttatatctgtgctttatgggaagccctatctgtcttcttgttgttttatttcgattcgatgtggcacattctacctttcatttctgtggcgtctcattgattggtattatgaatctcgaatttgcagggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagagcccaggcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcacctgctgttttgggtttctgtagaagtcaggggttggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgtttttaaggccaagcccacttacagaagacacagaggaaactaaatgtagctctctaggatgtggtttgactgaagatcagggtttgccttcagaaatgggaaataagcaggaaaattttgatacaatacaacatgttgactgtcttactcaacagatgggacttcatgcattggagtactgattgtgtgtatatatgttactcacaactgaaggttgaggtcccctttgctactgagcagacaaagccatcttacttatacaacaaagaaacctgacagatccaacaacttgatcggtgcttttatccgcttgtaatgtcgtcgtgtgttctgtttgtcattgggggcttaaaaacatacaagttcacgaaacttcatatatctccatgtattttgaattttaataactatgcccccgtttccaatgcgatgatatttttgtggggatgttccgtataattggatcataactcttgaattgctgttgaataactactgtttactgaagcta

SEQ ID NO: 864 - DNA, 964 bp, Oryza sativa
  misc_feature (963)..(963): n is a, c, g, or t
cggttttatgaaagttgatccagataggtgggagggtgcgaactaaagaaatcttagggggcaaaagcagcgactgaagaccatcaacagaaggaaaccaactcatggaaacaaccaagttcagcagcctcagttgccagctgctcctgtacctgcttgcgtagaagtggggaagtttgggatggaagaagagattgagatgctcaaaagggataaaaatgttttaatgcaggaacttgtcaggctgagacaacaacagcagacaacagatcatcagctgcagactttgggcaagcgtcttcaaggaatggagcaacggcaacaacaaatgatgtctttcctggctaaggcaatgcatagtcctggcttcctagcacaatttgtacagcaaaacgaaaacagcagaagaagaatagttgctagtaacaaaaagaggaggctaccaaagcaggatggttcgttggactctgaaagtgcttcattggatggacaaatagtaaaatatcaacctatgatcaatgaagcagccaaagcgatgctaaggaagatcctaaagctagattcttcacatagatttgaatccatgggcaattcagataatttccttcttgagaattatatgccaaatggtcaaggtcttgacagctcttcatcaactcggaattctggtgttacccttgcagaggtcccagctaactcaggtttgccatatgtagctacaagctctggactttcagctatttgttcaacttcgactcctcagattcagtgcccagttgttttggacaacggcatacccaaagaagttccaaacatgagtgcggtgccttctgttccgaaggcttgtggctccaggcccaactgatatcaatattctggaattcccagatttgcaagatatagtagctgaaggaaatgttgatattcctgggggggggctttgaaatgcctggtcctgagggng

SEQ ID NO: 865 - protein, 410 aa, Oryza sativa
GFRKVDPDRWEFANEGFLRGQKHLLKTINRRKPTHGNNQVQQPQLPAAPVPACVEVGKFGMEEEIEMLKRDKNVLMQELVRLRQQQQTTDHQLQTLGKRLQGMEQRQQQMMSFLAKAMHSPGFLAQFVQQNENSRRRIVASNKKRRLPKQDGSLDSESASLDGQIVKYQPMINEAAKAMLRKILKLDSSHRFESMGNSDNFLLENYMPNGQGLDSSSSTRNSGVTLAEVPANSGLPYVATSSGLSAICSTSTPQIQCPVVLDNGIPKEVPNMSAVPSVPKAVAPGPTDINILEFPDLQDIVAEENVDIPGGGFEMPGPEGVFSLPEEGDDSVPIETDEILYNDDTQKLPAIIDSFWEQFLVASPLSVDNDEVDSGVLDQKETQQGNGWTKAENMANLTEQMGLLSSHHTG

SEQ ID NO: 866 - DNA, 2635 bp, Zea mays
gccggccggtccgggataccctccccccccccgccccctggcaattccattttccaattcccctttcctctcatcgcatacaccagcggcggcgccgggaccccgaaaaccctctccccgcacaccacggccaacaggaaccactccgctcctccgagccctagccgtcccgggccgggtcgggctcccctacatgacgccggcgtgaggcaagtgcttagtggatcgcgctggtgggaggatgcagggcggtgtcatggcccatgccgccgccgccgcggcggccgcgtcgacggtgaccacggcggtggcgcccccagtcacggcgcacgcggtggcggtggcgcccccggtcacggcgcacgctgcggcggcggcgggcaacggcagcgccaccgccgcgccgccgccaccgttcctcatgaagacctacgaggtggtggacgacccggccacggacgacgtcatatcctggggccccgggaacaacagcttcatcgtctggaacacgcccgagttcgcccgggacctcctgcccaagtacttcaagcacagcaacttctcctccttcgtcaggcagctcaacacctacgggtttagaaaggttgatccagacagatgggaatttgcaaatgagggttttctgagaggacagaagcatctgctgaagactatcaacagaaggaaaccatccttgcaggggaacagccaaccacagcaacctcagtcgcagaacgctcctgtgccttcctgtgtagaggttggtaagtttgggttggaggaagagattgaacggctgaagagggataagaatgttcttatgcaagagcttgtcaggctgagacagcaacagcaaacaactgaccatcagctgcagactttgggcaagcgtcttcaagggatggagtcacggcagcaacagatgatgtctttcctggctaaagcaatgcaaagtcctggtttcctagcgcagtttgtacagcaaaatgagaagagcagaagaagaatagtagcggcgaacaagaaaaggcggctgcccaggcaagatggtggcctagactccgaaagtgctgctgcttcgttggacggtcaaatcatcaagtatcagcctctgatcaacgaagcagccaaagcaatgctaaggaagatactaaagctagattcttcgcataggttggaatctatgggcaattcagagaatggcaattttctgctggagaattatatgccaggcgctcaagcctttgagagctcttcgtcaacaagaaactctggggtcaccctttcagaggtttcagctaacccaggtttgccgtatggcggcggcggcggcacgagctctgggctgtcagccatctgccctcctgaaatccagtgcccagttgtgatggacaacatgtcgtctaaccaagtgcccagcatgagtgctgtgcctcctgtttcgaaggctacaattgacatgggtattcctgaattctcagctctggcagacttggtgaatgaaggctccgtcgatatccctggaggggcctttgagatgcctggtcctgagtttcctctgccagaaggcgatgacagtgtccccatcgagaccgatgagaccatgtacaacaacaacgacgagactcagagccttccaggcatcatcgactccttctgggagcagttcctggtaggcagccctctctctgccgataacgatgaagttgattcggggtcgccacaggagaacggatggagcaaagtggggaacatcggtgatcttacagaacagatgggccttctgtcatcaacaaatcaccgcgactcagggaatgggctgtagtgtatcttaattaatatacggtagactgggattatcggtaataagcgtcgcctgcagtttttgttatttttccttttggccaaaaaatgatatgccggtatatcaaccactcgctcgacctatatgcgcgggaggggcagtcttccagctgagctctgaatgccacagccacctgcttgtatcaatctatgatgttggcagtcttgagaacaccactgtgacttgttaaatctgtatgcttattcccactctagttgctgatattgtttagtttgttatattggtgcggaaacacgggggttgtttagcaacaaagtataacacgttgctttattacaattcgattctgtacaattccatactccaaccaatatattttccggcaacggaatcaagttgccagatttaaagctttacaatcacgcttacaagggtgtcaaattggtctaatttgtaggaatccacttgaaagattttgttactgtcaaacaggttaccccaaagaaagttgaaaattgttgtttcaagcacaagggcttcatgtaagcacaggttatccaaagcgcgctgagattgcgctgcaatgcgaccaaggagaattacttctgcagtaacccaactagatcatacacgctgttcgtgtagagatctggatggatattgttacgagcatcctgcacttctggtaaggcagtgcaaccagacaaaacaaggagggtcttgcagccggggttctggccaaatagtatgtccgtgtccagtctatcaccaaccatgcacatcccggacgcctccagattgaagcttttc

SEQ ID NO: 867 - DNA, 1841 bp, Zea mays
tcccccggggcagaccgccaaatcgaaggagattgaacgaagcagcccaaccaaattcccctcgccgcctcgtcccttcgcgacatttctagtcccgtcgtcgcctcaatctcgaagcctctccggcgcagccgcctcatcatcgatccgaaggcctccaaccaaacatcctctagggtttccgcatcgtccgtcgcgatgggcttcacgaagcggtcgccccagcatcccgcctccccagccggcggcgaggtcggcgcccagacggcagggaaggtcacaccagtgccggcggcgccggagtcggcgcccgtggcggtggtgccgaggcctccagacgtggcgcccttcctgaccaaggtctacgacatggtctccgacccggccaccgacgcggtcatctcctggagcgccggcggcggcagtttcgtgatctgggactcgcacgctttcgagcgcgacctgctgccgcggcacttcaagcacaatcacttcaccagcttcatacgccagctcaacacctacggatttcataaagttgatccagatagatgggaatgggccaatgaaggctttgttaagggccaaaaacatcttttgaagaccatcaagagaaagaagaaatcctctcaggatgtacctagtgatctgcagtcggtgcctgtcaaaactgcacctggcactgagaatatcgagataggaaaatatggaggccttgaaaaggaggttgagacacttaagagggacaaggcccttctaatgcagcagcttgtagatctacggcagtaccagcaatcatctagcggctgaagtgcagaatttaattcaacgcctccgtgtgatggagcagaaccagcagcagatgatggcacttttggcaattgttgtccagaatccagacttcctgaaccagctcgtgcagcagcagcgcaggagtaactggtggaatgatgatggtaacaggaaaagaaggttccaagctctggaacatggtcctgtagatgaccaagagacttctggtggaggcgcacaaattattcaatatcgtcctcctgttcctgaaacttccaatcagccaataccagcaaatgaagctttctattcaacccctgcacaaccagcttcaagccctgcacttgagatgcccatggatgtagagatggcttcaaacaatgttgatacctttgattcaactggcaatgattttactgacacctctgctctatgtgaatgggatgacatggatatatttggtgacgaacttgagcacattcttcaacagccagagcaggactttcaagtggaccctcctttaacagttgaggattatggttatgatcatccacggttagagcaggactgtcagatggaagcacaacagaattgcaaaaatcctcaatatgttgcctgtgtcttgaagcaaagggaaagccatgcatctgatgtccattagtactgatcagtttgagctgatgtcataactgaagcatgagccgtggtcccccagaatgttgtccagtaacattagtggatagagatttgtgatgaacagaatcttgagactggcaggttagccaccattgggaacctgaagaccgtcgggattgctcagaattcagtatactaatactaatactaaaatatacagtaacacatgttgactatacatgatttcgttttccttactcgctcgaccaaaggcagccgtacaatatttttacttttgtccaggtgggagcatctaggtctttaaatggtttcggtgattaatggtgatcctagattattatgatttgcagagactataacttaggttatgatagcagtgattgattatgcgt

SEQ ID NO: 868 - DNA, 1842 bp, Glycine max
ggctcgagacctgattgcgattatagtgatgctgaccttgttgtcgagggaattccggttagtgttcatcgatgtattctggcctctaggagtaagtttttccatgaattattcaagagggagaaggggtcatcagaaaaagaagggaaattgaagtataacatgaatgatttgttgccttatggcaaggttggatatgaagccttcctcatattccttggctatgtatatactggtaaactcaagccctctccaatggaggtgtctacttgtgttgacaatgtttgtgctcatgatgcgtgtagacctgccattaactttgctgttgagttaatgtatgcctcttccatttttcaaataccagagttggtatcacttttccagagacgtctacttaactttataggaaaggcccttgtggaagatgtcatcccaatcctcactgttgctttccattgtcaatcaaatcaacttgtcaatcaatgtattgatagggtggccagatcagaccttgaccagatttcaattgaccaagagcttccgcatgaactctcacaaaaagttaaattgctccgccgcaaacctcagcaagatgttgaaaatgatgcttctgtagtggatgctttgtctctaaaaagaatcactagaatacacaaggcgttggactcagatgatgttgagcttgttaaacttcttttgaatgaatcagacattactttggatgaagccaatgctctccattatgctgcagcctactgtgaccccaaggttgtttctgaggtacttggtttgggactggctaatgtcaatcttcgaaattctagggggtacacagtgcttcacattgctgccatgcgtaaagagccttccattatagtatccctacttacgaaaggggcttgtgcatcagatttgacttttgatggtcagagtgctgttagtatttgtaggaggttgacaaggccaaaggattatcatgcaaaaacagagcaggggaaagaaacaaacaaagatcggatatgcatcgatgttcttgaaagagaaatgaggaggaatccaatggctggggatgcctgtatgtcttcccataccatggctgatgatctccacatgaaactactgtaccttgagaacagagtggcatttgcaagacttttcttcccttcagaagccaaactagccatggacattgcgcatgctgagacaacatctgagtttgctggtctttctgcgtcaaactcaaaaggttcaaatggaaacttaagggaggttgatctcaatgagactcctatagtgcaaaataaaagacttctttctagaatggaagcccttacgaaaacagtggagatggggcggcgctacttcccacattgctcggaagtgctggacaagttcatggaggatgacctgcctgacttgttttaccttgaaaagggtactcatgaagagcagagaatcaaaaggacgcgtttcatggagcttaaagatgacgtccacaaggctttcaacaaggacaaggccgagtttagccgctctgggatttcatcttcatcatcctcatcatccctcagagattctgttgtacattacaaggctaggaaagtgtaattttaaaaccatacatagtgtttttgattttgacatacatattatatatagtgcaaattttaaaggtgaagcccaccaactcatctgtaaaattctcgaagcaggaaagttgatgtaaacaacctgcgcatatatttttgaaaatgttttcatatgctttttggtggagaaaaaaaaaaaaaaaaaaaaaaaaaaaaaaaaaaaaaaaaaaaaaaaaaaaaaaaaaaaaaaagg

SEQ ID NO: 869 - DNA, 2793 bp, Glycine max
cacaggtctcggttcccgagcatcatctctctctctctctctgttttcccatatcttctgtttcccgtcgttggtcaacctttgttcattggttctctttctctttccatttcaagtcttcgcttctttggttcaaaggacttgagcattcttgatgttaaactagccatcttcttcttcttctttttctgcagcgttttgaagcctcttccaagagtctcttacttaagatctgctgtcgagttcatcttccctcttaagtcttaacgggtaacaccctgtatgtaatatttattcttcttttgctcttaacgtctttcccatgtcagttaagttctgaaagttcaaattttttgttctcacgcctcaatttatttgatggatcatccccagatgaaaaatcatctcagtttttgcttctgggaatctgagttttgttgcttgacttgcaagtgactttggtcttgtggtaggggaaacagtgacctttctcaattttgcttatttaatttgagcttagtttgtttagttatagattatgttagctagcttttcagtttagatgggtacttaaaggggtttaatttcttcttttgcttctaaatttggtcaaacagtgctttgactcaattggaatctcgtatatttggaatcatggataactcatatgattcatcctcatccttgagtttcgtatcatctcacctgtcacatggttctagtaatcacaacgtgtcttccaccaccagcaatgagcatggggaaaatattgaaattttgagtctgaataagctcagtggaagccttgagaagctattgattgaggctgagtatgattatagtgatgctgagattcttgttgaggacatccctgtgggtattcatcgctgtatattggcgtcgcgtagtctgtttttccatgagctttttaagaaagggactgatggatcaggcaaggaaggaaagccaaggtatctcatgtcagatttgatgccttatggcacagttggatatcaagctttccaagtgttcttgtactatctgtatactggaaggctaaaggcttcaccaacagaagagacaacatgtgttgatgaaacatgtatccatgtagcatgccgccctgctatcaatcatgccctagagctgatgtatgcttctgccacttttcagatgaaagagctagttttactttttcagcggcatctcctaaattttgttgagaaggctcttgtggaagatgtcattcctattcttatggctgctttcaactgccaactagaccagcttctctctcggtgcattcggagagtagcaaggtctgactttgacaacacatctttggaaaaagagctccctcgtgaagttgtgactgaaatcaaattgctccgactcccatttcagccagaatccacacctaatgcaatggaagtggagtccttgaatgaaaagagtataaggagaatccacaaggcattggactctgatgatgttgagctactgaagcttcttctaaatgagtctagtgtcactctagatgatgcacatgccctgcactatgcttgtgcctatagcgattctaaggttattcaagaagttcttagtctaggcatggctgatattcttcgtagaaattcccgaggatacacagttcttcatgtggctgcaaggcgaaaggatccatccattttggtagcactactgaataaaggggcgtgtgcatcagataccactccagatggacaaactgctcttgcaatttgtcagaggttgacgagatacaaggattatcaagagcaaacagtccagtgtaaggaatctaacaaggacaggctctgtgttgatgtcctggagagggagatgagaagaaattctatgactgtgaatatgtctgtttcatcacagctaacagccaatgatttgcacatgagactggattaccttgaagatagagttgcatttgctcggctgttttttcctgctgaggctagggtagccattgagaatgctgaagcagattcatcgtcgatgtacgcaaactcatcggctttgaagggcacaaatggcaacccgaaacaagtagatctaaatgaatctccctcggctcgtaccagaaaactccagttaagattgcatgcccttatgaaaacagttgagaatggtaggcgcttctttccccattgctctgaagtgcttgataagtttctggaagatgacgatatgccagatgttttcttcctagagaagggcagtgaagacgagcagagaatcaagaaagcacgcttcatggagcttaaagatgatgtgcaaaaggcatttcacaaggatatggctgaaaataaccattctggtttttcatctacggtgtcttcctcatcttcctcaactcgtagggaaggtcttaaccatagagtgaggagaaaatgaagcccatgttcttctagagtagagtgttgcaacttgcaagtagaagccgtggcatatttagaaaaaataagatggaatgttaaattagggggttttgctaatgaacttgggagatttttactagcttgatttagtttcttatagttgttggaccaagagaagaagaaaaataaaagaagacgaattggcttatagtaatatctttgttccttttcgaagaccctaaagtgtgtattttttactttgttatctgatcctagattgttatataattgaaaatctcacctcctgtaataattactttaaagatgacatgcaagactatttaaaagtcatttctaaaaaaaaaaaaaaaaaaaaaaaaaa

SEQ ID NO: 870 - DNA, 832 bp, Glycine max
  misc_feature (34)..(34): n is a, c, g, or t
cttgcatgcctgcagtggcatttgcaagactttntcttcccttcagaagccaaactagccatggacattgcgcatgctgagacaacatctgagtttgctggtctttctgcgtcaaactcaaaaggttcaaatggaaacttaagggaggttgatctcaatgagactcctatagtgcaaaataaaagacttctttctagaatggaagcccttacgaaaacaggtaattgcagtctttattttattttcctataaccatttgttgtaatgatgcttttaacatgtttgtttatcattcaaattcgtagccagttgggtagtgaggtcaattttgtttcaggcatgctctatttcttgtttgtggtacaggctttgtaagcttcattcatgtatctcaatactcagattttgttaaaaaagttgttcatatttgataatatatttttatgattaaaaaaaaatctaatggatatgaactagggtacacgttaaaattggttttgggttcaggggatgtaaaattcttatcgaacctgacccactggcatcagtacttgactaatttcaacctatgtggtgatggaccagaaattttttaaattagtaaattagtttggcttcaattttaataacacaaatccatagaatacccctcttttttgtatacaatggcagaaataaagtttgagcttaggatttcatgcatactacccaaatcccctacaactaagccacctctagtggattaatctataaaatatctgttatcatggaaagttgcgtctcactgtcttcgtaacatgcaaacttgtcagacacaaattaatgcgagtag

SEQ ID NO: 871 - DNA, 900 bp, Oryza sativa
gcagatgattaggtgacactatagaagagctatgacgtcgcatgcacgcgtacgtaagcttggatctctagagcggccgcggcggcgatggggctgccggcggcggcggcggcggcggtggtgggggaggggagaggactggggggaggccgcggtacaagagggaggagctcgtgccgggaggccgcgtggggcgcgacgccttcctgtcgctgctgggttacctgtacacgggcaagctccggccggcgccggatgacgtggtgtcctgcgccgaccccatgtgcccgcacgactcgtgcccgccggcgatcaggttcaacgtcgagcaaatgtacgcggcgtgggcgttcaagatcaccgagctcatctcgctgttccagcgacggcttcttaacttcgtcgataagactctagtagaagatgttcttccaattctgcaagttgcttttcattcagagctgactccagtgcttgaaaaatgtattcggagaattgcaagatcaaatcttgataatgtatcgttggataaggaacttcctccagaagttgctgttcagataaaagagattcgccaaaaatctcagccaaatgagggtgacactgtcatttcagaccctgtacatgagaaaagggtcagaagaatccacagggcactggattctgatgatgttgagcttgtgaagttgcttcttaacgagtctgagatcaccttggatgatgccaatgcattgcactatgctgctgcttactgtgattcgaaagttgtttcggagttgttagacttgagacttgccaacttgaatttgaagaattcgcgtggatacacggcactccatctggctgctatgaggagagagccagctattatcatgtgtctcctaaacaaaggagcagctg

SEQ ID NO: 872 - protein, 624 aa, Oryza sativa
MEPSSSITIASSSSYLSNGSSPCSVSLAPPGAGAVAAQAAPVAAGEGGGGGGGGGGGGSSSVEVVSLNRLSANLERLLLDSDLDCSDADVDVADGGPPVPVHRCILAARSTFFYNLFAARGRGGDGAAGGGGGGGGGGGERTGGRPRYKMEELVPGGRVGRDAFLSLLGYLYTGKLRPAPDDVVSCADPMCPHDSCPPAIRFNVEQMYAAWAFKITELISLFQRRLLNFVDKTLVEDVLPILQVAFHSELTPVLEKCIRRIARSNLDNVSLDKELPPEVAVQIKEIRQKSQPNEGDTVISDPVHEKRVRRIHRALDSDDVELVKLLLNESEITLDDANALHYAAAYCDSKVVSELLDLRLANLNLKNSRGYTALHLAAMRREPAIIMCLLNKGAAVSQLTADGQSAMSICRRLTRMKDYNTKMEQGQESNKDRLCIDILDREMIRKPMAVEDSVTSPLLADDLHMKLLYLENRVAFARLFFPAEAKVAMQIAQADTTPEFGIVPAASTSGKLKEVDLNETPVTQNKRLRSRVDALMKTVELGRRYFPNCSQVLDKFLEDDLPDSPDALDLQNGTSDEQNVKRMRFCELKEDVRKAFSKDRADNSMFSILSSSSSSSPPPKVAKK

SEQ ID NO: 873 - protein, 89 aa, Oryza sativa
HCEIVELFLSRGVDVDLDSITGTPLLTAAMNGQYSTMKILLEHHADVGADVNFRDPNGVTCVMVAANHGSPVIMKCLLDAGANSNIPDE

SEQ ID NO: 874 - DNA, 492 bp, Oryza sativa
ggcacgaggggaggaggaggaggaggagggagtagtagcgtggaggtggtgagcctgaatcggcttagctgctaacctcgagcggctcctcctcgattccgacctcgactgcagcgacgccgacgtcgacgtggccgacggtggcccgcccgtgccagtccaccgctgcatcctcgccgcccgcagcaccttcttctacaacctcttcgcggcgcgcggccgcggcggcgatggggctgccggcggcggcggcggcggcggtggtgggggaggggagaggactggggggaggccgcggtacaagatggaggagctcgtgccgggaggccgcgtggggcgcgacgccttcctgtcgctgctgggttacctgtacacgggcaagctccggccggcgccggatgacgtggtgtcctgcgccgaccccatgtgcccgcacgactcgtgcccgccggcgatcaggttcaacgtcgagcaaatgtacgcggcgtgggc

SEQ ID NO: 875 - DNA, 2165 bp, Zea mays
cacgattcgtgcccgccggccatcaggtccgcggtcgagctcatgtacgcggcgtgtaccttcaagatcctcgagctcacctcgctcttccaggcgaacctggtggcttgaagtctatgaattgaaatggaatcattattcattaggctgctcaacatttgaatattacatttatggctgtatagtttatcaatcagtttaacatcaattgagctttgctttgtctttacggaaggcaaatggttaacatggtcttcttctacagcggcggcttcttaattttgtagacaagactctagtggaggatgttattcctattctggaagttgcttcccactcagggctgactcaagtgatcgacaaatgtattcaaaggattgctagatcagatctcgacgatatatctttggataaggagctccctccagaagcagttgatgagataaaaaatttgcgcaagaagtcacaaactgctgatggtgatacgttcatttcggaccctgtgcatgagaaaagagtcagaagaatccacagggcacttgactctgatgatgttgagcttgtgaagttgcttcttaatgagtccgacatcacattagatgatgccaacgcattacactatgctgcttcttactgtgatcctaaagttgtctcagagctgttagatttggcaatggctaacttaaatttgaagaatagccgtgggtacacagcactccacttggctgctatgaggagagaaccagctataatcatgtgtctccttaacaaaggggcaaatgtgtcacaactgacagctgatggcaggagcgcaattggtatttgtcggaggttaacaagagcaaaagactacaatacaaagatggagcagggtcaagaatcaaataaagataggctgtgtatagatattctagagagggagatgatgcggaatcctatggcggtggaagatgccgtcacctcgcctttgttggcagatgatcttcacatgaagcttctctacctggaaaacagagttgcatttgctagattgttctttcctgctgaagccaaggtcgccatgcaaatcgcacaagcagacaccacagaagaattcggcggtatagttgcagttgcagcaagcacttccggtaaactgagggaggtggaccttaatgagacgccagtgacacaaaacaaaaggctccgttcaagggtagatgcactgatgaaaacagtggagctgggccgtcggtacttcccgaactgctcgcaggtgctggacaagttcctggaggacgatctgccggaaggtctggaccagttctacctccagaggggcacagccgatgagcagaaggtgaagaggatgcgcttctgcgagctgaaagaggacgtgctgaaggcgtttagcaaggacaaggcggaggggcagcgtgttctcgggcctgtcctcgtcgtcgtcgtgctcgccgccccagaagtatgcccagaggtgatcaaggcaccagtttttgccgtatagtttgttatcatggtcttcgagacttggacccggacagcatatagggacatgtacacctgtgtatgtatagtgcttacaattggcgtaagtagaactatatgtatggaacataaggaaacatggcaggaacaccgtgcaaaaagatgaaaagatggccgaagtgctctatgcgagtgcccacctgattcgatggccctattcaacggcgccctgtcagcatgctgcatgcccactgagaccttcggttgcatagggataggaggagatttctgttcaattttggctagcaagtgatataggggtgtttaggactgtttcactttatgaaaatcaacttagctcataaacacttttaacttcaataacttaggtcctgtttggagtggctgtatttttctagtcccaagaaaataatgtggtatctgagaataccatggtctagaaaccaaaatgtgtttggcagactcttttaaaccatggtatttaaaatcttggttttgacaagaccacattatttctgggtatagaatactgtcagccgagttcggctcggctcggtgcggctcgttgactgaacgagctcgactcggctcgtccattccacgagctggtgaaagaggctcggctcggctcgaccttagctcgcgagccatattcttgt

SEQ ID NO: 876 - DNA, 1635 bp, Zea mays
  misc_feature (1631)..(1634): n is a, c, g, or t
acatcggccgcgacgccctcgtgcccgtcctcggctatctctacaccggccgcctcaagcccccggcgcaggacgccaccgtctgcatggacgacgcgtgcggccacgggacttgccgcccggccatagatttcgtcgtcgagtccatgtacgcggcgtctggcttccagatctcggagcttgcctccctcttccagcgtcgcctctctgacttcgtttgcgaagcgctggacgaggacgtggtgccgattattcatgtcgcttccacctgcgatctccaggacctgctcaatctgtgtattcagagggtcgcagtctccgctctcgatagccgctacctggacaaggagcttccggctgacatatacaacaagatcaaggagatccgccgccaaccagagaacgccattattctggaccctgagcatgacaagagggtcaggaacatcctcaaggccttggattccgacgacgtcgatctcgtcggcttgctgttgaaggaatcgacggtgaccttggacgatgcattcgcgatacactatgctgcagcctactgggagcccaaggtgtttgcagagctgctcaaactggactctgcgggcgggaacctgaagaacagcggtgggtatacgccgctgcacatagcttgcatgaggagagagccggacatcattctttcgctggtggagaggggagcctgtgtgctggagaggaccctggatgggcgcgatgctcttactatctgcaagagactgacaagagagaaagactgcaataggaagttggacaaggacgaggagaaaagtaaggcttacttggggatcgacattttggagcaagaactcaagaggaaatccttcggtttggaccccatctctatctctatagaggagtcgactgccacgcctttgctggtcgataattttcacatgaggctcataaacttggaaaacagagttgcgtttgctcggatattcttcccttctgaagccaagcttgtcatgcgcatcgcacaagccgattcaacccaagagtttgccggcatcaccaacttcagcagactcaaggaagttgatctaaacgaaaccccaacgatgcagaataggaggcttcgcgaacgccttgatgccttaacaaagacagttgagctagggagacgatacttcccacactgttcggacgttctggataagttcctcaacgaagaatccactgatccgatcttccttgagactgggaccccggaggatcagcaagtcaagaggatgcgtttctctgagctcagagaggacgtgcgcaaggcgttcacgaaagataaggcagcagtggctgcaatagcttcctcggcgtcctcgtcttcgtctccgaggtgcagacgacccaataggaaatcacggtgatgtcagtctgttcaggacacctgcactgggttgtgtgtgttttgacatgtaacactgtttcagtagataatgctgattgtcagatttgctgccgctctacagaagattaagcgaccgtctgtttcaagaattattcagacagttacttgtgattctttcaagcagcagttacaaaaaaaaaaaaaaaaaaaaaaaaaaaaaaaaaaaaaaaaaaaaaaaaaaaaaaaaagnnnna

SEQ ID NO: 877 - DNA, 440 bp, Glycine max
acgagtatcgttcaaacaacgcggaggcttgtcctgatgctgcagaagatgttcttgaccggtcctcttcacagagttggggatcatccaagttagaggaacaacccaaaactgcagaacaacttcctgcagaacagattcctctcagaaaagccagggtttccgtccgtgctagatcagaagctcccatgataagcgatggatgtcagtggaggaaatatggacaaaaaatggccaagggtaacccttgccctcgtgcttactatcgctgcactatggctgtaggatgcccggtccgaaaacaggttcaaagatgtgcagatgacaaagcagtgttgattaccacctacgaagggcattacaaccaccctttggcggccggccgcaccggcatggcgaatactacgtcaacagccgcaaccatgctgctttcaggttcg

SEQ ID NO: 878 - DNA, 406 bp, Glycine max
  misc_feature (45)..(45): n is a, c, g, or t
  misc_feature (376)..(376): n is a, c, g, or t
gcccgatcagaagctcccatgattagtgatgggtgccaagtgganaaaatatggacaaaaaatggctaaggggaatccatgccctcgagcatactacagatgcactatggcagttggttgcccagttcgcttactagtcagtttttctgattgatcagcgcatataataataataataattattattaaccttatctactaagcattgtggctgaagctaatatattgatatttcttggtttgtgataatataggttcaacgttgtgctgatgatagaacaattttggtgacaacatatgaaggcacacataaccatccactgccacctgctgctatggccatggcatcaaccactgcagctgctgctaccatgtngctgtctggatcaatgtccagtgcagatgg

SEQ ID NO: 879 - DNA, 1266 bp, Glycine max
ggcaggtacatatatgcacgcatatctgatatcaccatctcagtatctgtgactggcataaagtctatataaatggagggcaaagttgcattgaaaaaattgctggaagttcagaaaaaggcacatgttattagtacagatgcactcaactggactgaggaaccgtccattaaaaatactctaggatctactcttctcagtttgagtctgaataacttggagcctccccaaaatcatgagcaacagaacctgaatcaattgggcttgctgcaaattgagttagaggaggtgaagaaggagaatcagaatttaaggtcaatgctaaatgagatctctgaacactacgctgctcttcagaatcagttattgttggcgatgcagcagaagaaactatcttcatcacctcgaaataatgaggacatgcagaaggacagccagcagaataacatggagaaaccagcgttaccctcctgcagccagttcttaaatactggtaaaatcaataacagggtaatattacaagaagcaaaaatcgtagaagagcaagcatttgaggcttcttgcaagaaagctagagtgtccgtaagagcgcgatcagaatcatctttgatgggtgatgggtgtcaatggagaaaatatggacaaaagatatcaaagggcaatccttgtcctcgggcctattatcgctgcaacatgggaactgcatgtccagttcgcaagcaggttcaaaggtgtgctgaagatgagagtgttgtcatcacaacctatgaggggaatcataatcattcactcccaccagcagccaggtccatggcgtgcacaacatcagcagcactgaaaatgttcctttctggctcaaccactagttcacatggaagcacttattcttattcaaattcagacctcttctctccactatgcacttctacctactatccatctgcagcaccatcatgtccaactataactttggacttaacccaaacctctaagaacaacatgaaattcccaagtgctatttcttcaaaccatttgcaaccttttccactttcattgcatggtcaacctcaacaatctgagggaatattaccttcagagaaaaaccttgccttggtggatgttgtcagtgctgccataaccaacgatccttctcttaaggcagcattagaagcagctgtttcctcaatcattggagactctcagaaatcactgccccactttgtaggagtgattatgacccctcttctaagatgtctgcagtatcac

SEQ ID NO: 880 - DNA, 2039 bp, Glycine max
ggctcgagcctctcgcttatggacaaaggatgggtttcctctcaatctcttcttcctcccacacccgacaatactatgtttcctctcctcggattccccgtcaaactcagccgccccaccatggaactccaccatgataaccgcaaacttgtcgctgaagtcgacttcttctctcatactccgccacccaacatcgtcaagaaggaacttgatcaaacacctcttcacattaatactggtttacaactccttactgctaacaccaggagtgaccaatctaccgtggatgacgggctttcatcggatgcagaagataagcgagccaaaaccaccgagcttgcacagttgcaagtggagcttcaacgcatgaacgctgagaacaagaagctgaaagagatgctcagccatgtcaccggtaactacaccgccttgcagatgcatcttgtgacactaatgcaacagaaccagcagcgaacagaaagcacggaaaatggggttgctcagggaaaggttgaggataaaaaccatggtgttggtggaggaaaggtaccaaggcaattccttgatataggtcccagtggcacagcagaagtagatgatcaagtttcggattcttcttctgatgaaagaacacgatcgagcacgcctcaggacaataacactgaagctggaacaagagatggagcgagaaataacaatggtaataaaagcgagttgggtagggaagagagtccagactcagaatcacaaggttggggtcccaataagcttcagaaagtgaacccttccaatcctatggatcaatccactgcagaagccacaatgagaaaagctcgtgtctcagttcgtgcccgatcagaagctcccatgattagtgatgggtgccaatggagaaaatatggacaaaaaatggctaaggggaatccatgccctcgagcatactacagatgcactatggcagttggttgcccagttcgcaaacaagttcaacgttgtgctgatgatagaacaattttggtgacaacatatgaaggcacacataaccatccactgccaccagctgcagtggttgatgccatggccatagcagcaggtggcagtggatggttatggcatcaaccactgcagctgctgctaccatgttgctgtctggatcaatgtccagtgcagatggagtaatgaaccccaatttgctagccagagcaattcttccttgctctacaagcatggcaacactttcagcttcagcaccattccccactgtgactttggacctcacacacaacccaaacccattgcaatttcaaaggcctggtgccccattccaagtacccttcctccaagcacagcctcagaattttgggtccggagccaccccaattgcacaagcactttataatcaatcaaaattctctggtcttcagttgtctcaggatgtaggatcttctcaattagcaccacaagctcccagaccacccttgcagccaagccaacatccctcactggctgacacggtcagcgccgccgcctctgccatcacttccgatccaaacttcaccgccgtgctcgctgccgccatctcctccatcattgggggagctcacaattcaaacaacaacaacaataacaacagcaacaacaacacgagcaggactactattagcagcttttcaggaaactgaacattttctttttggttccattaactttgtatttttgtacttgggtactataagggaaaatgaaaccataaatgttcatattctttttagtccatgtattgggagggatatatcatatattagatcagaaaaaaaatgtttcatttttttgtatcatcaatttctctttgaataatgttgtatatttgattcaaaaattctcttgggagtaaatagacaagggcaaatgaagaaagaatcgtcttttattttttcttcctttgtctcgtgtttatctttaatttttaaaaaaaaaaaaaaaaaaaaaaaaaaaaaaaaaaaaaaaaaaaaaaaaaaaaaaaaaaaaaaaaaaaaaaa

SEQ ID NO: 881 - DNA, 1060 bp, Glycine max
ggctcgacgccacgcgtccgataattaataataattagtatctattcaagtatcaacaatataagcaatatattgctgtggctaaagctcgatattaatttcgtggtttgttaatataggttcaacgttgtgctgatgatagaaccattttggttacaacatatgaaggcacgcataaccatccactgccacctgctgctatggccatggcatcaaccactacagctgctgctagcatgttgctttctggatcaatgtccagtgcagatggaataatgaacccaaatttgctagctagagcaattcttccttgctctacaagcatggcaacactctcagcttcagcaccattccccactgtgactttggacctcacacacaaccctaacccattgcaatttcaaaggcctggtgccccattccaagtacccttccttcaagcacagcctcagaactttgggtcaggagccgccccaattgcacaagcacaagcactttataatcaatcaaaattctctggtcttcagttgtctcaggatgtaggatcttctcaattagcaccacaagctcctagaccacccttacaaccaagccaacagccctcacttgctgacacagtcagcgccgccgcctccgccatcaccgccgatccaaacttcaccgccgtgctcgccgccgccatctcctccatcataggcagtgctcataattcaaacaacaacaacagcaacaacaacacaagccggactaccattagcagcttttcaggaaactgaacattttctttttgggttcaattttttggttaatattgttattattccttaaactttttatttttgtacatgggtactataagggaaaatgaaaccataaatgttcatattctttttagtccatgtcttgggagggatatatatgatatattagatcagaaaaaaatgttttttgtatcaatttctctttgaataattaatattgttgtatatttgattaaaaagttctctagggagtaaatagacaaatggtaattaagaaaaaaacctcttttatcttcttt

SEQ ID NO: 882 - DNA, 961 bp, Glycine max
actaacggcccctttgacttcatatattttagggacaactgtgacaacatgagtgtatattagggcctcttaacatgtgttgggcgaatgatcaccttcttgcactcctcaggacaataacactgaagctggaacaagagatggggcgagaaataacaatggtaataaaagcgagttgggtagggaagagagtccagactcagaatcacaaggttggggtcccaataagcttcagaaagtgaacccttccaatcctatggatcaatccactgcagaagccacaatgagaaaagctcgtgtctcagttcgtgcccgatcagaagctcccatgattagtgatgggtgccaatggagaaaatatggacaaaaaatggctaaggggaatccatgccctcgagcatactacagatgcactatggcagttggttgcccagttcgcaaacaagttcaacgttgtgctgatgatagaacaattttggtgacaacatatgaaggcacacataaccatccactgccacctgctgctatggccatggcatcaaccactgcagctgctgctaccatgttgctgtctggatcaatgtccagtgcagatggagtaatgaaccccaatttgctagccagagcaattcttccttgctctacaagcatggcaacactttcagcttcagcaccattccccactgtgactttggacctcacacacaacccaaacccattgcaatttcaaaggcctggtgccccattccaagtacccttcctccaagcacagcctcagaattttgggtccggagccaccccaattgcacaagcactttataatcaatcaaaattctctggtcttcagttgtctcaggatgtaggatcttgtcaattagcaccacaagctcgcagaccacccttgcagccaagccaacatatcttactggctgacacggtcagcggcgacgactctgccatc

SEQ ID NO: 883 - DNA, 826 bp, Glycine max
ggctcgagggaaaagctgaggagagaaagcatggaggaatggtgcctcctagacaattcctggatttagttccgagtggtacgaccgaaatagatgatcaagtatcgaattcttctttgggtgaaaggactcgatcaaccacacctcccagctgcaataaaaatgatgataagtgataagaaagagactactgatattccacactctggcaaattattgaaccatacgacggatccatccactagtccggaagccgctatgagaaaagctcgtgtctcagttcgtgcccgatcagaagcacccatgatcagtgatgggtgccaatggcgaaaatatggacaaaagatggctaagggaaacccttgtcctcgagcatactacagatgcaccatggcagttggttgcccagttcgcaaacaagttcaacgttgtgcggaggacagaacaattttgacaacaacgtacgaggggacccataaccatccactgccaccagctgcaatggctatggcatcgaccactgcagctgctgctagcatgttgttgtctgggtcaatgaccagtgctgacggaataatgaaccccaatttgctaactagagctattcttccatgttctagcatggcaacactttcagcttcagcaccattccccacagtgacattggacctcacacacaaccaaaacgcgtttcagaattaccaaagacctcaaaccccattgttcccatcacagccccaggactttatcgctggatccacgccaccacaactgccgcaactgattgcacaagcgctctatatcaatccaaattctcaggccttca

SEQ ID NO: 884 - DNA, 734 bp, Glycine max
  misc_feature (702)..(702): n is a, c, g, or t
gaaaaatatagacttagcgaggacttatattggtggtgtgtacagtgcagaaatttcgtccataaacgctgcagactacacccactatatagttatgcttcaaaagtttggtgtcactctgggaaaaccaactgagttgtagtaacaagcttaaaggctacataaatggaagataaagctgcgataaaagaattgctggaagacgaggaaaacccatatgataatactggaaacaaacaagatgcggagaaattaccaatgctacacacccggcagtttttgaatatgggcgagtcttcatcaattttagacggcaacacaaaagcatgtgcaatagcagaaaacgctgaaaagaaaatgttaggcaaaaaccttgcatgtgatgataataagtacaatgttgaaggtgaaatcaacagtcaaataacatcgcatgaagcaaaaagcacagaagatcaagtatctgaggttacttgcaggagagctagagtgtccataagagcaagatcagatttttcttcgatgtttgatgggtgtcaatggagaaagtacggacaaaagacagcgaaaggcaacccttgtcctcgagcctactaccgttgtagcatgggaactgcatgtccggttcgtaagcaggtgcaaaggtgtttcaaggatgagactgttctcatcacaacctatgaagggaaccacaaccatccnctcccaccagcagcaagacctttggcaagctc

SEQ ID NO: 885 - protein, 502 aa, Oryza sativa
MEMMVQKQRHEEGEEERGGLCAREIKELDFFSAAGAGAGRRDDDDVLRADGISSSHAGFMVSTALDLLTAVNDGDHHEEKKGQSNIHQSKQMDAAATTVEGELRQAGEENRRLRRRLEELTSSYGALYHQLVQAQQLHTKHQQQAPIAGVQLLDALAAASPASHRRRAAAAVDGDRTADSDGGEGDENVSPSLGSKRPAAAATLTRLTPESGSGGENNGGGEQAPAAEMAPCRKARVSVRARSEAPMISDGCQWRKYGQKMAKGNPCPRAYYRCTMASQCPVRKQVQRCAKDKSILITTYEGTHSHPLPPAAAAMAKTTSAAAAMLLSGPAVSRDALFAAHHHVVAPPPFFHHPYAGSTMATLSASAPFPTITLDLTQPPPTTTTTAAAAMLQLHRPYAFSSLPFSMYGAGGGSHRPPVVLPPPSSVVETMTAAITRDPNFTTAVAAALSSIMAGGGAQARTPPRGGSDAAGDINGGGGADHATAGARAAAAATQPCGTSPT

SEQ ID NO: 886 - protein, 625 aa, Oryza sativa
MESYVGVKGKNVVGGGDVGREMPVAPPSSSSAAVGMVEFPAAAAGLGYAGMTAKEAGGGYQERRVVVGEMDFFKTAEKRGERKEPPPATATAAASGHAGASPDDLSLNKDDLTINMGLLVGRRRNSGSEESIVDDGGVSSNDEEHREAKAALAVTKAEIGRLSEENKRLKNMLSNVTTKYNSLQMQFVTLMQQRRSVLAAPIHQQELLDPEKKEQEGSQQQQQQLIPRQFISLGSASLQPDVEAPHSVVVVGGDVCAPSSSNPDAAVPAMMPLPHFDHHNHHHPIHGGRERGSSPAEADHHRHHQQEQPPPPPQQQQQLPPSWLPADKVPRFLPGKGPEPVPEAATMRKARVSVRARSDAPMISDGCQWRKYGQKMAKGNPCPRAYYRCTMAAGCPVRKQVQRCAEDRTVLITTYEGNHNHPLPPAAMAMASTTAAAASMLLSGSMPSADGSLMAGSNFLARAVLPCSSTVATISASAPFPTVTLDLTQTAPPPPPASSTQPQPPRPEPAQLQAALTETARPVALPQLFGQKLYDQSKLSAVQAVAGTKGSDGGALADTVNAATAAIASDPNFTAVLAAALTSYIGSRSGSGGAGAGGSSGTVQPLMSGGGDSCSRDDKIGEQNS

SEQ ID NO: 887 - protein, 583 aa, Oryza sativa
MEADDSGGGGGRARRSVEVDFFSDEKKNMKKSRVSGGVAAEADDAKGPAAAGLAIKKEDLTINVSRRRLLRSSIARHLFNSRRSNACARPCSLQLLPAGNNARSDRSMVVDDDAASRPDHEEKSRSSNELAAMQAELGRMNEENQRLRGMLTQVTTSYQALQMHLVALMQQRPQMMQPPTQPEPPPPHQDGKAEGAVVPRQFLDLGPSSGAGGEAAEEPSNSSTEAGSPRRSSSTGNKDQERGDSPDAPSTAAAWLPGRAMAPQMGAAGAAGKSHDQQAQDANMRKARVSVRARSEAPIIADGCQWRKYGQKMAKGNPCPRAYYRCTMATGCPVRKQVQRCAEDRSILITTYEGTHNHPLPPAAMAMASTTSAAASMLLSGSMPSADGAAGLMSSNFLARTVLPCSSSMATISASAPFPTVTLDLTHAPPGAPNAVPLNAARPGAPAPQFQVPLPGGGMAPAFAVPPQVLYNQSKFSGLQMSSDSAEAAAAAAAAAQFAQPRPPIGQLPGPLSDTVSAAAAAITADPNFTVALAAAITSIIGGQHAAAAGNSNANNTNTNTTSNTNNTSSNNTTSNNTNSETQ

SEQ ID NO: 888 - DNA, 483 bp, Oryza sativa
gcacgagggcgaggcaattcctcgatctgggcccgtcctccggcgccggcggcgaggcggcggaggagccgtccaactcgtcgacggaggccggcagcccgcgtcggtcgtcgtctaccggcaacaaggaccaagaacgtggtgacagcccggacgcgccgtcgacggcggcggcgtggttgccgggacgcgccatggcgccgcagatgggcgcggccggcgcggcgggcaagagccatgatcagcaagcccaggatgccaacatgaggaaggcccgcgtctccgttcgcgcgcgatccgaagcgccaatcatcgccgatgggtgccaatggaggaagtacggtcagaagatggcgaagggaaacccttgtccacgcgcgtactaccgctgcaccatggccaccggctgcccggtgcggaagcaggtgcaacggtgcgcggaggaccggtccatcctgatcaccacgtacgagggcacgcaca

SEQ ID NO: 889 - DNA, 1062 bp, Glycine max
  misc_feature (1026)..(1026): n is a, c, g, or t
ccctcgcgttttcccacgcgtccgcccacgcgtccgattttctatcagaatctgagggcccaaaatctagggttttctgttcttctctggggatctgaagacatgcagtccaagtctgaaactgcaaatcgactgagatcagatcctcattcctttcaacctggcagtgtttattctgagccttggtggcgtggtattgggtacaatcctgtggcccagacaatggctggggcaaatgcatccaattcatcgtctcttgaatgccctaatggtgattctgaatccaatgaagaaggtcagtctttgtccaatagcgggatgaatgaggaagatgatgatgccactaaggattcacagcctgctgctcctaatggaacccgcgcgtccgggcaagaacagcaagggatgctgcatactgcatcatctgcaccctccatgcgtgaagaatgccttactcagacaccacagctggaacttggcggtcattcaattgttagtctatgcctttgttgttatcacttttttaagacatatacatggtccaaatattgatgacttagttcaatagcataaattgttggtgattcatgcatatcattttgataaaaaaaaaaatctgttatagaatttatagttggcttgcctttggaatggattggactcttcatattcttttgatgtaggcatgtgctacaaatccttatcaggatccgtattatgggggcatgatggcagcttatggtcaccaacagttggtatgtgacattaatctggcttaattcaatattaaagattattgcatatataggtcatagtcataaactcataattactaatttgcatttttcacaaattagcctgataagaaatgtgggtagtacataatccagaagggatatgttcctgtcataatgataaatttgtttcattttggttggtctattggcttggtaaagcaatggtgatatttggataacagagaaaaataaccatgtgatatttttaccattagggatatggctcttntataggaatgcctcatgccagaatgcctttgcccct

SEQ ID NO: 890 - DNA, 946 bp, Glycine max
  misc_feature (903)..(903): n is a, c, g, or t
gttgtgttactattttttttttttaaatgtttgttttgatttttttataattttctctgttattattggtgtcgttgctattaattaatttctggtgctaaattgagataactgtgtgtgacaaagagagagagtaatcaagatagctcctttgaattttctatcagaatctgagggcccaaaatctagggttttctgttcttctctggggatctgaagacatgcagtccaagtctgaaactgcaaatcgactgagatcagatcctcattcctttcaacctggcagtgtttattctgagccttggtggcgtggtattgggtacaatcccgtggcccagacaatggctggggcaaatgcatccaattcatcgtctcttgaatgccctaatggtgattctgaatccaatgaagagggccagtctttgtccaatagcgggatgaatgaggaagatgatgatgccactaaggattcgaagcctgctgctcctaatgaaacaggaaattatgagcaagaacagcaagggatgcagcatactgcatcatctccaccatccatgcgtgaagaatgccttactcagacaccacagctggaacttgttggtcattcaattgcatgtgctacaaatccttaccaggatccgtattatgggggcatgatggcagcttatggtcaccaacagttgggatatgctccttttataggaatgcctcatgccagaatgcctttgccccttgagatggctcaagaacctgtgtatgtgaatgccaaacagtaccaaggaattctgaggcgaagacaggctcgtgcttaagctgagcttgaaagggagctcataaaatctagaaggggcataacatgctcacaaacattggacagaattgggttcctctactactagtgtncttcttaacgttttgggatcctctattgggctatatgctgaca

SEQ ID NO: 891 - DNA, 858 bp, Oryza sativa
agaaggatcaacaggcaatggcatcctagagtttgcagcaccagtaatttgaggatgaacaaatgcatgtgaagtgtatcctgttaatactccaccataatatggatcagtaccatatggataagaaacacatgcaaaaggctggttgtaatcgaactttgaaggaggaaaggcagcttctgtgttccccaaagacaataccgacttagtgccatggtcccgctccccacaactatcattgttgttaatatctgaggggacaaacactgattgtggtgaggtgtgttgtccgttgagactgctgtcacttactgcagatgcttcttggtgagactccccagactttgttggtgacgactcaccaccagagttcctctgaactaactgtttcattggatagttattcctggcaagaaaatcatagttggtcttggccatgcattggacaggatgattctccatttcttgcaacagcattatcattattagaaggcattactcaagatccacaaacattttctgtcctcctattttgaagttcagaaaattttcaggtcagactgacagtggcacataaagaaagccaagttactagataaattagtaccttgaattcggtttgtatactatccacatacaatgattagggattaggttgtacaaacatccaaactcagctggatgaacagttgaaaatgatcgaagcataaaataaatcaaagaactattgtacggcctctacaatatcattaacaaacaatactatgtccacttcatgatggattaatctatctagacagtacacctccaggataagaagtagaaatcctcctcgtgccgattcctgcagcccgggga

SEQ ID NO: 892 - DNA, 1544 bp, Oryza sativa
cccgggctgaggaatcggcacgaggctctcgttggctagcgcgcgggagccagtagccgcagctgcagcaagcagcagcagcagcgaagagcctgagccccagaggaggcgtgcaccgcctccgattggccggcctctcggagagagagagagagagagagatcgatcgagtcctattggccgccgcctccgcgccctggctgctcactggtgagcgagcatggagtcgaggccggggggaaccaacctcgtggagccgagggggcagggcgcgctgccgtccggcataccgatccagcagccgtggtggacgacctccgccggggtcggggcggtgtcgcccgccgtcgtggcgccggggagcggtgcggggatcagcctgtcgggcagggatggcggcggcgacgacgcggcagaggagagcagcgatgactcacgaagatcaggggagaccaaagatggaagcactggtcaagaaaagcatcatgcaacatcgcagatgactgctttggcatcagactatttaacaccattttcacagctggaactaaaccaaccaattgcttcggcagcataccagtaccctgactcttactatatgggcatggttggtccctatggacctcaagctatgtccgcacagactcatttccagctacctggattaactcactctcgtatgccgttgcctcttgaaatatctgaggagcctgtttatgtaaatgctaagcaatatcatggaattttaagacggaggcagtcacgtgcgaaggctgaacttgagaaaaaagttgttaaatcaagaaagccctatcttcatgagtctcgtcatcaacatgctatgcgaagggcaagaggaacgggtggacgcttcctgaacacaaagaaaaatgaagatggtgctcccagtgagaaagccgaaccaaacaaaggagagcagaactccgggtatcgccggatccctcctgacttacagctcctacagaaggaaacatgaagtagcggctcgaaacctagaacagtggcttctgtccaccggcattcactcttgagggtggattcttgctccagaattgtgctgccatctttcaaatgatcttcatcgtgcaaagtaattatatgtacattcctctgaatgatctatgcaccaattgttgatcctggcagggtaataatctggatgtattgagtccatcacagtgcgaatgtcacgggtagatctgctgttttcaggcaattcattcttggctttctatcccacccgttgttgttgcaagttaagctagcagtacttgtctcagtgtccgtgagacgtttgtgtaagattaggttaaactagaagttgtaatgctgtattaagtgtttgtatttctaatatgaaccgtaacaaggccagagcagaactcgttatacatacaaaaattgatggccaggtcagtgttaccgtattattatgcaatggcagaagcttgcataaggcgtggtgccactcgttgctttgctgtaaaaaaaaaaaaaaaaaaaaaaaaaaaaaaaaaagaggg

SEQ ID NO: 893 - DNA, 383 bp, Oryza sativa
agcctttggtccggcgggtggtgtggcggtggcgcgactagtggaggtagggcttcctgccttagaccagcctgttctccctctgggccttggcgcgggcacggtgacggcggaggatgccttcgtactgcttcgcgttgacatagattcggcgcatcggtatggcgcgtttagcggcatgtatgcattcgccctgccacctcatttgatttccatccgcgttaggtggtcaataagaaccatagcatttggctccataccaaggaataacttggtgagaggacctgaaaccacatggcctagtaatgttaacccaaattaggcaacgcataacacaccttgatggttactattcagaaaataaaatctttttagtaagtaca

SEQ ID NO: 894 - DNA, 1666 bp, Zea mays
cccagcgtccggcccgagccacttacaataatccttgcccaatcccgtctttagccgctagggttacgcgtccacggcgacgacctctgcgcagagcgtgctgcgattggccggccttcctgggatcctccccgcgcccgacacccggaaacgcgcgcgcgcgcgagggagagacagagtgaggaaacgagggaaggagacgacgcgctcgcctattggccgccggctccgctccttcgcgcccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgaggcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacaggagtcccgtgctaaggctgaacttgagaaaaaggtgggcaaagccagaaagccataccttcacgagtctcgtcatcagcacgcgatgaggagggcaagaggaaacgggggacgcttcctgaacacaaagaaaagtgacagtggtgctcccaatggaggcgaaaacgccgagcatctccatgtccctcccgacttactacagctacgacagaacgaggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcaatctgggcgcaggaatccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggttttcttttagcttttcaactgtaacacggccacagctgattcatgtgatgtgcttgcatatctttccttgtgccaatttttgtttgggggaacgcagtaattttatattttttatattcgggagtccacacaatcgtgtaaggttcctgcgaaccagttctgactttaattgaaccgcccggattcatatg

SEQ ID NO: 895 - DNA, 642 bp, Glycine max
  misc_feature (562)..(562): n is a, c, g, or t
tcacctcatcatctatcattatatctttctttcaattcctatcctcttccttgtagtgtacccattttgaatgtgttctctctctctctctctttctttaggtccctggtgaatatctagaaccactctctagctagtttctctcttcttgctagctagctatcgccgatcactctcttggtttaaaccacctgaatgccggaaaacatgagcatatcagtgaatggtcaatctcaagtccctcctggcttcaggtttcatccaactgaagaagagcttcttcagtactacttgaggaagaaggtctcttacgagaagattgacctcgacgtgattcgtgacgttgatctcaacaagctcgagccatgggacatacaagagaaatgcaaaataggaaccactccgcagaatgattggtacttcttcagccacaaagacaagaagtaccccacaggaacgcgcaccaatcgcgcaactgctgcagggttctggaaggccactggccgcgacaaagtcatctacagcaatggaaagaggattggaatgagaaagactctggttntctacaaaggaagagcgccacatggccagaaatccgattggatcatgcatgaatacagactagacgacaccacaccagcg

SEQ ID NO: 896 - DNA, 497 bp, Glycine max
gaaagaggaagacctactctctatctttaaacatgatccgggagagaataggggactcactcttcctatatttaccatcctaccatgaaggaaatagggggccttcacacttttggtttaaaccacctgtttgccggaacacattaccctgccaggtagtgcacaagctccagtgcctcctgggttcccgactcatccgactgaagaacagcttattcaccactactagacgaagaggtctcttacgagaagaggacctcgacgtgattcgtgacgttgatctcaacaagctcgagccatgggacatacaagagaaatgcaaaataggaaccactccgcagaatgattggtacttcttcagccacaaagacaagaagtaccccacaggaacgcgcaccaatcgcgcaactgctgcagggttctggaaggccactggccgcgacaaagtcatcttcagctatggaaagaggattggaatgagaaaaaactctgttttc

SEQ ID NO: 897 - DNA, 1034 bp, Oryza sativa
  misc_feature (4)..(4): n is a, c, g, or t
  misc_feature (199)..(199): n is a, c, g, or t
  misc_feature (205)..(205): n is a, c, g, or t
catngtgtcatggctccatcaccacctagcagctctacacctctctcttatattagctctctctctctctctacccccattcatgctcatctccttctagcttccagcttaatcccttccttgtcaatgttaatggacaaactctgagcattgcactacccatcatctcctagctagactcaccttagcttgtctcttngcgtcnctagtgtgtgattctttctcccatttcctgtttggtttgcactgagtgaacaagcaattaagcttggtagtagtagtagttgttgtattgatcgatcgatcgatctagagacgacgatgagcatatcggtgaacgggcagtcggtggtgccaccggggttccggttccacccaacggaggaggagctcctgacatactacctgaagaagaaggtggcctcggagcgcatcgacctcgacgtcatccgcgacgtcgacctcaaccagctcgagccatgggacatccaagagaggtgcaggattgggtcagggccgcagaacgactggtacttcttcagccacagggacatgaagttcccggcggggacgaggacgaaccgggcgacgggcggccggcttctggaaggccaccgggcgcgacaaggccatctacaacgccgtccaccgcatcggcatgcgcaagacgctcgtcttctacaagggccgcgccccccacggccagaagtccgactggatcatgcacgagtaccgcctcgacgaccccgccaccgacaccgccgccgtcacacccacggttacttctgctgctgctgcggcggcggcgatggccgcggcggcggacggcgggcaggaggatggctgcgtggtgtgcagggtgttcaagaagaagcaccaccacaaggaggcccgcgggaggcggcggcaagcacggcggtcgacggcagcgcccggcgccaagggcggcgcacgcttactcctccagcgacgacgcgctcgaccagattctgcagtacatgggcaggtcgtgcatgcaggagcacgagcttccc

SEQ ID NO: 898 - protein, 395 aa, Oryza sativa
MSISVNGQSVVPPGFRFHPTEEELLTYYLKKKVASERIDLDVIRDVDLNKLEPWDIQERCRIGSGPQNDWYFFSHKDKKYPTGTRTNRATAAGFWKATGRDKAIYSSSNRIGMRKTLVFYKGRAPHGQKSDWIMHEYRLDDPSSASASVSVNLPSYYSSSSSSSSPMHGVAGDQGAQEEGWVICRVFKKKNLVHHGGGAAAASHHAAAKLAAAAMEGSPSNCSTVTVSDHVKAQMLHSSASDDALDHILQYMGRSGCKQETKPAAMSASSAAAAAALEQHLSTPQYGKFMKLPPLEHVAGGVGLLAAAGGGGEYCSAADASGIADWDTLDRLAASYELNGALSDVASGKNMAGFFDVVDQPAGAAAFSSGDGDLWSLARSVSSSLHADLTTMNNV

SEQ ID NO: 899 - DNA, 633 bp, Zea mays
  misc_feature (9)..(9): n is a, c, g, or t
  misc_feature (572)..(572): n is a, c, g, or t
ggtaccctnccgagcctggccgggctgccaccagcaattcccttccattcctcacatcgtcttcctcctctggccttcccatcttcttcctctcgtcctcgatcgatcatcctgctaactagctagaggtctggcactagctgctaactagaaaaaaggaagaaagcaagcaagctaagaaggaattgaagatcgtatcatcaatgagcatctcggtgaacgggcagtcgtgcgtgccgccggggttccggttccaccccacggaggaggagctgctcaactactacctccgcaagaaggtggcctcccagcagatcgacctcgatgtcatccgcgacgtcgacctcaacaagctcgagccatgggacatccaagagagatgcaagatcgggtcgggtccccagaacgactggtacttcttcagccacaaggacaagaagtacccgacggggacgcgcaccaaccgcgctacggccgccggcttctggaaggccaccggccgcgacaaggccatctacagcgccgtcaggcgcatgggcatgcgcaagacgctcgtcttctaccggggccgngcgccgtacggacacaagtccgactggatcatgcacgagaattgactggacaaccctgact

SEQ ID NO: 900 - DNA, 1203 bp, Zea mays
ccacgcgtccgcccacgcgtccgcccacgcgtccgcccacgcgtccgcccacgcgtccgcccacgcgtccgcccacgcgtccgcccacgcgtccgcggacgcgtgggatcgtcttcctcccctcacatcctctggcctctggtcctccaccgtcctgctagccagagctgctcttgtacgcgcagctggcctctgtgcatatcaccagcacaccgcgcaggggaaggaaattaacaagagaaaaggcaaggagagcaggcaggcaaggaagctgcagaagccaaggaaggagaaggaggatcatcaatgagcatctcggtgaacgggcagtcgtgcgtgccgccggggttccgcttccaccccacggaggaggagctgctcaactactacctccgcaagaaggtggcctcccaggagatcgacctcgacgtcatccgcgacgtcgacctcaacaagctcgagccatgggacatccaagagaaatgcaagatcgggtcgggtccccagaacgactggtacttcttcagccacaaggacaagaagtacccgacggggacgcgcaccaaccgcgccacggccgccgggttctggaaggccaccggccgcgacaaggccatctacaacgccgtcaagcgcatcggcatgcgcaagacgctcgtcttctacaagggccgcgcgccgcacggccagaagtccgactggatcatgcacgagtaccgcctcgacgaccccgctgctgctgctgctgctggatccggtgatgccgtggccaacgacgacgcagccgccacggctgctgctgctgccgccgcgtcgtcggacggcgggcaggaggacggctgggtggtgtgcagggtgttcaagaagaagcaccaccacaaggagtcaggtgggggcgggggcaacaagcacggcagcagtaacagcgagcatgggcacggcggcgccggcaaggcatcggctgcggctgcggctgcggcgcaccagcaccagcaccatggaggcctgcagtactcctccagcgacgaggcgctggaccagatcctgcagtacatgggcaggtcgtgcaagcaggagcacgagctggtgtcgccggcgccggcgccgccgggacgggcggcggcgtccaggtacctccggcccatcgagaccgttctgggcgggcacgcgttcatgaagcttcccgcgctcgagagcccgtcc

SEQ ID NO: 901 - DNA, 820 bp, Zea mays
  misc_feature (750)..(751): n is a, c, g, or t
  misc_feature (755)..(755): n is a, c, g, or t
  misc_feature (758)..(758): n is a, c, g, or t
gccggccggttctgggtacccggcttccctcgtcaccggctccggctccggcaccggctcaatacaatcccatcaccaatcattcattccctttgcctactactgctaccttctcctccttccatcttcgatagacgacgaaataatggcggtattcgacgtctgaatcctcgtactcttatactgcatacatacagacagacccttcttcttccttagttccctatagctctagctaggcgaccgatcatgagcatctcggtgaacgggcagtcggtggtgccgccggggttccgtttccacccgacggaggaggagctgctgacctactacctgaagaagaaggtggcgtcggagcgcatcgacctggacgtcatccgcgacgtcgacctgaacaagctggagccatgggacatccaagagaagtgccgcatcggttcgggcccccagaacgactggtacttcttcagccacaaggacaagaagtacccgacggggacgcgcaccaaccgcgccaccgccgccgggttctggaaggccaccggccgcgacaaggccatctacgcctcgccgggcgcccgccgcatcggcatgcgcaagacgctcgtcttctacaagggccgcgccccgcacgggcagaagtccgactggatcatgcacgagtaccgcctcgaggcgcccgtcgacgccggagccggcgccgcgcaccacctgctgctccccgccgccgaacatcctccctactacacnntcgncgncgcaggcggcttcttcaatactaccgcaacgatcccgtggcgcggcgggagaccagcgggca

SEQ ID NO: 902 - DNA, 458 bp, Glycine max
acgagaacactctatccctcgttctttctctctctctctctctctctctctctagccagctttggttagacaacatagttctgaccaacatggtgcaatcaaggaaattcagaggtgtgaggcaacgccattggggctcttgggtttctgagattcgtcacccattattgaaaaggagggtgtggcttgggacattcgagacagctgaggaagcagcaagagcatatgatgaggcagccattttgatgagtggaagaaatgcaaaaacaaacttcccagttggtgaaaaccaaatagtgggaaatcacagttcaaacacttcctcttcctccactacaacattgtctgcagttctgagtgcgaagctgagaaagtgttgcaagtccccttcaccttccctcacttgcctgaggcttgacactgagaattcccacattggtgtgtggcagaagcgagcg

SEQ ID NO: 903 - DNA, 514 bp, Glycine max
gttacatatataaataaattaacttttccttctttttttttctcttttctcttcctatctttttgttgagtgcaggaagagaagggtgtggctagggacatttgagacagctgaggcagcagcaagggcatatgaccaagcagccattttgatgaatggtcagaatgcaaagaccaatttccccacctcaaagaaccaagctgaagctgatgacaacaacaacactgacactttcttatctccaaaagctctttcagaacttctcagcacaaagctgagaaagtactgcaaagaccctgctccttccctcacttgtctgaggctagatgctgataattcccacattggagtgtggcagaaaggggcaggaccacattctggctccaactgggtcatgaggttagagcttggaaagaaacaaattaccgaggagggtagtgagtcaacggagtcaccacaaagtagtactaatggtgctactgaaaataatgaagtagaagaggaggatagagtg

SEQ ID NO: 904 - DNA, 867 bp, Glycine max
tgttttattttacatctctctctctctctctatatatatatatataatcaacaccatccactactttctcacgcgccattaacaaagatatggtacaaacaaagaagttcagaggagttaggcaacgccagtggggctcctgggtgtcagaaattcgccaccctttactgaagagaagggtgtggctagggacatttgagacagctgaggcagcagcaagggcatatgaccaagcagccattttgatgaatggtcagaatgcaaagaccaatttccccacctcaaagaaccaagctgaagctgatgacaacaacaacactgacactttcttatctccaaaagctctttcagaacttctcagcacaaagctgagaaagtactgcaaagaccctgctccttccctcacttgtctgaggctagatgctgataattcccacattggagtgtggcagaaaggggcaggaccacattctggctccaactgggtcatgaggttagagcttggaaagaaacaaattaccgaggagggtagtgagtcaacggagtcaccacaaagtagtactaatggtgctactgaaaataatgaagtagaagaggaggatagagtggctttgcagatgattgaagaactacttaattggaactagaagaagaagaaaaaaaaaagggaaccttaatccgtgtcatatatagttcttgaatagtagtccttttttcatgctatccttttcaattcgtttacttttgtgctttctgtaaaaaaaatgtttgtcaaagtgctgatatctatatgatgatggccagtttgatagttacttatattatacactttttaagatatattgtgattgatggtaattatgcatc

SEQ ID NO: 905 - DNA, 817 bp, Glycine max
aattcggctcgagcgacagaagggggtcaacactgaattcaaaatcactttcgaccatattctcttcttcttctctctctccatcatggtgcaaacaaggaagttcagaggtgtcaggcagcgccattggggttcatgggtatcggaaattcgccacccttttctcaagaggagggtgtggctaggcacgttcgaaacagcagaagaagcggcacgagcttacgaccaagccgcgatattgatgagcgggcgtaacgcgaaaaccaatttcccaatactccaaaccccggagggtgacccaaagacgacgctaacacccatcgatcacgagacctcatcatcgtcgacgaccacctcgaaggaactggaagagattcttcacgccaagctccgaaagtgcgggaagcttccgtccccttccatgacctgcctgaggctcgaccccgagaattctcacatcggagtgtggcagaagcgcgccggccagcgttccgattccaactgggtcatgatggttcctcccctcggaaaaaaaggtggtgctaatgaaggaggtactggaggagatgcttcttgttctaactcctttccgttctccgagtgcgatccgaccccgcaagtggcaaggcaggagcttctgaggacggagatggacgaggaagaaagaattgcgctgcaaatgatagaagaactcctcagcaggaactgccccactagcccttcattcaataacttatattaattaagggaaatgtttcctgaagaaggataattctattcagtttctttaagggtctttagagataaattatgctgg

SEQ ID NO: 906 - DNA, 1128 bp, Glycine max
ttttttttttttttaactgaaaatatatttattatttatgataaataaaccatgaacgtttcaaacaagcagcagacgatagggcctttacatatgaactctgaaaataatattctgtatacatctctcttattttcttatgtatattttcctatgcatgcatgtaatatgtatgtgtatatatatattatctacacttataataaatatgacatacatgaaaacagatatgatatgatagatatgatgtggttatatataattagcctataactaccacttccctttttttcccaaataatgacaacccttgttgaagatgaagattaaacatgcatgtgaataccataacgctgtgtggaaaaaagaagcttaaagaaaaaagtggtcatgatcagcaccatccctttcttgaatgttgttgttaaatgatgggctagggcagtttctgtcgttgaggagttcctcaatcatctgaagggcaattctctcctcttcgtcaatctctcctctcacaacttcttgatgatgaagattacctgtcacagccagtgatggagactcaatgtggtgatgttcagaagaaggtagagaagaagaaagagaactactactgctactatcagcttgatgatgagtgtcattattattaacattaacactcttctttcccagttgaaccgtcatgacccaatttgaatcagaacgcctcccagcacgtttttgccacactccgatgtgggagttctccgggtcaagcctcaaacaagtcatagaaggtgaaggtaccttcccacattttcgaagctttgcatgtaagatttcctccagatccttcgaggtggtggagggagtgtcctcactggtagtgctctttggatcaccttctggagtttgagttattgggaaattggtcttggcatttctcccactcatcagaatcgcagcttgatcataggctctagcagcttcttctgctgtttcaaatgtccctagccacacccttctcttcagaagcgggtggcgaatttcggatacccatgaaccccaatggcgttgcctgacacctctgaacttctttgattgcaccatgatgttgttagagtttgttaattgctcgagccgaat

SEQ ID NO: 907 - DNA, 479 bp, Oryza sativa
cggcacgaggggaggatgctcactgtctgactgactgactggctgctgctgctgctcattccttctcctactctgcctgcctcctctgctgtgtccctgggagaattcttcagggacagtatccctgcagaggtgagatcatgggacagtcgaagaagaagttccgcggaggcaggcagcgccactggggctcctgggtctccgagatcaggcaccctctccttaagaggagggtgtggctgggtacctttgagacggcggaggaggcggcgcgggcgtacgatgaggccgccatcctgatgagcggccgcaacgccgagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctc

SEQ ID NO: 908 - protein, 243 aa, Oryza sativa
MGQSKKKFRGVRQRHWGSWVSEIRHPLLKRRVWLGTFETAEEAARAYDEAAILMSGRNAKTNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 909 - DNA, 438 bp, Oryza sativa
ctgcaggaattcggcacgaggctcctccgttcagttcagaggcgcctagcaatagcagctcattgcctcatctctgcctcccctgtccttctgggggcagagaatctctccactgctggaaaaatggtacagccaaagaagaagtttcgtggagtcaggcagcggcactggggctcctgggtctctgagatcagacaccccctccttaaaaggagggtgtggctgggcacctttgagacggccgaggaggctgcgcgagcctacgatgaggctgctgtgctgatgagtggccgcaacgccaagaccaacttccccgtgcagaggaactccaccggtgatctcgccacggccgcagaccgggacgcccgtagcaatggcggtagcaggaactcctccgcgggcaacctgtcacagattctcagtgctaagctccgcaag

SEQ ID NO: 910 - DNA, 434 bp, Zea mays
tctgaggacggcggcctcgtcgtacgcccgcgccgcctcctctgccgtctcgaaggtgcccagccacaccctcctcttactgcatattcgattcaagcatgcatgcccaccacgccgccatcgtcagaacgcatggcgaaagagaaagaccgaggcatctactactactactagagagcagcgtggctagctagtagagctgagggaagaagatctagcatggggggccaccagtttcttacagcagcgggtgcctgatctcggagacccaggagccccagtggcgctgcctgacgccgcggaacttcttctttgattgcaccatgatgcctgcagatccccgcgctctgcagggcagggacgggccggccggcaagcactgcagattctctgccaggggaaggaaggaaggagtgagcagcagtccagtcagt

SEQ ID NO: 911 - DNA, 1039 bp, Zea mays
attgggtacctcgaggccggccgggcacacggccccacacacttcacttcataggcgccccagcagagctcatctctgcctcctgtgtccttctccatgacagagaatctccactccaggaaaatggtacagccaaagaagtttcgtggagtccggcagcgccactggggctcctgggtctctgagatcaggcatcccctccttaagaggagggtctggctgggtacctttgagacggctgaggaggcagcgagagcatatgatgaggctgctgtgctgatgagcggacgcaacgccaagaccaacttcccaatccaaagaagcagcacaggggagcctaccccagctgcgggaagggacgcccgcagcaacttcagcagcggctcctctaccaccaacctgtcccagattctcagtgcgaagctccgcaaatgctgcaaggcgccatcaccgtccctgacctgtctccgccttgaccctgagaagtcccacattggtgtttggcagaagcgtgcaggagcccgtgctgactccaactgggtcatgacagtggagctcaacaaagatgcagcatccactgatgctgcatcacagtccacatcagcaacaactgctccaccagccacgccgatggatgaggaggagaggatcgcactgcaaatgatcgaagagttgctgagcagcagcagcccagcttcaccctcaaacggagatgaccaaggtcgcttcatcatctgaaaagcatggatcaaacagcacaagtcaccatcccagatcagagtttcgctaggtcggttggtacacaagcagttcaggttgcttcagtaatatagatatatgtctattactaaatccaacttacaagaactataaagtttgcaattgtgtgcagttctatgtacgtgaaaagctctacatacacatgttcctatcaagatactttgttacacatcaatgtcagtgatataattgcttataaaagaaataaatagattatgattgtgttactgctcaaaaaaaaaaaaaaaaaaggccccta

SEQ ID NO: 912 - DNA, 1416 bp, Glycine max
gatttcggctcgaggctaaagataggtcaaatccaacgctttcttcaacatacatatctcaattatgtagcattagcatacccttttttattctttcttctatttctctgcagggctcaagccttcctagctcccttccttggctcaaaagattttcccttgattttgccaatttggtgcatatctgcttcgttttgctttctgtgtcttcaagtcttacttggaagggtcagatttgctgcaaatctctccatttccccatcatcagaaggtttaatttcttggtttactctatagctacttgaaagaagtcaaaaaaagagataatggtgaggggaaagactcagatgaagcgtatagagaatgccacaagcaggcaagtaactttctcaaagcggcgaaatgggttgctgaagaaggcctttgagctatcagttctgtgtgatgctgaggctgctctaatcatcttctctccaagagggaagctctatgaatttgctagctccagcatgcaggagtcaattgaacgacaccgcaggcataccaagcatgttaatccaactacattcagatcagttgaacaaaatatgcagcatctgaagcaagaggcagcaaacatgatgaagaagattggccttcttgaagctgcaaaacggaagttcttgggggaaggtttgggggcttgctccattgaggaactgcaacggatagaacaacagttggagaggagtttaagtaatgttagagcaagaaaggtttttaaggaacaaattgaacaactaaaagaaaaggaaaaagccctactagatgaaaatgccaagctcactgaaaatgccaggctctctgagaagcatgacatccatctacagccagcaacaaagaatcagaatgtgaatcaaccccaatgcaatgcagaaagtagttcaagttcagatgtggagaccgaattgttcattggacttcctgatacaagagcaagacacatctctcatcacgtctagtagaagattacttattccctggctatggaaaataaaataagggtaagcctaactgtatcatcaatgtatatgtatcctgatgctctagtaaagataataatagaataattttaaatcctcttacagtatcttcctaataatccttctaattattaatgaaatgaagaaaatattaaattttttctctgttttccaagtgttaaatgtttttacattttcatctaatattttctttatgaagtataagaaaattattgggaggatgttataggaggatataaattattctaaatagtagtggtaattggtgggagtgatttgttttgcttgattatatcctcaaacccatggtctaatgacccgttgtattgatacttatactttagactcagcagtatgaaaaaaaaaaaaaaag

SEQ ID NO: 913 - DNA, 1285 bp, Glycine max
ctgttttggaccatggacttggtttttaccaaatcaagaaaaggatgaggtttcaatttttctattaccataaaacaggctcgagattttgtttcttaatatggtgaggctgggggaatcaattggggataggtggatgaataaggaaagcttggtctgattagtctatactatatgccttgctattccactttttctgagtttttctctgcactcctttgctagctaccctctcttttgggcttttttgggccttcaaatcttgcttggagaaggctcaattttggtggaaacctctcacacaagaaagcatagtttcttttgggttcattctacttggtgtttagagatggtgagaggaaagactcagctgaggcgcatagagaacgccacaagcaggcaagtcaccttttcaaagcggcgtaatgggttgctgaagaaggcctttgaactttctgttctttgtgatgctgaggttgctctcatcattttctctccaagaggaaagctttatgaatttgcaagctcaagcatgcaggacacaattgaacgataccgcaggcataacaggagtgctcaaacagtgaacagatctgatgaacaaaatatgcagcatttgaagcaagaaacagcaaacttgatgaagaagattgagcttcttgaagcttcaaaacggaagctcttgggagaaggtttggggtcatgctctttagaagaactgcaacagatagaacaacagttggaaaggagtgtaagcagtgttcgtgcaagaaagaatcaggtttacaaggaacaaattgatcaactaaaagagaaggaaagagccctatatgctgaaaatgctaggctgtgtgagcagtatggtggtatccagccacagccagcaacaaaggatccgaaagaaattcaaccctatgcagaaagcagtccaagttcagaagtggagactgaattgttcattggactactcaggtctagctattgaacataatttaatccttgcctatgcaaatatcaaataagaagcccaactgcaatgtataaatatcacatgtttcctaatactgagatgaataatattatcgcttgtattatataaagaactttctagccttatgattagggtttaattattgatatgtttgcctttcctcatttctgaagcccttttcatatataatagcatgcacaaaagggatctaattcaattagttgaacatggtatgtgagtgatataaatcttttgataccgtcttcgatttccatcaaaaaaaaaaaaaaaggc

SEQ ID NO: 914 - DNA, 1367 bp, Glycine max
ctgttttggaccatggacttggtttttaccaaatcaagaaaaggatgaggtttcaatttttctattaccataaaacaattttgtttcttaatatggtgaggctgggggaatcaccgggggataggtggatgaataaggaaagcttggtctgattagtctatactatatgccttgctattcccctttttctgagtttctctctgcacttcttgctagctaccctctcttttggggtatttcttttcattctccaaaaactctttaattttccttcccttttctgtgctattctctcctcactggtcaaaaggtttgtgggattttgctaatttggtgcaaatctgattcctttgacaaatccctcttgatctcctggcttattgaaaactactacaattccgagttgctttttttccctagttgcttttctgggccttgaaatcttgcttggagaaggctcaattttggtggaaacctctaccacaagaaagcatagtttttttgggttaatcatacttgaggtgtttagagatggtgagaggaaagactcagatgaggcgcatagagaacgccacaagcaggcaagtcaccttctcaaagcggcgtaatgggttgctgaagaaggcctttgaactttctgttctttgtgatgctgaggttgctctcatcattttctctccaagaggaaagctttatgaatttgcaagctccagcatgcaggacacaattgaacgctaccgcaggcataacaggagtgctcaaacagtgaacagatctgatgaacaaaatatgcagcatttgaagcatgaaacagcaaacttgatgaagaagattgagcttcttgaggcttcaaaacggaagctcttgggagaaggtttggggtcatgctccttagaagaactgcaacagatagaacaacaattggaaaggagtgtaagcaatggtcgtgcaagaaagaatcaagtttacaagggacaaattgatcaactaaaagagaaggaaagagccctatatgctgaaaatgctaggctgtgtgagcagtatggtatccagccacagccagcaacaaaggatccgaaagaaattcaaccctatgcagaaagcagtccaagttcagaagtggagactgaattgttcattggactacccaggtctatctagttgaagataatttaatccttgcctagtatgaaataagaagcccaactgcaatgtataaatatcacatgtttcctaatactttgagatgaataatattatcgcttatattatataaagaactttccgattttatgattaaaaaagaaagaaaaaggactagtgcgctcgagtagctggtctaaccccggatcgattccggaccggta

SEQ ID NO: 915 - DNA, 1256 bp, Glycine max
ccacgcgtccgattggggataggtggatgaataaggaaagcttggtctgattagtctatactatatgccttgctattccactttttctgagtttttctctgcactcctttgctagctaccctctcttttggggtatttctcttttccggctcgagaaactcttcaaatttccttcccttttctgtgccttattttctcttcactggtcaaaagatttctgggatttttgctaatttggtgcaaatctgattcccctttgacaaaccctcctcatctcttggcttattgacaactactataatttcaagttgctttttttttcccccttttttctagctgcttttttgggccttcaaatcttgcttggagaaggctcaattttggtggaaacctctcacacaagaaagcatagtttcttttgggttcattctacttggtgtttagagatggtgagaggaaagactcagctgaggcgcatagagaacgccacaagcaggcaagtcaccttttcaaagcggcgtaatgggttgctgaagaaggcctttgaactttctgttctttgtgatgctgaggttgctctcatcattttctctccaagaggaaagctttatgaatttgcaagctcaagcatgcaggacacaattgaacgataccgcaggcataacaggagtgctcaaacagtgaacagatctgatgaacaaaatatgcagcatttgaagcaagaaacagcaaacttgatgaagaagattgagcttcttgaagcttcaaaacggaagctcttgggagaaggtttggggtcatgctctttagaagaactgcaacagatagaacaacagttggaaaggagtgtaagcagtgttcgtgcaagaaagaatcaggtttacaaggaacaaattgatcaactaaaagagaaggaaagagccctatatgctgaaaatgctaggctgtgtgagcagtatggtggtatccagccacagccagcaacaaaggatccgaaagaaattcaaccctatgcagaaagcagtccaagttcagaagtggagactgaattgttcattggactactcaggtctagctattgaacataatttaatccttgcctatgcaaatatcaaataagaagcccaactgcaatgtataaatatcacatgtttcctaatactgagatgaataatattatcgcttgtattatataaagaactttctagccttatgattagggtttaattattgataaaaaaaaaaaaaaaaaacag

SEQ ID NO: 916 - DNA, 976 bp, Glycine max
ggctcgaggttttctgttttggaccatggacttggtttttaccaaatcaagaaaaggatgagcttttttgggccttcaaatcttgcttggagaaggctcaattttggtggaaacctctcacacaagaaagcatagtttcttttgggttcattctacttggtgtttagagatggtgagaggaaagactcagctgaggcgcatagagaacgccacaagcaggcaagtcaccttttcaaagcggcgtaatgggttgctgaagaaggcctttgaactttctgttctttgtgatgctgaggttgctctcatcattttctctccaagaggaaagctttatgaatttgcaagctcaagcatgcaggacacaattgaacgataccgcaggcataacaggagtgctcaaacagtgaacagatctgatgaacaaaatatgcagcatttgaagcaagaaacagcaaacttgatgaagaagattgagcttcttgaagcttcaaaacggaagctcttgggagaaggtttggggtcatgctctttagaagaactgcaacagatagaacaacagttggaaaggagtgtaagcagtgttcgtgcaagaaagaatcaggtttacaaggaacaaattgatcaactaaaagagaaggaaagagccctatatgctgaaaatgctaggctgtgtgagcagtatggtggtatccagccacagccagcaacaaaggatccgaaagaaattcaaccctatgcagaaagcagtccaagttcagaagtggagactgaattgttcattggactactcaggtctagctattgaacataatttaatccttgcctatgcaaatatcaaataagaagcccaactgcaatgtataaatatcacatgtttcctaatactgagatgaataatattatcgcttgtattatataaagaactttctagccttatgattagggtttaattattaaaaaaaaaaaaaaaaaaagg

SEQ ID NO: 917 - DNA, 1063 bp, Glycine max
  misc_feature (64)..(64): n is a, c, g, or t
  misc_feature (66)..(67): n is a, c, g, or t
  misc_feature (70)..(71): n is a, c, g, or t
  misc_feature (78)..(80): n is a, c, g, or t
tgagctattagaaggatacagatttatgagattttacactaaggaaaggatatattttgtgttnannttnnagatttnnnatattgcaaaatgattagtagattaatatacacatataatcagcactgctgctttggcaatccaataaatagttctgtatccacatctaaactctggctacttgaacagtggggttctgcttctgcttgtgtgtgtctaggccattgctgctgggatgacttttctgccctctgccacattgcacttaatttggcattctctttgagcaagttactctcctgggatcgtagttgatcaatctgttccgtatatagttgagtttttctctgcctgactctttgcaaacttatctgcagctgctcctcaattcctttgagttcatcataagaacaagaactcacgctttgtcccagaagctcccttttagaatgttctagaagctcaatcttctttgccaagcttgcggagtctaacttcagttgctggatataatcgtctccaaacttactggcaggaacatctttggtatgttcacggtatcgttccaaaatctttgtcatgtcagaacttgagaactcatagagccttccgttctgtgagaagactatcacagccacttctgcatcacaaagaacggataactcgtaagctttctttagaagaccacttcgacgctttgaaaacgtcacttgacggcttgttgtatcctcaatcttcttcaattgaacctttcccctcaccatctccaaaaattagcaagagacgtcttcaagaagaatttccctttaatttgtgttctttctaaagcaaatattttgaggttaaagttaaagaagagaagagaaagtgtagggagtggtagaaagaagtggcaaatattccagaaaccctagctagaaggatccccacttccagtaaagtggcatttatgatagctgttactcagaccacagaaaagggtatttccttattccatccatttttgtcatcctcccagagaatcgatagcccaacagttgacttgaaaccgagatcagaaaaa

SEQ ID NO: 918 - DNA, 879 bp, Oryza sativa
aaaacggaaacgcaaccgcacgcactcctcctgttgccgtttgcctctgtctccccctaccgcgcggtggggtggccactacgcgaacaaagggaaacggcaacacccgcagaccaaaaaggaaagccgaggaggagagggaggggagagaagggagagggggtcggggagaaagaagagcgagcgagcagctttggctacggccaaaccctacagcgcctccaccaccactcctggccttttttggtgagtcgccctttgccgactctcagatccccttgcgttttaccacttttgccttgtccgccgcccctccaattgggataaaaaagaaaagagctgcatctctcgctgctcctcctcctcctcctccgccgtgcaggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccagtacgcagaaaacaattgaacgctataggacgtatacaaaggaaaatatcggcaacaagacagtacagcaagatatagagcaagtaaaagctgacgctgatggtttggcaaagaaacttgaagctcttgaaacttacaaaagaaaactgctgggtgaaaagttggatgaatgttctattgaagaactgcatagcctggaggtcaagctggagagaagcctcattagcatcaggggaaggaagacaaagctgcttgaggagcaggttgccaaa

SEQ ID NO: 919 - protein, 483 aa, Oryza sativa
MAAAAAGMGGGGGVQHQETTTTVVQVAAEASRKKVEVRSAGRRGRREMRRIEDATSRQVTFSKRRSGLLKKAFELSVLCDAEVALIVFSPRGRLYQFASASSDLQRTIDRYLNHTKNSSAHEEGEESCVQKWRSEATTLGKKIEAIEGYKSKLLGEGLGSCSVQELQELEVQLEKSLCSIRQKKQKMLMDQILELREKEMNLLKENMVLRDQCKALSSPWSTSVGELKNKQADDDVHRHEDYSGGGVRDDDDRRMMEDVETDLAAANQAGKVLKKGKKKQAKDELDRQKQAEKKRRRLEKALANSAAIISELEKKKQKKREEQQRLDEEGAAIAEAVALHVLIGEDSDEPCHLMLNKHRRCNHWDHSAGFDFAVDAQGADIYPPDGLIQCADHVYAPKGRCIDWGIGQPLPSWGEVKDLQLQAPCYQGMFHQSVACPGFIAAQAVSSLQIGGDSSDITSPSQGATVVNRMLGATNRLNLYREI

SEQ ID NO: 920 - DNA, 1253 bp, Zea mays
cgtgggcgccctcgccccccccccggagatccccgtccccgttttccacttttgcctccgccccaattcggataacaaacccctccgcctcgtcgcgtctcctcccagccgagccgatccggtagagagagggagagggagagggagggactgagggaggaggagctgggttccggtcccggccgcccggccggctgcgcgattcgattgtagctctcgtccccgggcggcgtccaggatggtgcggggcaagacgcagatgaagcgaatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtctgtctgtgtatcatcccgtcccgtccgtcagagtctcagagaacgaacacttcttctccttctccctgtagctagctgctcctgcttgtgtccagatcttctgttcgatcgggtttgggaccaaaaaaaaaaaaaaaaaagcggccaaaaaaaaaaaaaaaaaaaaaaaaaaaaaaaaaaa

SEQ ID NO: 921 - DNA, 1284 bp, Zea mays
gctggctacggggccaaaacccttacgcgcgacgcggccccctcctcttcttctctctcccaccaccgccctccccttgccatttttggtgagtgccccctttcccttccctagaccagatcctcgccccgttttccacttttgcctccaccgccggcccaattcggataacaagctccctccgcctcgccgcgtctcctcccagccgcaggagccgccgccatccgatccggaagagggaggaggggggagggaggaggatctgtgtcccgattcgattggagctctcgtccccggcggtccaggatggtgcggggcaagacgcagatgaagcggatagagaacccggccagtcgccaggtcaccttctccaagcgccgcaacggcctgctcaagaaggcgttcgagctctccgtcctctgcgacgccgaggtcgcgctcgtcgtcttctccccgcgcggcaagctctacgaattcgccagcggaagtgcccagaaaacaattgaacgttatagaacgtacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagtgcaagaagcagccgccgccgccgccgcctatgctgatggctcctccgccgcctccagcgccggcagccatcgatcacacggggccgaaggatgtcgggatggacgtggagacggagctgtacataggattgcccggcagagattaccgctcaaacaacaaagacatgactgcacagtagctgtcaggtcaggtcaggtcaggctagccagcagtgcagagaataatcttagatctgtggtgcggagaactggagatgcaagccaagcccaagccaatcaacatgataaggatcatgagtgtcgcgtcgtgttttacaaacctgtccaccgtccgtcaaaggcacatgcgccagaacgtccgtcagagaacacttaccccctcatctccctctattagctagctgctccggcctgctcatgtcgaaaccttctgttcaagtatgttctcctcctgatgaattccctgcccggcacgcactggtgagcttctcctgccgaagaagtgggtggggtgggaacactgtcgttcatatttggcaacacacgaggtgtag

SEQ ID NO: 922 - DNA, 1491 bp, Zea mays
atacccttctcgtctccgcccagcagcaacggcacccaccgaatccgcccctccctctttccgttccgcctcgttgcgctcgctctcgctgcgccgcccgccccacctcacggagctcacggcaacaccggcagggaaggaaaaggaaagccgaggaggcgaggagagagagatacaaggcaggcagccaggcacaggcagcccgcggctggctacggggccaaaaccctttcgcgcgacgcggccccctcctcttcttctctctcccaccaccgccctccccttgccatttttgccgcaggagccgccgccatccgatccggaagagggaggaggggggagggaggaggatctgtgtcccgattcgattggagctctcgtccccggcggtccaggatggtgcggggcaagacgcagatgaagcggatagagaacccggccagtcgccaggtcaccttctccaagcgccgcaacggcctgctcaagaaggcgttcgagctctccgtcctctgcgacgccgaggtcgcgctcgtcgtcttctccccgcgcggcaagctctacgaattcgccagcggaagtgcccagaaaacaattgaacgttatagaacgtacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagactcagctgctggaggagcaactccataagctgaaggagaaggagatgaatctgcgcaagagcaacgaagatttacgtgaaaaggtaatgggggcgaaaacattttgcagacgctgcactgcggcaagcggcatgccaacaacccaagaaaacagtgcaagaagcagccgccgccgccgccgcctatgctgatggctcctccgccgcctccagcgccggcagccatcgatcacacggggccgaaagatgtcgggatggacgtggagacggagctgtacataggattgcccggcagagattaccgctcaaacaacaaagacatgactgcacagtagctgtcaggtcaggtcaggtcaggccagccagcagtgcagagaataatcttagatctgtggtgcggagaactggagatgcaagccaagcccaagccaatcaacatgataaggatcatgagtgtcgcgtcgtgttttacaaacctgtccacaccgtccgtcaaaggcacatgcgccagaacgtccgtcagagaacacttaccccctcatctccctctattagctagctgctccggcctgctcatgtcgaaaccttctgttcaagtatgttctcctcctgatgaaaaaaaaaaaaaaaaaaaaaaaaaaaaaaaaaaaaaaaaaaaaaaaaaaaaaaaaa

SEQ ID NO: 923 - DNA, 1239 bp, Zea mays
  misc_feature (1215)..(1215): n is a, c, g, or t
gagtgccccctttcccttccctagaccagatcctcgccccgttttccacttttgcctccaccgccggcccaattcggataacaagctccctccgcctcgccgcgtctcctcccagccgcaggagccgccgccatccgatccggaagagggaggaggggggagggaggaggatctgtgtcccgattcgattggagctctcgtccccggcggtccaggatggtgcggggcaagacgcagatgaagcggatagagaacccggccagtcgccaggtcaccttctccaagcgccgcaacggcctgctcaagaaggcgttcgagctctccgtcctctgcgacgccgaggtcgcgctcgtcgtcttctccccgcgcggcaagctctacgaattcgccagcggaagtgcccagaaaacaattgaacgttatagaacgtacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagactcagctgctggaggagcaactccataagctgaaggagaaggagatgaatctgcgcaagagcaacgaagatttacgtgaaaagtgcaagaagcagccgccgccgccgccgcctatgctgatggctcctccgccgcctccagcgccggcagccatcgatcacacggggccgaaggatgtcgggatggacgtggagacggagctgtacataggattgcccggcagagattaccgctcaaacaacaaagacatgactgcacagtagctgtcaggtcaggtcaggtcaggctagccagcagtgcagagaataatcttagatctgtggtgcggagaactggagatgcaagccaagcccaagccaatcaacatgataaggatcatgagtgtcgcgtcgtgttttacaaacctgtccaccgtccgtcaaaggcacatgcgccagaacgtccgtcagagaacacttaccccctcatctccctctattagctagctgctccggcctgctcatgtcgaaaccttctgttcaagtatgttctcctcctgatgaaaaaaaaaaaaaaaaaaaaaaaaaaaaaagtcnaacaaaaactaaaaaaactcaaaa

SEQ ID NO: 924 - DNA, 1272 bp, Zea mays
ctttttttttttttttttttttttttttttttttttttttaagaaaagtagcgcatcaagcttggttgggtgtatccatgggtggatttcattttcaggccccagaaggcttgcagctagctaaccagccgtttcttgcatccacatactacagatttatttttattttttttacttttcaagtacaagtttgcatacaaaagttgcaaataaaaccattgacgtgtgcccttcgatgctttaatttcagggagcttattccttttagccgatcgaactgaaaatccgtggttcaatcagagtcccggttggaggagcgctccctgccgggtaatcctatgtacagctccgtctccacgtccatgtcattgctcggtgccggcaggctacgcggccaaggagggacacagcggttcaggtccggtggcgcctccggtggagactggaggttgcgctgcttatcccgcaactctttgttgtcttggagcagggtcctctccttctccttcagcttggatatctgctgctccagcagttgtgtcttcttccctctgatgacgtgaaggctcttcgccagtttaacctccagattatgcagttcttcaatggagcattcttctaaattttcacccagaaacattcgtttggtcttttctagggcttcgagtctacttgccaagcttacggcatctgctttgacttgctgtatatcttgttgaacagtcttgttattgacattttcccttgtgtatgtcctgtagcggtcaattgttttctggaggctggcggcgctggcgaactcgtagagcttgccgcgcggggagaagacgacgagcccgacctcagcatcgcagagcacggagagctcgaaggccttcttgagcagcccgttgcggcgcttcgagaaggtcacctgccggctcgtcgcgttctctatccgcttcagctccgtcttcccccgcaccatcgtcgtggccgatcccttcacggcttcccgaaacggaagcgtccccaatccaggaaacgctagcaaatatggcaaagtaaaggaggcaagcaggcggtggtgaactagctactactactactagtgggctcttggctgcagctggcgcccgccgcgcggcctccgcctttcctttctggtgcttgcccgcccgtgccacgcgtgtcgggcactctcccggccggcctcgagggacccggtgttttatagtggcggggcgggtaagctagctgcgtgcgtgaccggaggaggacgcggacgcgtgg

SEQ ID NO: 925 - protein, 406 aa, Oryza sativa
MQESREYWRDGGDVVGEELLREILDETAAVHSNSNSNSNSNSNSKEAEEEDEREYFAAAAADEQLQVEAPCGRRRRESMVNKLISTVYSGPTISDIESALSFTAAGDHQLLADGHNFAASSCSPVVFSPEKTLSKTMENKYTLKMKSCGNNGGLADDGYKWRKYGQKSIKNSPNPRSYYRCTNPRCNAKKQVERAVDEPDTLIVTYEGLHLHYTYSHFLHSTSSSSSSTTTQQQLQPQPQMMTNCKKKPKLHLHPLLHDDPPPPPPPPEMTTMMIMQSFSIQQQQHDDDQLLQPAADDHLMVQAPPDDCYNINGSSSSGLMMSLDDDEQAAGAGGLLEDVVPLLVRRPPPPICNNNNYYYSPATTCTSDNEYGSSASASPSSSVSVSSWTTPMSPCIDMAILSNIF

SEQ ID NO: 926 - DNA, 2573 bp, Glycine max
ggctcgaggttctacatttttttttcttctccctttatctcttgccctttttgttggtggtgaaagagaagccttgagaacaaagttcccgttttcaaaattgaagcttttgggtctctgaggtttgatctctgcacaagaaccttgttttctcatctgggtgtgttgcttttgcctctgctggctcgatatggctgtggaaaaccaaagggaagatgggggttgtgatcgttttcctgtgggtatgcgtgttcttgctgtggatgacgacccaatttgcctcaaggtgttggagaatctccttcgcaaatgccagtatcatgttactacaactaatcaggcagttgaggcactgacaatgttgagggaaaacagaaataagtttgacctcgttatcagcgatgtgaatatgcctgacattgatggatttaagctccttgagttggtgggacttgaaatggacctacctgtcatcatgttgtcagcacacggtgatacaaagctggtgatgaagggtgttacacatggtgcatgtgactatttgctgaaacctgttcgaattgaagagttgaagaacatatggcaacatgtggttcgaagaaagaattttgatagcagggatcagaacaaggcttccaatgaggagaaggctcctaattttgctgggggaggtagtcaaggcctaagatcagaaaacagtgctgaccagaataaaaggcttggtaaaaaaaggaaggaccaaagtgatgaagaagaagaaggtggggaagagaatgaagatgatgaggacccctcagcacagaagaaagctcgtgtggtttggtctgttgagctgcatagaaaatttgttgctgcagttaatcaactgggcctagataaggctgttcctaagaaaatacttgacctgatgaatgttgaagggcttacaagggaaaatgttgcaagccatctacagaaatatagactctatctgaaaaaggcagcccagcaagctaacatggttgctgcattgggtggtagtgattcttacctacgtatgggttcaatagatggatatggagatttttgcacctcgtctgggtctggaaggatcacaaacactactttaccatcatatgcatctacgggaattttcagtaggctgaattctccagctgccttgaacatgagagcaattagttcttctgcgcttatccggcctgttcagtctcaaaacatcaactgctccttaaacacacttggaaacattcagccatctgtttttcctgcaaatcatagctcaagtttattacagggaattccgacatcaattgagcttaaccaatctaagcaaagcaactgtacaactggaatatcacagttaagtcaagttgattcaagtggatttacagttgcctctggcttcccagaccatagggctactgttaatggtccaaacaattctctcccgtgtgtctcaaataatcatataatgttacaaggaaatccacaaacgcatggcccaggagcgtttagcaatcagtcttctgtcagagcggcttctttgtgtgctgaatcttttgacgtgggcttatgtggttcttctaatttgttggatcataatcggtgcaatgataactggcagaatgcagctcaattgtctaaatttcctgccaattccttgccactttgtgaggctttcagcaatgaccaactgcctcccactagcatcaatgattcgaactcaagtactcatattggcaacaacagtccagttgatttttcttctaggatgggaatttctgttcctttggaggacaccagaaatgagctgagatgccaagagggcttgattgggaatattgtacagccttcaagttacacaccacgacaaaggtgggaagaacataaactggattataaccaaaacatgagctgtccctttaattctgtaaattcacacgcttcctccagtggagtgacaagttctatggggcatgttttaaaccaaaataatacaatttgcagcaatagagttgatgcatcatctttggttggccaactaaatggagcatccccatcaatcagccggtgcactgaagttgagaaattctcttcagacattcgactgaagccaaatgaagcctacattttggagcaaatgaagtcccaagatggatttatgcagaatacttttgggaccttggatgacataatgggtgtaatggtcaaaagggagcaaaatgagtcgacattgttggatggagaaatgggatttgatgcctaccctgttggatcatgcaactgatttcttcttaaccagaacgaatccaggagcaataaaatcgtgaaacttgctccagtctctgaaaccgattaatgtacacctatttttatgttctgctactaaatttattttcttggccaacattttgttgtttcacttatggacttttgttagccatctgatctgttccatctttttttcctttcaatctgtagtgtatccccataaaaattgtctttggtttagataaaataattgtaatatgaatgtttcttggtgctcaaaaaaaaaaaaaaagggcggccgc

SEQ ID NO: 927 - DNA, 2580 bp, Glycine max
aaaaagacaccaactttttcgctccttccttgcatttattcattcacacccgccccgattccggctcgtcccagctccccaaataaacaaaaaaaaatctttccttattgttttccgtgtttcctttgtttcatagcttctgggttttggttttcagacccacaatacaaagttcacaagtgtgtgtaaagattgaagaagaaaatgaccgtagagaagaaaatgaatgattccggcgacgagtttcccgtcggaatgcgtgttctcgccgtcgacgatgatcccacttgcttattggttctggaaactctcctccgaagatgtcaatatcatgcaaccacgactaatcaagcaataaaggcgttggcgctgttgagagaacacaaagacaagtttgacctggtaattagtgatgtgcacatgccagacatggatggatttaagctgcttgagctagtgggacttgagatggatcttcctgtcataatgttatctgcaaatggtgatacgaagctggtgatgaaggggatttctcatggggcctgtgattatctgctgaaacctgtaagaatggaggagctcaagaacatttggcagcatgtaatcaggaggaagaagtttgactcaaaggagaagaacaaaacccgcaacatagacaaacctacttcaaacagtagcaatggactagggtcatcaggaacaggaaattctgatcacaatgagaagctgactaagaaaaggaaggatcaagatgaagatgaagatgaggatcaggagaatgatcttgacaatgaggacccatcagcccagaagaagcctcgggttgtttggtctgtggacctgcaccgcaagtttgttgctgctgttaatcagctaggcattgacaaggctgtacctaaaaaaattcttgatttgatgaatgttgaaaagcttacaagggagaatgtggcaagccatcttcagaagtataggctttatctgaaaagaattagctgtgtggctaaccaacaagccaatatggtggcggccttaggggttgcagatccatcctatttgagaatgagttcggtgagcggggttggacatgtacaaacattaagtggttccggacagcttcataacaataatttcagatcctttccacctagtgggataattaatagattgaacactcctgctggtttgaatgtgcatggatttccttctggagtacttcaattgagtcaatcacaaaatttaaacaatgccaatgatcatcataaattccagtcagccattgttcctgctaatcagaatggtgttcagggaatgacagtatctgtagggcttgatcaactgcaaaacaataagggtgttatgtctgttcaaaacctgactactgtttttgatgccaaaacaacttttcccatctcgaataaactcccagatccaagaccaaaaataaccaactctggctctcacactccagatgtgagtttctcaaacaatgccttgatgttggaaccacgccctcaaggcacacaagggagtgtaagaattgaaactttatcttcttcagtagcctctcaacattcagaattttctttgtctttgctggatcaaggtagatatagtgataattgggcaagtactgtgcagccatctgtgatccagacaaactcttaccctccaagtgaatgttttggacagactaatatacctcctacagataacatggcttctgtacccttgcaaggtgggaatctaagtggtgcgtccatcacttcactgtccaggcaatcctatgattcaatgacagatatgcactctgaaggagtgacttttaccaacagacctgggcatataagcagtaatgtgccatatcaagggtggcatgacaataatcaggatgctactcaccattcaaatattttgtcaataaactcactgactccagtcaatggtgctgctgttccagctggccatgcagcaatgaactcagccttacacagaaacttggactttaattattgtgatcccttacaaatgaagcatgagggatttgtggagttaactgacgaggccttatcgaaacaacatcaggggaatatcatgaacctaccgaaatctcaacaaagtcatttctctaataatcttggttcactggaagacttggtcagttcaatgatgaaacaggaaaatgataagatgaaattattggatggaaacctcatttgcaataattactctggtgggttatctcgatgtgatagcaggtttagcagcacattccagaatatcatgcatcctcgctgatgaatttttttgtagttttcatcgtgttttaagggctttagcttttgtcttctcgtagttactataggatttagcttctccagattactttgttctctaggtttgttccactaagggctttctattttttaaacaaatgcattgttgtccttgccttgagtccagcaatgcaatatggagtgttattgatcactttgtttaatctccttagatatgttggccttcaaattggacctaaaaaaaaaaaaaaaaaaaaaaaaaaaaaaaaaaaaaaagggcggccgc

SEQ ID NO: 928 - DNA, 2449 bp, Glycine max
gaattcggctcgaggcgagaagacgacagaaggggagagaacacaaagacaagtttgacctggtaatcagtgatgtacacatgccagacatggatggatttaagctgcttgagctagtgggacttgagatggatcttcctgtcataatgttatctgcaaatggtgatacgaagatggtgatgaaggggatttctcatggggcctgtgattatctgctgaaacctgtgagaatggaggagctcaagaacatttggcagcatgtaatcaggaggaagaagtttgactcaaaggagaagaacaaaaccagcaacctagacaaacctacttctaatagtggaaatggactagggtcatcaggaacaggaaattctgatcaaaatgagaagctgactaagaaaaggaaggatcaagatgaagatgaagatgaggatcaggagaatgatcttgacaatgaggacccatcagcccagaagaagcctcgggttgtttggtctgtggacctgcaccgcaagtttgttgctgctgttaatcagctaggcattgacaaggctgtacctaaaaaaattcttgatttgatgaatgttgaaaagcttacaagggagaatgtggcaagccatcttcagaagtataggctttatctgaaaagaattagctgtgtggctaaccaacaagccaatatggtggcggccttaggggttgcagatccatcctatttgagaatgagttcggtgagcggggttggacatgtacaaacattaagtggttccggacagcttcataacaataatttcagatcctttccacctagtgggataattaatagattgaacactcctgctggtttgaatgtgcatggatttccttctggagtacttcaattgagtcaatcacaaaatttaaacaatgccaatgatcatcataaattccagtcagtcattgttcctgttaatcagaatggtgttcagggaatgacagtgtctgtagggcttgatcaactgcaaaacaataaggttgttatgtctgttcagaacctgaccactgtttttgatgccaaaacaacttttcctatcccaaataaactcccagatccaagaccaaaaataaccaactctgtctctcatacttcagatgtgcatttctcaaacaatgccttgatgttggaaccacgccctcaaggctcacaagggagtgtaagaattggaacattatcttcttcagtagcctctcaacattcggaattttctttgtctttgctggatcaaggtagatatagtgataattggacaagtgctgtgcagccatctgtgatccagacaaactttttccctccaagtgaatgttttaggcagactaatatacctcctgcagataacatggcttctgtacccttgcaaggtgggaatctaagtggtccatccatcacttcattgtccaggcaatcccatgattcaatgacagaaatgcactctgaaggaatgacttttactaacagacctgggcatacaagcagtaatgtgccatttcaagggtgggatgaccataatcaggatgctactcaccattcaaatattatgtcaataaactcactgactccagtcaatggggctgctgttcaagctggccatgcagcaacgaactcggtcttacacagaaacttggattttaattattgtgatcccttacaaatgaagcatgaagggtttgtggagttaactgatgagaccttattgaaacaacatcaggggaataccatggaccagcaaaaatctcaagaaaatcatttctctaataatcttggttcactggaagacttggtcagttcaatgatgaaataggagaaagataagatgaaacacttgatggaaacctcatttgcaataattactctggtgggttatctatgtggtagcaggtttggcagcacataccagcatatcatgcacatcctcgttgatgaattttgtagctttcattgggtttaaccacttttttcttctcatagttactataggctttagcttctccagattactttttcctgggtaaagttttctaggtttgttccattaagggctttctaattttatacaaatgctttgttgtccttgccttcaggtccagcaatgcattatgaagtatcaatcactttgtttaatctacatagatatgctggcctgcaaattggacctagatcttctctcacagcctcacttgtagtgaggagagagagacaaaaggtccaggtggaacccacttgaacctgtgtctttctcactcctcgctgcactctgtgtagcagatggggagagatctggggttgcaaatttgtaaaatgttagggatccataaacaaagattgtagtgattatgatgaatgacaataaacatggatgcccccttttatgcttggaaaataaaaaaaaaaaaaaaaaaaaaaaagcggccgccg

SEQ ID NO: 929 - DNA, 1823 bp, Glycine max
gcggccgccctttttttttttttttttttgtgtaaaaaaacatgaatgctatttcgtcggccattatttgcattcataaagggaagaccccgagtttattgccactaaaattattttattcttgcttatggaccactaacaaattgctagaaaagcatgtctgcacaaaactaaacatggttaactccataatgcactagagggccccatccataaaacaacgcattttcacaaattgagaaagcccttgctgaaagtaataataataccctagacctagaaaataccaccaagaagacaaaactgggaagagtggtaaaccaagacttgtcacgctacaaaattcatcaacaaagcatgacatgatgcgcaaatatactgccaaagttcatatcacatggatgttccgtcagggtaattattgttgcataaatatgatccgtccaagaatttcaccttgtcttgtttctgtttcatcaccgaactggcaaagtcttccaatgaaccaagattattaggggcgcgactgttttgagacttctgccggttcatgatgtacccgtgttgttgtttcaatgagttttcgtcactcaatcccataattccatcatgcttcatctgtaagggatcacagaaattgaagtccaggtttctgttgtaggttgagttgatagaagtatggccttctggatcaatcagagtgtctattgagttaccaataacatttgcatcgtaactactatcatgattatggtcatcccacccgtgaaatggcacattattgctcatttgtcccgagttatttgtaaaaatgagtccttgagagtgcatatccgtcggtgaatcatgggattgattagacagtgaagtaatggatgatgcaccactcagattccccccttgcaaagtttcacttggagggtaagaatttgtcccagatgaccgcataggacttgaccaaatatcactacacctaccatgacccagcaaaggaagcgaaaattgtgaatgctgagatgctactgaagttaaattctcatatactcctctcccttgtgtgttttcactatctgctttcaataccaaggcattgtttgagacgtccaagaccggagagggtgagcaacccattgttacttttggtatttgatctgagagtctatttgacacagcaaaagttggtctggcatcaataagaggggacatgttttgaataggaccaacactaacactaacacccttattatgttgcaattgatcaaggcctatagacattggcattccctggatagcattttgattaccacaagctatggatgattggaacttaagtggatcatttatggagttgtttaaattttgtgcatgactcaactgaagagcttctgaagaagacaacccatgattattcagaccaacagaagtgttcaatctaccaatcattccaccaggtggaaagggtctgaaagcattgttatgaaactgttgtggaccagtcaatgtctgcaaatgtccaacgccactcagagaacccattctcaaataagatgaatctgcagtacctaaggctgccaccatattagcctgtcggtttgccccacagctaattcttttcagataaagtctatatttctggaggtggctggccacattctcccttgtaagcttttcatcattcatcaagtcaagaatctttttaggtacagccttgtcaatgcctaatagattgacagcagaaacaaacttgcggtgcagctccacagaccaaacaactcgaggcttcttctgagttgatgggtcctcattgtcctcgagccgaattc

SEQ ID NO: 930 - DNA, 765 bp, Oryza sativa
  misc_feature (569)..(569): n is a, c, g, or t
catccatcatcccctacctctcgctctctctctcctctcctctcctcttattatcatcgcatccatcccgcacttctctctctttggtggtggtgctcgctctcgctcaccctgctttgacctttggatttttatttttaaggatccaagaaagtgctgtttcttgggttgcttggaggtggaggagtttgggagattgtttgtgtttgattgattggttgattgattggaggaagatgacggtggaggagaggcaggggagggtgggaggccatggtgtgagcggcggcggcggcgggagagaccagttcccggtcggcatgcgggtgctcgccgtcgacgacgaccccacctgcctcaagatcctcgagaacctcctgcttcgatgccagtatcacgtgacaacaactggtcaggcggccacggccctgaagctgctcagggagaacaaggaccagtttgacctggtgatcagcgacgtccacatgccggacatggatggcttcaaactccttgagcttgtcggcctcgagatggacctcccagtcattatgttgtctgcgaacggngaaacacaaactgtcatgaagggtataacccatggtgcatgtgactatcttctgaagccagtgcgtcttgagcagctaaggacgatatggcaacatgtgattaggcgtaagaattgtgatgctaagaaccgtggtaacgatgatgacgctggtcagaaggcacagggaatgaacaatgaggtgagagtattggtgc

SEQ ID NO: 931 - DNA, 1485 bp, Oryza sativa
cacgaggcttgctctagctcagctagctcttgctgctagtagcttcagctttgctactgctactaccactactactactactactttcacctccaagaaagtatagattgcaagaacaatttctgctgctgttgttctttcttgctgttctttctccttgtgtagttgtgtggtgtggttgagctgaggtgtagttaggacagtggctggctttgcttgcttgattggtcacctgggaaggtcgctgtctctgccttttgttttctttgccatctctttctttctgggctgctctcaccttttgctttccaacctcttcttgccatcaataatgatggaggagtaagatgagggcttgttcttgaagtctctccaatctaatctcatttcatcttcatcatctccacccggtccaaatccacctactactgtttttcttttgtcccttctcttttttttcttcctctgatcttttcttttttcaggtgttttgtttttggcagtaggtgcttgctatcttttcattaggctttggattttcctctcgtgttctttagtctcagcctattagaggtttgaggaaagttttccatttcttagctctttttgcttccagcttcttgggattgctctgtttcttgctgagaattggctcgatttgggaggcctcatcttgtgttagctttcaggttttcttgcctgaaattgaaccgattgggtaggtttttaggtgcttcagtttcagttgctagctcgtcaggcttgttcttgggctcctgccttgaattggggtcaaattgggatgcttctgggccctcgcggccgcccgctcggccggggattgatggggagggagagggatcaattccccgtcggcatgcgggtcctcgccgtcgacgatgacccggtgtgcctcaaggttcttgagaccctcctccggcgctgccaataccatgtaacatcaaccaaccaggctattactgcgttgaagctgctcagggagaacagggacatgtttgatcttgtcatcagtgatgtccacatgcccgacatggacggatttaagctccttgagcttgtggggcttgaaatggatctcccagtcatcatgttatcagtaaatggagagacaaagactgtgatgaaggggataactcatggtgcctgtgactatcttctaaaaccggtccgaatcgaagaactaaggaacatatggcagcatgttgttaggaggaagttcggtaatcgtgagcgaaacaatcttgatttctccaaagaatgcaataagccgcaaagcgcggatactgatcatggaccataccaacctacctgtggttcttctgatcaaaatgggaggtccagcaggaaaaggaaagaactacacggcgaggacgacgatgaaggcgatgataatgattatcaagaaaatgatgagccctcagctgcaaaagagcccagagttgtatggtcagttgagctgccccg

SEQ ID NO: 932 - protein, 131 aa, Oryza sativa
MSTKTVPEPEPHVLAVDDSIVDRTVISRLLRSSKYRVTTVDSGKRALEVLSLDRNVHMIITDYCMPEMTGFDLLKRVKESAELKEIPVVLMSSENSPTRIRRCLEEGAEDFLIKPVRPSDVSRLCNRVIMK

SEQ ID NO: 933 - protein, 256 aa, Oryza sativa
MASSGDTNTVMKYVANGAFDFLLKPVRIEELSNIWQHIFRKQMQDHKNNNMVGNLEKPGHPPSILAMARATPATTRSTATEASLAPLENEVRDDMVNYNGEITDIRDLGKSRLTWTTQLHRQFIAAVNHLGEDKAVPKKILGIMKVKHLTREQVASHLQVHIKYRMQLKKSIPTTSKHGATLSSTALDKTQDHPSRSQYFNQDGCKEIMDYSLPRDDLSSGSECMLEELNDYSSEGFQDFRWDSDKQEYGPCFWNF

SEQ ID NO: 934 - protein, 642 aa, Oryza sativa
MRAAEERKGVVPAARRRDQFPVGMRVLAVDDDPVCLKVLETLLLRCQYHVTTTNQAAIALKMLRENRDMFDLVISDVHMPDMDGFKLLELVGLEMDLPVIMLSVNGETKTVLKGITHGACDYLLKPVRIEELRNIWQHVIRRKFSTRDRANLDFYEECNKPPNADSDHVHGHVTCGSPDQSGRPSKKRKEYCSEEEDEGEVNTQDIDDPSAPKKPRVVWSVELHRKFVAAVNQLGIDKAVPKRILELMNVEKLTRENVASHLQARNSFHYLLFISMYCPRNNPAALGTQGVPASKSIQTMSGSHTLSHSINDANKYHLSLPGNQKGNLGQGLATSLGQTQMQQKWIHEETDDLSTILSGNGLSNGMSGTLQSVTSSPLLPQELAECTQAKIVSQPSIRTSSVSSEHIEGAVGVSSGLLESRVSQQSTIPLSGFSANGLLIHGSFNNTCANKLGGTSSSCAPARSSNDLMVARDTKGGASSFGGAMLLPPDTEQKYLNFGGGNGLKQKFDDRTADSLFDLKFVWSSVPSSQLASNIGAHHAMSQRWNNSSSNSSNIGARMIGQATSSGSTVIPQMKTDFLVSGDMAMPKNASDLSIPKLQSELSSSSCSFDGLLNSIVKVEKDDVTFSDDLGCGDFYSLGACI

SEQ ID NO: 935 - protein, 564 aa, Oryza sativa
MTVEERQGRVGGHVTTTGQAATALKLLRENKDQFDLVISDVHMPDMDGFKLLELVGLEMDLPVIMLSANGETQTVMKGITHGACDYLLKPVRLEQLRTIWQHVIRRKNCDAKNRGNDDDAGQKAQGMNNEGESIGANRNKRQSRKSRDENGDDGDDSDENSNENGDSSTQKKPRVVWSVELHRKFVAAVNQLGIEKAVPKKILDLMNVENITRENVASHLQKYRLYLKRLSTDASRQANLAAAFGGRNPAYINMNSFGNYNAYGGLNNGNMIRGAQMSTILTGPSGNSFPNISNGAPLATANRSLQPLESSNQQHLSRVHSSSADPFSTLVGESPQFPDLGRTTNTWQTAVPSNIQDRGHNDNMSQATLHMNGPKIEPVSSFTSSNQIPLLGNEMQGQVASLASNVPIAFNQDTSPFNYGSSTNSRDMLNNSHVFSNSSINTSLPNLSLDNPAVPRQTLDRGNTGIVSPMQDGRIHHQAVSNQLNYNDDLMRTTGLQRGLSGGLDDIVVDMFRPDREDDGVPYIDGDWELFCEDGKNSCVRLRPELRILKLQISEEKLLNYSLN

SEQ ID NO: 936 - protein, 349 aa, Oryza sativa
MEERKGLMGRERDQFPVGMRVLAVDDDPVCLKVLETLLRRCQYHVTSTNQAITALKLLRENRDMFDLVISDVHMPDMDGFKLLELVGLEMDLPVIMLSVNGETKTVMKGITHGACDYLLKPVRIEELRNIWQHVVRRKFGNRERTNLDFSKECNKPQSADTDHGPYQPTCGSSDQNGRSSRKRKELHGEDDDEGDDNDYQENDEPSAAKKPRVVWSVELHRKFVAAVNQLGIDTNSFMFVSFFFFYLTVDAQAVPKRILELMNVEKLTRENVASHLQFMRSSIIHSFIRPAQSDRKSLIIIHVANADAAQHREFKIPPHGCLNSEKLTILSHHLLNLHRNVVQQTSDQD

SEQ ID NO: 937 - protein, 694 aa, Oryza sativa
MAATQATAARKFPEGLRVLAVDDSPVCLMLLEALLRRCKYQPTMTRDAATALRMLRERPGDFDLVISDVHMLDMDGFKLLELIGLEMDLPVIMQSANGELETMMKGVTHGACDYLVKPVSLKDIQNIWQHVWRKRKLDIRNHNGGYNDGGELVGATRTKRKYTRKMRNDGDNYGENKENMDSTLKRQRVVWTPELHRDFVIAVHELGVDRAVPRKILRMMKVDYMTRENIASHLQKYRLYLKRISTQTGMDPDQFPEKWKYMNELDALKNYCENGRYRLTPAIASSSSSNPFARMNSASALATNGFLPTHSVQLKNSQRNMAMGTVGHGGSPGNNPVFQPLQNSSNARKCFPSGPSGSSFANISNGLVLDTDDSGSSYAGMFCKSMWETSNGSPSCHSGNSSANKSNNGVSAPANQFQVQSKFGFSALANQFPVQSNCGFSAPANQYQVQSNGGFSVPANQFPVQSNGEFLAPTNQFPVQYPEVNNQPLVQMNQSSTNHFSTIGNDYQFPDLANCSKYWQPTAPSMFPDLGHNDGTSFRPSQANIANINQLSSFAASSGQEPMFGDELHGQMSPIMSTISLSDFDDQMGSFNIGNDTSPAEMMHDNFSLGSDSNISSSTPTDSSFGSTFPDFHLDSPEMPAQMLNGGDEDGILLPVLDDTVDQQDLFDQLDENNGREKLGSGRCVRKGPFECFF

SEQ ID NO: 938 - DNA, 490 bp, Oryza sativa
aagccgagagttgtttggtcagttgaactacaccggaaatttgtcgctgctgtcaaccagcttggaattgacaaggctgtgccaaaaaggatacttgagctcatgaatgttgagaaactcacaagggaaaatgttgcaagtcacctacagaagtacaggctctatctcaaacggctaagcgctgtggcgtcgcaacaagttagcatcgttgctgctttgggaggtagagacccctttctgcacatgggtggatttgaaggactacagggttatcaagcttttacctcttccgcagctctatcatcttttactccacatggattgttaaacagtcctagaaacaatccagcagctcttggaactcagggggtacctgcttcaaaatcgattcagactatgagcggaagccatacattgagccattccattaaatgatgcaaataagtaccaccttagcttaccaggaaaccagaacaggacacttgggaca

SEQ ID NO: 939 - DNA, 2563 bp, Zea mays
  misc_feature (9)..(9): n is a, c, g, or t
ctccctccntattatcattgggttcctccacgcccccccacacacaacccttctccccaaccccatctctctctctctgcctgcgttctcctggtgctgctctcgctctcctcccctgctttgacctccccgcctttccccgccgtttcttggatttctaggatccagacaaccgcccttgtgagcctgccttcctgcctactacctgcgtacgtacaggagggtccttgcttgggtgatccgggtgcctggtttctcggttccgcggcttccgctgctgttggattcgccgagccggagccgccggagatgaccgtcgacgagctgaagctgcaggcgagggccagcggcggccacggcgccaaggaccagttccccgtcggcatgcgcgtgctcgccgtcgacgacgacccgacctgcctcaagatcctcgagaacctcttgctccgctgccagtaccatgtgacaacaacgggacaggcagccacggccttgaagctgctgagggagaagaaggaccagtttgaccttgtgatcagcgacgtccacatgccggacatggacggcttcaagctcctcgagcttgtgggcctcgagatggacctcccggtcattatgctgtctgcaaatggggagacacagacagtcatgaaggggattacccatggagcatgtgactacctgctgaagccagtgcgtattgagcagctgaggactatatggcagcatgtggttaggcggaggagttgtgacgccaagaacagtggcaatgacaacgatgattcgggtaaaaagttgcaggtggtgagcgctgaaggtgacaatggcggtgttaatcgcaacaagagaatttcacgcaagggtagggatgataatggtgatgacggtgatgattctgatgacaacagtaatgagaatggagactcgtcgagccagaagaagccaagggttgtgtggtctgttgaattgcaccgaaagtttgtggctgctgtcaaccagcttggcattgacaaggctgttccaaagaaaatattggatcttatgaatgttgagaacatcacaagggagaacgttgcaagtcatctgcagaagtatcggctgtatctgaaaagactcagcgcagatgcaagcaggcaggctaacctaactgctgcatttggaggaagaaaccctgcttatgtgaacatgggactagacgccttcaggcagtacaatgcatatgggagataccggccagttccaaccactaaccattcacagccaaacaacctccttgcaaggatgaactctcctgcatttggtatgcatggtctgctgccttcgcagccacttcagattggacacaaccagaacaatctgagcacttccctagggaatgtcggggggatgaacaacggcaacctgatcaggggtgcgcatatgccactgcaggatactagcaaatgctttcctactggcccttctggtaattcgttcgcgaacatatcaaacagcacacaactggttacgacaaacaacttgccattacagtctcttgagccaagcaaccaacaacaccttggtcggctgcattcctctgcagaccctttcaactcatttgttggtgagcccccccagtttgcagatcttggaaggtgcaacaccacctggccaaccgcggtctcatcatccaatgttcaggagattggccagaaggacaggatcgtgaataggcccaagcttgagcctctctcaagctttacagaagcatccagtcagatccctttgctgggaagtgaaatgcagagccaccaagtagcatcactagccagcaacggtcttccgatgccgttcactcaggaagcggtgcccttcgcttatggaagcagcacgaactcgagagagatgctgaataacaaccttgcgcttagtaattcaggcgtcaactctacattgccgaaccttcgcatagacggttctgttgttccagggcagacactgggtggtagcaattcaggtggttgtgttgtcccccctctgcaagatggcaggattgatcaccaagctgtcagcagtcatctaaactacaacaacgaactcatggggacaggtaggctgcaaaggggacttagtggtggtctggatgacattgtcgtggacatgtttaggccggaccgcgcagacgatggcgtctccttcattgatggggactgggaactggtctagcaagtttcagttctctacatcaagtctgccttcgtgtgagattttccgcatttgtggttgtggaggggttcggcgcttgattggtccaaagttgtttatagtagcaagattgcatcacaaatgccctttgcatttggtttttcagtttagcgaccaggttccagtgtcacgtccgaatatcaactatgtggtatttgctaccttaactcgtatggctatgttttcaagtcaggtgttaactgtggctatcgtgatatatacagcatggttatgagccaaaaaaaaaaaaaaaaaaaaatcttaaaaaaaaaaaaaaaaaaaaaaaaaaaaaaaaaaaaaaaaaaaaaaaaaaaaaagg

SEQ ID NO: 940 - DNA, 846 bp, Zea mays
  misc_feature (709)..(709): n is a, c, g, or t
ctctctctccctgctccctgcctcccctctcccctgctttgaccctgctgcccggccggctgcctggctttatctgcccgccgcgcctttccccgccgcttggatttgtaggatccagcgacgcccgtccccgcgccgctcgccggggcattaggtggcccggccgtgccgtgtgggactcgcgggggaaggaagatgaccgtggaggggagggtcggcggcggcggcaaggacaagttcccggcgggcatgcgcgtgctcgccgtcgacgacgaccccacctgcctcaaggtcctcgagaacctcctgcgccgctgcgactaccatgtcacaaccactgggcaggcagccaccgccctcaggatgctcagggagaacaaggaccagtttgacctcgtcatcagcgatgtccacatgccggacatggatggtttcaagctcctcgagcttgtcggtctggagatggacctcccagtcattatgttgtctgcaaatggggagacgcagacagtcatgaagggcataactcatggagcatgtgactacctgctaaagccggtgcgtcttgagcagctgaagacaatatggcaacatgtgattaggcggaataccaagaaccgtggtagtgacaatgatgatgccggtcagaaggggccaaatgctgaaggtgagaatggtggtgctaaccgcaacaagaggcagtcacggnagggatagagatgacaatggagatgatggtgacgattctgatgagaacagtaatgacaaacggcgactcgtcatcccagaagaagccaaagggttgtgtggtctgtggagctgcaccggaagtttgttgctgctgtc

SEQ ID NO: 941 - DNA, 3122 bp, Zea mays
aattcggcacgagggtttggtcgtgaacctgccgctgtggctgtgctgcatcccccaccctcgccgctccctcgtccaaatccaccagccgttcgctttcctctcctctcctctccatcatcccggccggctcgccagtcgccaccctccctttcctcttttcagctacagttgagcttgggcagtagtaggttggttctgcttcccttcccctcccccgatcccttttccttgctggggatcgggaggccttcaggcttcaacccatcttcctccctgtccacatctcgctccttgtttggggtagtgccggctggtggtgccgctactgctagccgggaacccaatttcttgataggactggacgactggtgcgtgccaaccacgagtttttcctgttcgctttgctttctcggctcagctactgctgctctgctaggaacaccaacagtagtgtgttcttgcgccggcttttcttgccgtgtttcgggtcgatattattgggagggtgggtctcccgtcccgtttcgatgaggccggaggagagagatgctgccgtggggagagtcagggaccagttccccgtcggcatgagggtcctcgccgtggacgacgaccccgtgtgcctcaaggtgcttgagaacctcctgcgccgctgccagtatcatgtgacaacgacgaatcaggctgttgtcgccttgagtatgctgaggcaaaacagggacctgtttgatcttgttattagtgatgttcacatgccagacatggatggctttaagcttctagagcttgtggggcttgaaatggacctccctgtcattatgttatcggtgaatggagagacaaaaactgtaatgaaggggataactcatggtgcctgtgactatctcttaaaaccggttcggctggaagagcttaggaatatctggcagcatgttgttaggaggagattcagtaactgtgattcgtgctaacaatgatggctattaggagtggcataaggccatcaaatccaggatttgatcttgctcacacccaattaacagctgggccacctgacccaaagtgggaggcccagcaaaaagaggaaggaatatcatagtgaagaggaagatgaaggagaagagagtaatggccaagataacgatgatccttcagctccaaagaaaccaagggttgtttggtcagttgaactgcaccgaaaatttgttgctgctgtcaatcagctaggaattgacaaagctgtgccaaaaaggatacttgagctcatgaatgttgagagactcaccagggaaaatgttgcaagtcacctgcagaagtatagactctaccttaaacggctaagtgctgtggcatcacaacaggctagcattgttgctgctttgggaggcaacgacccctttatgcggatgagtgcatttgaaggactccatggttatcaatcttttgtctcttcagcagctctgccatctttcagtccacagggactgttaaatagaaataatccagcatcatttgcgattcaaggggtgtctgcttccaggccaattcagattgcaaccggcaataccacaatgagtcattccattggcgatccaaataataaatatcaccttagcttaccaggcactagtagcctacaaggaaatctagcacaaggtttgccaactccagttgggcaggtccagctgccacagaagtggatacacgaagaaaccgacgatctatctactatcctttctgcgagtggccgggctaatagtggtgttcctggcacactccaaagtgtcacgaacagtcacttgctgcagcaaggctttgttgaacgtagacaagacaaagttgttatccagccatcttcatctgcaagttcagatcgtcctgaaggcactgttggagtttcctccagtctgatggattcctgtgcaacccagcagagggttgttccattgtctgccttctctagcagtgcatctccaatgaatggctcgttttgcagcaacggtgtagctgagttgggtgctacatcctctggaggtacaagtattttcccctccaatgacctgaggatagaaagagacagcaaagtgggagctagctcttttggtagtgtgatacttctgtctccagacactgtgccaaaccaaaaatacttgaacttcggcggtgaaagcgatttgagatcgaacatggatggagggaacgcaggcaatctgttgaatcccaagctactatggagttgtttgccggcctctcagccgcctaatcttatcggaagtcatcatcccatgagccaaagactgaaccttggcggctcaatggtcagacagacaacagcaagtgcttcggcagctgccccacagacaaggatcgacatgtttatctccggagacgctccgaagagcgcgtcggatttgagcttccctaaggtccacagcgagcttagctctagcagctgcagctttgacggcctcctcaactccataatcaaagtggagaaggacgatgcttccttcagcgatgacctgggatgcgacttgtactccctgggtgcctgtatatgatcgctaccttccacgtatctgcatctgcatctgtgttaatctcccattgtatgctgtgcagctagtgttaatcttaggtagaattgtagctgtgcgcctatctttgcttgcccacagccaagaaaaaaaaaattgatgtctgcacgtgatgtgctagcagtaagatatctggatttgtggaagtcaatgcccatttgctaaatcgagctggagacactgttggcacgagttgattctaaaagcggccttgatgatctaggcccaatttgaatgtcgacacactgaaagcctaaaccgccgtttgagtaatgacacgtggtgttcatgtaaacaaatccaaaagtttaaaacaaattgggagatttgaagtcgatgctcaggtgctgccgaacccaatgccaactcgacctgactgcctccgtctcgacctcgcttcccgcacgccatcaaaccctaaagccctcgtctcctcgagttgagtagtggaacttttgggttctcctggctctggtctttgtcgaatgtcgacgcactgactgttactgtatcggttgagct

SEQ ID NO: 942 - DNA, 1031 bp, Glycine max
aagattttgattggtttaggttagactccttttcagtgcaaaggatctttgtcatcagcagatgaagttcctagagtcttgaacattgttaaaagaagcaatattctcttcttgataagcagccaggggtcataataggctttactccaccaaaacttacttttatttcctcactagtgataagattaacaggtgaagggctaatagttgatacatgctccaccctttgctttttggttttatgctccaactggtgaccaggaagaaaactggccaccacaacctgcactggaccagcagctaccaacaaaccagcaagtccgccccccattactcgaccatctggaccagccaaagagacactcatcccaccagatctgcttcttgttactccattctcagttggcataaaggaaccagacaaggaaagaatctcaaaccgtccctcatacgttaaagtacccccacaagaagacggttgacgaagtgtaacatttgaaattgtcccagttgctgagagaatgcatatagcacgtgatccttgttgagagaaggacataatcttcatagtgacatcctcgccagcatttactgtgagcacgtgtggtgtgaaattggcaccaactgagtatgctattccctcacctggtcctgcacctccagcttcataaaacttaaaagacttcttgattgattcaagtggcttccctctgccccttttccaggctgagaagtctccggtcaacggaatcgacgccgatatcggcatcggcgacagcgccaccttgccgtccggtccatacttcctaggcctgcccctcttcttcttcccctccgtactacctgaattcatcaccggagcactcaccggtaccggtgccggtgccggtgccggtgccggtgctggtgctggcgccggtgtctccactgtgggcccggaaaaccgcgcggagtttagtcccacgtggaagctatggggggcctcgagaagattaacagcatgcccagaactaaaaatctctcctcgagcc

SEQ ID NO: 943 - protein, 170 aa, Oryza sativa
MEEAVDGKHPKRGRGRPRGRRGRGRGRGRGGRSLASPAAGPGDQGPRRRRGVVPAAAAAAGGRALRERRPAPGAYRESGADNDDDGGGDDEHDEQNDDGAEKSDNQVVDSLNEPNRSNTGKKRGRPKKVKAEQEDSNQLSNGKHLGENNGVITQPSVCSLSGFEHVLDHA

SEQ ID NO: 944 - DNA, 934 bp, Glycine max
  misc_feature (912)..(912): n is a, c, g, or t
gccatggacaactctcacctcctccaatataattcccaacaccaccacttccaccaacaacacccccttcttccaccatgcaccaccacacactcactccaccttctctactaattcctccaataatactagttcctaccccttccacctctcccaaattaccgaaacaccctcccaccatgatagagccctcgctgccatgaagaaccacaaggaggctgagaagagaaggagggagagaatcaactcccacctcgaccaccttcgcactcttctcccttgcaattccaagacagacaaggcttcgcttctggcgaaggttgtccagcgggtgaaggagttgaagcagcaaacctcggagattaccgagcttgaaaccgttccgtcggagaccgacgagatcacggtgctctccaccaccggaggcgactacgcctccggtggcggcgacggaaggctcatcttcaaggcctcgctgtgctgcgaggaccgctccgacctcatccccgacctcatagaaatcctcaattcgcttcacctcaaaaccctcaaagcagaaatggccactctcggaggaagaacacgcaacgttctcgtggtcgctgctgacaaagaacacagcattgaatccatccatttccttcagaactcgctcaggtccattctggaccgatccagttccggcgacaggtcgaaacgacgccgtggcttagaccgaagactgatgtcttgaaccggatactgtttccatagctacacatgcaaatgcatgccttactagtatcactcctaatattgttggttaattcgaaatggtttatgtgtttgcaggttttttgtaatgtaaaaagaaattaagacagatcatgagtttaaggactatgcattatcagttcaaatataaacattttngcactctcaactaatcataaaa

SEQ ID NO: 945 - DNA, 633 bp, Glycine max
gcataagcatcacttcacgttcatgaccacaaaaactgagactgtaccacactctttcagtcccccttaggtttccttcttattagcctccccccctcacacctaccctatcatcatgcaccactttgccatggacaactctcacctcctccaattccttcccaacaccaccaccaccaccaccaccaccaacacccccttcttccatgctgcacctcacactcacaccatgcaccaccccctctctactaattcctccaataatactaattactaccccttccacctctcccaaattaccgaaacaccctcccaccatgatagagcccttgctgccatgaagaaccacaaggaggctgagaagagaaggagggagagaatcaactcccacctcgaccaccttcgcactcttctcccttgtaattccaagacagacaaggcttcgcttctggcgaaggttgtccagcgggtgaaggagttgaagcagcaaacctcggagattaccgagcttgaaaccgttccgtcggagaccgacgagatcacggtgctctccaccaccggaggcgactacgcctccggtggcggcgacggaaggctcatcttcaaggcctcgctgtgctgcgaggaccgctc

SEQ ID NO: 946 - DNA, 725 bp, Oryza sativa
cggcacgaggtctcgccctcgccttcctcctcctcgccgttgatcgatcgatctcctgctcgatctcttgggccctagctacgatcaccaactagcttcaagcttcctctcccagcagctgcagcggcagctagccagcgatcgatcgatcgatcgagctacacgtgagatcgagtgcgtgcagtagtgtgtggtgtgcatgtttccggtggaggtggcggcggcggcggcggcggcggggaggatgcagggggaggcggtggtgccgatgatgctgccgcccttcttcatggactcggggatctggccggcggcggcgggggtcgtggatgtcgccgcgtcggcggaggaagaggcggcggcggcggcggcggcgcaggaccgcgcgctggcggcgtcgcgcaaccaccgcgaggccgagaagcgccgccgcgagcggatcaagtcgcacctcgaccgcctccgcgccgtcctcgcatgcgaccccaagatagacaaggcgtcgctgctggcgaaggcggtggagagggtgcgcgacctgaagcagcggatggcctggcatcggcgaggcggcgccggcgcacctgttcccgacggagcacgacgagatcgtggtgctcgcgtcgggcggcggcggcgtctgcggcgccggcggcgcggcggcggtgttcgaggcctccgtctgctgcgacgaacgctccgacctcctcccggagctcatcgag

SEQ ID NO: 947 - DNA, 1080 bp, Zea mays
cctccatagtataaaatgctcagatttttgaagtacttttcgaaagagtgtttttaaaaaccgctgtttggcaggctctggttttttttccggtgccaaagccctgaccctaatgcgactcaagaatcatctgccgcttgctctgaaagggactactcccgtatgccgtttctggggaagcaacccttgctaacgcctgcctgacagcctccttcagagacctgaggcttgcacctgcacttccccagccgtcctccatgcacagcacgaacacatgccgcgcccttcctcctaacgaggtcatgttggccctcaccgtcttcagcctcaggccatggaacgcctgggcgagcccggcgacgaggtccggccggtcggcgcagcttatcgaggcccttatgtagacggtcctgtcggcgccggcgtcgccggtgtggagctcgatggagacctcgtcggtctccgggggcaggggcgtgctctgggtggtggtggtggcggcctcgcttgctttcctcttcaggagcttcacttgctccaccactctggcaagcaaggtggccttgtccatctgcctggtatcaggaaccatcctcctgagcgtagccagatgagcgttgatcctctcccggcgccgccgctcggcctcgctgtggactttcagggccctcgcctccgtcgcactcctccccgaccccgacgacgacgacatgtccggcggcggcgctacccgcacggccggtggagcggcgctttcctgctgccggggcagaagaactggactacccccggccccgagcgctgaagggtcacggccatcgtatggctgcagctcctgcttcccttgcagaggttggcgcgcagccattgaaccaggcatcatcctcacctgcagtgcaggttcgtttcaaataaaagtggtgcaacaacgtcttgtcatctcattctctggaatgagtgatatgcatatgcttgtgtgcgagatgtgatcatcttcttatgatatgagtgatgacagacaggcgtactgcggtgtatagtgtgctcgttgatttttcccggccggctcgaggtaccaat

SEQ ID NO: 948 - DNA, 1117 bp, Glycine max
gccatttcaagagtacagcgatcctcggactggaattctcaatcttgctgtgaagttgccagcccacgtcctgaaacctgacatgggtccaaaaacatatattgcatatgggattaaagaagagcttggtagaggagactctgtaacaaagcttcattgtgatatgtcagatgcggtgaatattttgacccatacagctgaggtgatattaactgatgagcagcactttactatatcaaagttgaaagaagcacacagggcacaaaatgagagagaacagtgtgcccaagagagggttgctgaccacctggaggatcgaccttacaaagacaacaaagaacatatagaaaataaggaagttcttgaagccaaaagcatgaagaaacaacctattgaaattgatggaaacatctttccaaataatgtgcttgagaggttgtacatccaattcatgaccaatgtttttatttgacatgggaacataagaagaagctgaaggaggagcttggtgtagagccatggacttttgaacagaaacttggggaggcagtatttattcctgctggatgtccacatcaagtcaggaatctcaagtcatgcacaaaagttgctgtagactttgtgtccccagaaaatatccatgagtgtctgcgtttaactaaagagttccgccagcttcccaagaaccccaaggctagagaagataagctggagataaagaagatgatagtttatgccgttgatcaagctgtcaaagacttaaaagatttactgaagtgttcttgattggcttgcagaaagctcattttgccgtggttgatgatacactagatttctgtgaatataaacagtgtccagatagaaaattgtgaagtctgaatgtttattgtaggattagagtccggatagaaaattgtgaagtaggaatctttattggaagatcagaggcactcataattgagtgttttccattttggtattaacatagtgatttaattgttaatacttacattttagacaacagtttcagaaagttctgtaaacagataacggccccaagaattaatgaaaatattgtattcatggcccaaggaaaaaaaaaaaaaaaaaaaacacc

SEQ ID NO: 949 - DNA, 1284 bp, Glycine max
  misc_feature (497)..(498): n is a, c, g, or t
  misc_feature (500)..(500): n is a, c, g, or t
  misc_feature (504)..(509): n is a, c, g, or t
  misc_feature (584)..(586): n is a, c, g, or t
tttggtccaaaaacatatattgcatatgggattaaagaagagcttggttgaggagactctgtaacaaagcttcattgtgatatgtcagatgcggtgaatattttgacccatacagctgaggtgatattaactgatgagcagcactttactatatcaaagttgaaagaagcacacagggcacaaaatgagagagaacagtgtgcccaagagagggttgctgaccacctggaggatcgaccttacaaagacaacaaagaacatatagaaaataaggaagttcttgaagccaaaagcatgaagaaacaacctattgaaattgatggaaacatctttccaaataatgtgcttgagaggtacacttctcctgctacagagaatgaatcaatggaaactggtagtgccctatgggatatctttcagagagaggattctgaaaagttagaaacatatcttaaaaaacactcaaaagaatttaggcatacttactgttctccagnngnacannnnnnacatccaattcatgaccaatgtttttatttgacattggtgcgttagttgtgcctgtcggggctgtttggtgtagnnncatggacttttgaacagaaacttggggaggcagtatttattcctgctggatgcccgcatcaagtcaggaatctcaagtcatgcataaaagttgctgtagactttgtgtccccagaaaatatccgtgagtgtctacgtttaactaatgagttccgccagcttcccaagaaccacaaggctagagaagataagcttgagataaagaagatgatagtttatgccgttgatcaagctgtcaaagacttgaaagatttactgaagtgttcttgactggtttgcagaaagctacttcattttgccatggtcgatgatactctagattgctgtgaatataataacaatgtccagatagaaattgtgaagttagaatgtttattggagggttagagtccagatagaaaattgtgaagtaagaatctttattgaaagatcagaggcactcacaatcgagtgttttccattttggtaataacatagtgaaaatgttgtaatggccacaagaattaaaaaaatagttaatggaaatgttgtattcatggcctaagaaaatacaaagactgccattttttttccttggaaagatacaagattgaagataaagcttatgaaagagttcaagacacgtgtattttttttattttaacctttcagtaatttagggaaaaaagactctgagttcagttagaaaggaagtaaagt

SEQ ID NO: 950 - DNA, 465 bp, Glycine max
ttcggcacgaggtacacttctcctgctacagagaatgaatcaatggaaactggtagtgccctatgggatatctttcagagagaggattctgaaaagttagaaacatatcttagaaaacactcaaaagaatttagacatacttactgttctccagttgaacaggttgtacatccaattcatgaccaatgtttttatttgacatgggaacataagaagaagctgaaggaggagcttggtgtagagccatggacttttgaacagaaacttggggaggcagtatttattcctgctggatgtccacatcaagtcaggaatctcaagtcatgcacaaaagttgctgtagactttgtgtccccagaaaatatccatgagtgtctgcgtttaacttaagagttccgccagcttcccaagaaccacaaggctagagaagataagctggagataaagaagatgatagtttatgcc

SEQ ID NO: 951 - DNA, 1139 bp, Glycine max
ggctcgaggaagctaaattactaggaaaatctgctcctcttgactttgttcatgacaaattcaagaggagcagattgaagctaaattactaggaaaatcttcttttgagattgagatgcaccaaagtctttgtggcgatggtgaacgtgtctattgtgaccattgtgctacttcaattattgaccttcatagaagctgccccaactgttcctatgaactctgccttagttgttgccaagaaatacgtgatggaagcattacaccccgggctgagctgaagttcccatatgtaaataggggctatgattatatgcatggtggggaccctctacctgtgccttgtgatttagagacatcagaaggtcatattgagccgtctactgtgtggaatgctaagagtgatggaagcattagttgtgcgccaaaggagttggggggttgcggtagtgctgtattggagctgagacgcatcctcccagatgggtggatatctgacttggaagccaaagctcgcaatatgctgaaaatttgggaaattgagcacacaactcttcagcaaaaagaagcagtatcaagcttcacctttttgagaaaggaagctattagagaaggcataaatgacaataacatatactatccagagtcaagtaacactcaaaaagaagggctgctgcttttccaaaagcattgggctaatggtgaaccaattatagtccgtgatgtccttaaacagggaacaggtctgagctgggagccaatggtaatgtggcgagcattatgtgaaaatatggtttcagaaatcagttcaaaaatgtcagaagtgaaagccatcgattgcctagctaattgtgaggtttggtctcgctgtccctttggtgctgagtttgaacatttggtctaattagagtattatgtctctaaatttgtagtgttttcccttttccaaatccctcatctgttgtggattggctgtgatctctaatttttttaaggatgcaaaaagaatgctttagtaactacttttctgcccagtatcattataagaaagataactaacttttggtataaggcatgtcatcttgactacactactgtaatataccacatccatcgccaacatgccttattgtgctttagat

SEQ ID NO: 952 - DNA, 994 bp, Glycine max
attcgtaaacaacgtgagttcattaatctcaattttggagttattttttgagcttccgaatgtatagattatgagatcctaagtatcaaatggtgacaattatatatttatatgtacaccgttcaagtcatatatgatttccaaaaaaaaaaaaccatccaggtgttggcgaaaacaaaatatggaaccgttcttacagtcacgatatacagaacccatcatcacacctgtataaaagcttgactaaaaaaatttacactttcaattggctttgatctgttaaagatatatctactttggaactatggtttgcctggaccttgctttctctaattttgttatcacttcttgcatagcatatattgtcatcttcttcacctccaatttgtcctcagtagacctgtggtttattggaagtgtgcgaaactcctccgtcaaacgaaagcactccccaacattttcaggagagacaaaatccaaagcaaccttaatacatgacttcagatttctgacttggtgaggacaaccagctggaatgaaaacagcatctcctaacttctgagtaaaagtccagggctcaattccatactcctccttaagcttcttcttatgctccatagtcagatagaaggtctggtcatggatggggtgaataacctgctttaaaggacagcaatgaatatgcctaaactctctgaagtgcttcttcagatattcctgcaatttaggtacatcctgtctccgaaaaatatcccagagagcaccttctgaagcatcccccctaaacaaatcactttcttgtataatttttactttgtcaatctctttcagatctgatccgcacgaaagaccatcctcattagcaacgacaacctcaataccaccagagggttgataaaactgatcaacttctttcccatcacataagttacctccattttccatgacttgtacacaattttgcttgcccttctgtcgtcttctcgcagccgta

SEQ ID NO: 953 - DNA, 537 bp, Oryza sativa
aggaggaccatggaatgaccctggacattgtcacaaaacttggggagcagtattcattcctgctgggtgtcctcatcaagtacggaatcttaagtcctgcaccaagattcccttggattttgtatcacccgagaatgttaaggagtgtctcagcttaaccgaggacttccgaagacttcctaagaaccacagggccaaagaagacaaattagagttgaagataaaggttccagaaggagaagacgtttggcttataccccagttgagctgcctgtgggagtggagctgaagccatcgctagatcgttattccgctgctgttttcttttcttttgtaagtatgtaacgttatttttaagatggatttgtatattaaattgtcagtttgtgtacctcggctgatttctggacgaggattttatgcacaattagttcggaatttactagtgaatttccgggcgtgacagtggcgctgtcggcgtttattggtttttttataataaattatgggtgtggcttttaaaaaaaaaaaaaaaaa

SEQ ID NO: 954 - DNA, 455 bp, Oryza sativa
aaatttgaatgtggatatgggggaacaatcacctgaccatgtaagctcaaagtttgatgaaagagcgcatgcgtctgccttgcgattacaagagaagtcttcagatgccaaacttaattgtggtttcgaaggctcttcaactgagttatcttgctcgtcacattcagaggaaccaaaagttaatggttcagaaagaagtcaggctggttctgtttgggatgtgttccgcaggcaggatatttcaaagctgaatgaatatttaactgctaactgggaagaactggcagctagtagtcaggttaagaatcctatttatgaacaatctatatatctcaacaagtatcataaaaggatactgaaggatcaatatggaattgaaccctggacattccaacaacatatcggtgaggctgtatttgttcctgctggctgcccattccaagtgaaaaatctcc

SEQ ID NO: 955 - DNA, 1738 bp, Oryza sativa
gggctgcaggaattcggcacgaggggattgccttgattggaatgaggtggaaattaacatacacatgttctttatggggtatatgagaggtagaagacatccgatgaccttttggcctgagatgcttaagctaaaagattggccaccatctagtatgtttgaccagaggttacctcgccatggtgctgagtttataactgcattgccatttcccgagtatactgatccacgatatggcccgctaaatcttgctgtcaggcttcctgctggtgtactgaagcctgatcttgggccaaaaacttatattgcttatggatgttatgaagagttaggcaggggtgactctgtgaccaagcttcattgcgacatgtctgctccgggaaatatcttgatgcacacagctgaagtgtcctatgacactgaacagcttgacaagatagcaaaaattaaaatgaaaatgagagaacaagatcttcatgaactgtttggggtttcagaatcaggcgccaagggtaaagctgatgatgaagcatcgaaaatctcatgtaacatggaaaacaaacacacctctaaccaaagtactaagggtttggacattaatgctttaccacctgatgattctggaagtgatattggggataaaccatcattttgtcaatctgaggtagaaagtgaattaacacaatgttcaaaacacaatcacgaggttaatagttctgtcaagatgcatgctggagctcattgtacttcagacaaccaaggatacattgacaggagtggattcaaacgcaaagattcagactgttcagaccaacagaaaactggtggcgctttgtgggatattttccgaagagaagattctgagaagttacaagattatcttcggaagcatgcctcagaatttcggcacatacactgcaatccagtgaaaaatgtttctcacccaattcatgaccagactttctatttaactgtggagcataagagaaagctcaaggaagaacacggtgttgaaccatggacattcgagcagaagctaggcgatgcagttttcattcctgctggatgtccacaccaagtgagaaatttaaagtcttgcatcaaggttgctctagactttgtttcccctgaaaatgttggtgagtgtgttaagctgaccggagagtttagacgtcttccatctgatcacagggctaaagaagataaactagagattaagaagattgctctcaatgctcttaaagaagtcgtaaatttcttagatcctttaccaaaagggtcaaagaacagggatgaagtggtagaagtgaccaaaccaaaaaggaaatacggtaaccgaaaaggtgacctgaagagtggggaagaccaacccattgatgaatccatagaagaaaggaagcctaaaaagcgagggagatctaaacggtgatctgaagattgaagatcctgtccaacaatgaaccagtagatgactagatgagaagcctaaaaaacaattaatgctcttttgattattcagaggcccaaatgattgggctgatatcgctctgggatagacttaagtttcgacagttcaagaatcacctcagacatcaccatggtgtcgattttgttcatatgtggggtgattgccttcactaaaatgatgtgattgtttgttgctgatagtggcaattgacttggaatagctttgatgaagttatggctcattctgatgcttgtcaaaaaaaaaaagctt

SEQ ID NO: 956 - protein, 917 aa, Oryza sativa
MAAEEVEAAAIDGSGEEAKRKSGKQRGSGAKGRRRNGDRAFRPPAMRPEEEGRGVATRPGALRERKPPPNAFNAPDDDEDVEKTDQLLEPLNKPKRRDAGKKRGPRKKKVDQENIKTHRHNANAVKGKMLVNDKVSKTEKKQREENVDRYPDLPENEFAAKCPYCRKNCNCKACLRMRGVEEPPRKEISKENQIRYACHVLRLLRPWLIELRQEQMAEKELEAKIQGVSVDQIKVEQAELRKGEIPGGEEVEILDPEERDKDYAFGKILSDGENQRDSLKCRSDTQNSESNKGMASDENQKKALLLWKANSNGSIPCPRKEKEDCSFSSLDLKCLFPEKLLPELEDRSEKVFWSETFAKELGRTSELCPCFDHSGKIRSDSKKLRQAANREDSSDNYLYCPVATDIQDADLLHFQMHWAKGEPVVVSDTLKLTSGLSWEPMVMWRAVRERTKGKAEDEQFAVRAVDCLDWCEVEINIHMFFMGYTRGRTHPRTYWPEMLKLKDWPPSSSFDQRLPRHGAEFISALPFPEYTDPRYGPLNLAVKLPGGVLKPDLGPKTYIAYGFSEELGRGDSVTKLHCDMSDAVNILTHTAEVPCETYDAVQIKNTQKKMKMQDDMEIYGMIESGSELKPSACPVELGNKAVGEAPKASCSKENVHTLKDKSNGWWRKYTFGLDINASPPDDAGGDARDEALSYESVVHSDVAQCPNHNHETNNSDDARIGAQRCQKKAKGRPPKTGSGVSEHQESGGALWDIFRREDSEKLQDFLRKHAPEFRHIHCNPVKQVIHPIHDQAFYLTAEHKRKLKEEYGVEPWTFEQKLGEAVLIPAGCPHQVRNLKSCIKVALDFVSPENVGECVRLTKEFRRLPSSHRAKEDKLEIKKMAFHALNEVLNFLDPPSSEGSKEAAEKPRRGRGRPRKH

SEQ ID NO: 957 - protein, 552 aa, Oryza sativa
MAAEKVEEVAIDGSGEEAKRKSGKQRGSGAKGRRRNGDRAFRPPAMRPEEEGRGVATRPGALRERKPPPNAFNAPDDDEDVEKTDQLLEPLNKPKRRDAGKKRGPRKKKVDQENIKTHRHNANAVKGKMLVNDKVSKTEKKQREENVDRYPDLPENEFAAKCPYCRKNCNCKACLRMRGVEEPPRKEISKENQIRYACHVLRLLRPWLIELRQEQMAEKELEAKIQGVSVDQIKVEQAELRKGEIPGGEEVEILDPEERDKDYAFGKILSDGENQRDSLKCRSDTQNSESNKGMASDENQKKALLLWKANSNGSIPCPRKEKEDCSFSSLDLKCLFPEKLLPELEDRSEKVFWSETFAKELGRTSELCPCFDHSGKIRSDSKKLRQAANREDSSDNYLYCPVATDIQDADLLHFQMHWAKGEPVVVSDTLKLTSGLSWEPMVMWRAVRERTKGKAEDEQFAVRAVDCLDWCEVEINIHMFFMGYTRGRTHPRTYWPEMLKLKDWPPSSSFDQRLPRHGAEFISALPFPEYTDPRYGPLNLAVKLEYSIVSPK

SEQ ID NO: 958 - protein, 997 aa, Oryza sativa
MPPKRKRGGGRPRKAPEDAAAKENGEKTNKEEETQASPEENGAGQTQASRTARKRRKGPVADPSSTELPPRKLRDRRNVPAVDYKENKHTKKMDGTSTMCHQCQRKDSGRVVRCRNGAEKNRRHRYCVKCIKRWYPHLTEDDFENCCPVCHNNCNCKTCLRTNVINKGDKEFADGKNKIKYSLRIARFLLPWLKQLHQEQMLEKSVEATIKGIDVTDLEVPQAQFNNDERIYCDNCRTSIVDFHRSCKSGHYDLCLSCCQELRQGLTTGTVVTCDTAVDVPEIEGKEGLQEGSSHSSAVGQGASDQQNDRLIGSAAPSEDCTPSLIWRAKSNGSIPCPPNAGGCGDCLLELRCLFKENFISDLLDKVNSVVNKETEQELGGSRCSCFTESGEVNNETSRKSACREDSNDNYIYCPTAREVQSGALDHFQQHWLNGQPVIVRDVLELTSGLSWEPMVMWRALREKRDKKEHERLSVIALDCLTWFEFMYHQDVLVVPVSYLGFNSTIETTLYFKLVDINIHMFFEGYSRGAVGSEDLPVLLKLKDWPQHSSFEERLPRHGAEFMSALPFREYTDPKSGPLNLAVKLPKHVKKPDLGPKTYIAYGVAQELGIGDSVTKIHCDMSDAVNILMHTDEVELKAERITAIEKKKESLRKDGKNLHVLRPDHDDDTSIALSESTEVPRSRGLENGSSIKQPAPNVAVMDQGGVHTDMVADEAEGNLSLSNGQSPNQSDAHNMDITFSKGETDHSICTINGGEEMGNGFGREDKCKSSHGVGSSESSDCQRRSRRRDACSSSATGEINETSMETNKFTISIEPKDDHPFVEGNQTEGGALWDIFRREDVSKLHDYLMKHAEEFRHYNYETVKQVSHPIHDQCFYLTNEHKRKLKEEHGIEPWTFEQKLGEAVFIPAGCPHQVRNLKSCIKVALDFVSPENVQECIRLTEEFRLLPKGHRVNEDKLEVKKIALYALDQAIDDITGKSCNERTKDEGEEEASAPSVS

SEQ ID NO: 959 - protein, 860 aa, Oryza sativa
MGLSDYDLMGVAVPGTGVGGPHPEALKERMLCNLWEVYTLAQRNRKFNELLNDEAIMMKPSKESKKRGAGKKQEEEENNTISIEDEMCDANNKKGKKMLTGENALMCHQCQRNDKGRVIWCKSCNNKRFCEPCMKRWYPGLSEVDFAAKCPYCRKNCNCKACLRMIGVEKPPEKKISEENQRRYAFRIVDLLLPWLKELQQEQMKEKELEGRLQGVSMDEVKLEQADCDMDERVYCDRCKTSIVDFHRSCKACSYDLCLACCWELRKGEIPGGEEAKSVQWEERGQKYVFGNISKDEKKRVSSKRHMETPSTETCNDMAVAGDPNNPLLLWKANSDGSIPCPPKEIGGCGASSLVLRCLLPEIMLSELEHRANKVIKREAFDKAINETSDQCPCFYHTSKIRTNATREAANRKGSSDNYLYCPDANNIQEDDLSHFQMHWSKGEPVIVSDALRLTSGLSWEPLVMWRALREKKTNGDVEDEHFAVKAVDCLDWNEVEINIHMFFMGYMRGRRHPMTFWPEMLKLKDWPPSSMFDQRLPRHGAEFITALPFPEYTDPRYGPLNLAVRLPAGVLKPDLGPKTYIAYGCYEELGRGDSVTKLHCDMSDAVNILMHTAEVSYDTEQLDKIAKIKMKMREQDLHELFGVSESGAKGKADDEASKISCNMENKHTSNQSTKGLDINALPPDDSGSDIGDKPSFCQSEVSHPIHDQTFYLTVEHKRKLKEEHGVEPWTFEQKLGDAVFIPAGCPHQSCIKVALDFVSPENVGECVKLTGEFRRLPSDHRAKEDKLEIKKIALNALKEVVNFLDPLPKGSKNRDEVVEVTKPKRKYGNRRGDLKSGEDQPIDESIEERKPKKRGRSKR

SEQ ID NO: 960 - DNA, 122 bp, Oryza sativa
cccgggctgaggattcggacgaggattcattttcgtaaacactggataaaaggagaacctgtagttatcaggaatgcgtttgagccttctctgtcatcaagctgggacccactaaatatttt

SEQ ID NO: 961 - DNA, 670 bp, Zea mays
  misc_feature (580)..(580): n is a, c, g, or t
  misc_feature (632)..(632): n is a, c, g, or t
  misc_feature (651)..(651): n is a, c, g, or t
  misc_feature (662)..(662): n is a, c, g, or t
tcaaatttgaaatctggtttactaaatgtctctgcattgcttcctggtgacgtcttaaagcttgacatgggcccaaaatatatatagcttatggctatgcagaggaactcattagaggagattctgttacaaagcttcattgtgatttgtctgatgcagttaatgttttaatgcatactgccaaagttgtgccttctgaagaacaaaaagaggggataagagatttgaaaataaggcatgcagaacaagataaaaaggaatgcttggggaattcatcaatagatggaaataaaacaagcatggagcatgctcatatatcatcagtttcctgcgaggatggtggaggtgcactatgggatatttttaggagggaggatgttggaaagctgaaagagtacctcacaaaacattccaaagaatttcgccatatgtactgttgtccagttgaaaagatatttaaccctgtacatgatgaaacattttatctgaccaacaaacacaagagaaagctcaaggaggagtatggaatcgagccatggacctttgtgcaaagacttggagatgcggttttcatacctgnctgggtgtcctcatcaagtacggaatctaaagtcttgcaccaagatagctcntggattttgtatcaccagnaaacattcagncatgtcta

SEQ ID NO: 962 - DNA, 1000 bp, Zea mays
atagataacaggggcaaggccttttggaaacgaagccacattttgtagatttacagtatgacatctatttttttcagcatgcccagcttttcagtgttgctctccttcagcaaaatctaccattttaggcctttttcgattgtatagggatctcatcaaatctctttctattcagttaaaataaaaaaaaattaatctcctccaatcccttcctaaccgagcccttattagtaatatttccaagattattatttgtgccgacaagcaaagcaactagcgctaccccacgtctactgtcgcacaacatcgcatcatgttctctagtttccctcgttgactagcagaaacccagatatgatgccagcttgttcaggcggactcgcggggtgtgcaaggctctttcagaatcgccaaagcatgctcaacggcatagacgatcatcttcttcacctctagtttatcttcttttgccctgtggcccactggaagtctccggaaatcctcggttaagctgagacattgctgaatgttctctggtgatacaaaatccagagctatcttggtgcaagactttagattccgtacttgatgaggacacccagcaggtatgaaaaccgcatctccaagtctttgcacaaaggtccatggctcgattccatactcctccttgagctttctcttgtgcccacgcgtccgcggacgcgtgggcgcacgcgcggggttaaatatcttttcaactggacaacagtacatatggcgaaattctttggactgttttgtgaggtactcgtgcagctttccaacatcctccctcctaaaaatgatcccatagtgcacctccaccatcctcgcaggaaactgatgatatatgagcatgctccatgcttgttttatttccatctattgatgaattccccaagcattccttttgagcgtgttctgcatgccttatttgcaaagctcttatcccctctttttgttcttcagaaggcctcgagcc

SEQ ID NO: 963 - DNA, 1620 bp, Zea mays
gcggccgcccttttttttttttttttttttttttttttttttcgcgttctgttttgctaagagtatgcctcgtagagtttcatacacacgtttgcaccatttctcagaaacttgtttgcaccatttctcacacaccgacacctcgcagtggagtcctaaaaagaagagacggaaccctcactcagaatggcctgaccggtacaaacaaagacgtttaagttcgcatatggttcacatacacacatccattacacaggacaagaaaataagcatatgagaatcacactcagccttcttctgtttcttttactcctcgtgctcatccataaccgaagaaaacgcagtggaaattgactcaaggctgatccgagccactccctgacctacacatgcatacatgcgctctttctccatttccatatccttttcctctatttgaacaagttggtgaatgtcagtgccaaatgttcaatcggacctcttccaatactcaatcttcttcagtgtcaaatccgacatcttggagaaaaccctacacctttgttcaccagcacatcaatattttgtgagccctgctccaagtgtaaccatttggcttcattctttagaacctcccaacaatgagaaacggtgaatggcctacattgctattagatgattcatcagtgatatctttaatagcttgattgaatgcatgaagagctatcttcttaacctcgagtttatcttcattcaccttatgccacttcggcagcagacggaaaccttctgttaacctgatgcactctcggacattttccggagaaacaaaatctagtgcaacctttatgcaagacttcaaatttctaacctggtggggacatcctgccgggataaatactgcctcacctagcttctgttcaaatgtccaaggctcgactccatattcttccttaagctttctcttgtgctcaattgttagataaaaacactgatcatgtataggatgagtaacctgcttcactggctcaaagttgcaatgtctaaactcatcagcatgcttcattagataatcatgcagtttgctcacatcttcccgtcgaaaaatatcccacagtgcaccaccctctgcttggtttccatctataaatggggcatcatcatcatcttctgactcgggagccacagcaattagtccagacgcattcccctcttctatttttttagtcctgtttcctctaccattagaactacggccacgctgcttactgcaacccttagtggtaggctgagtcaatgttctttctgctaaaccactaggagattctattttatctccactgttggtaccattaattgtgccaaaagaatcttctgattttcccttaccaaaagaaacattcataacatttgcatctgccttggcatcatcttgaactccttcctgctcctcggaagcaacatgctgtactggttgtttaatgcccagttcatttacacactcttcaggccttggctccttgttagattcactgggagctgttggcataccaacataatctgcacaccgttgaaggcctccacttgcttccttggtagatacggacgcgtgggcggacgcgtgggtcgacccgggaattc

SEQ ID NO: 964 - DNA, 2613 bp, Zea mays
tagataaactcaagagagcatacaaaaaagtttgaaagaaaaatccaactcaaaaagtgagtgcaacaagtgagtttacagtagcatcggatgtgtcccattcttcactagacacaatactagataagagtatgcctcgtagagtttcatacacacgtttgcaccatttctcacacaccgacacctcgcagtggagtcctaaaaagaagagacggaaccctcactcagaatggcctgaccggtacaaacaaagacgtttaagttcgcatatggttcacatacacacatccattacacaggacaagaaaataagcatatgagaatcacactcagccttcttctgtttcttttactcctcgtgctcatccataaccgaagaaaacgcagtggaaattgactcaaggctgatccgagccactccctgacctacacatgcatacatgcgctctttctccatttccatattcttttcctctatttgaacaagttggtgaatgtcagtgccaaatgttcaatcggacctcttccaatactcaatcttcttcagtgtcaaatccgacatcttggagaaaaccctacacctttgttcaccagcacatcaatattttgtgagccctgctccaagtgtaaccatttggcttcattctttagaacctcccaacaatgagaaacggtgaatggccttttctccaagctacgtattatataaggtactaatatcatgcataatacactaaaatcaggttttgttatcttgtcggcatccgataagccactacggttttcattcaggttctcgatagcaagatgtcgaatgcgggttgtgctaacttccatgacatcaagcatggattcaatggccttcatgatcctcactatctccggatccatttgctttcattgctattagatgattcatcagtgatatctttaatagcttgattgaatgcatgaagagctatcttcttaacctccagtttatcttcattcaccttatgccacttcggcagcagacggaaaccttctgttaacctgatgcactctcggacattttccggagaaacaaaatctagtgcaacctttatgcaagacttcaaatttctaacctggtggggacatcctgccgggataaatactgcctcacctagcttctgttcaaatgtccaaggctcgactccatattcttccttaagctttctcttgtgctcaattgttagataaaaacactgatcatgtataggatgagtaacctgcttcactggctcaaagttgcaatgtctaaactcatcagcatgcttcattagataatcatgcagtttgctcacatcttcccgtcgaaaaatatcccacagtgcaccaccctctgcttggtttccatctataaatggggcatcatcatcatcttctgactcgggagccacagcaattagtccagacgcattcccctcttctatttttttagtcctgtttcctctaccattagaactacggccacgctgcttactgcaacccttagtggtaggctgagtcaatgttctttctgctaaaccactaggagattctattttatctccactgttggtaccattaattgtgccaaaagaatcttctgattttcccttaccaaaagaaacattcataacatttgcatctgccttggcatcatcttgaactccttcctgctcctcggaagcaacatgctgtactggttgtttaatgcccagttcatttacacactcttcaggccttggctccttgttagattcactgggagctgttggcataccaacataatccgcacgccggggaaggcctccacttgcttccttggtagatagaatcttcattcctaaacaccgcttcttcttttccaccgcggcaatcctttttgctttgagttttatttcatcagtatgtgtgaggatattgaccaagggtgcagccaaatgagcgaggtcttttgccccagctacttccccccttcttctttcctcatcagcagctctgagacttaaggacatacttggattgcagccatcaaaaatgcatttatttcgatgattccataaagtccaagctcccaaaatgatgagagagttaaggcccttttttgtgagaccaaggactgcttcctcccaccacttcccaccatcccaggaaggagtttgcagtcggctgtggtgcgagagagtgaagaccgaatttcctgagtaaaaggtaccagaattctcgtgagaaggaacattgcacaaggaggtgatccatattttcttcctcttgatcacatagaagacatttctctggatgatttaggcctcgctttgccaatctatcagctgtccagcatctcttatgggcaaccaatcaaaggaagaaacgacattttggcaatgcccaagacttccagattcttttatagtgtccaaatgtcacagatcccagaaacagaccttcatatgctcatttggctgagtacacaccattcggggcaatactgaagatatgcttgtcgtcaacctccggctgcagctcgatgccagatatcaaatcccaaagctgaaggtaatatgtcaaaacccccactgacaaagctcctctgatatcagaaatcca

SEQ ID NO: 965 - DNA, 2134 bp, Zea mays
ccacgcgtccgctgaaagcaaatcagtaagggaggctgcaagcaggaagggctcaagcgataacttcctatactgtccagttgctactggtattcaagatgatgacatagtgcattttcagatgcattgggcaaagggtgagccagttgttgtttctgatgtccttcagttaacctctggtctgagttgggagccaatggtaatgtggcgggcattgcgggaaagatccaaaggcaaagcagaagatgagcaatttgctgtttgggcgatagactgccttgattggtgtgaggtggaaattaacatacataggttcttttcgggatatacaacaggcagaactcatgctaggactcactggcctcagatgcttaagctaaaagactggcctccttctagttcctttgacaagcgattgccgcggcatggtgccgaatttattagcgcattgccatttcgtgagtatactgatccacggtatggcccgctaaatcttgcagccaagcttcctgctggtgtcttgaagccagatcttggacccaaaagttacattgcttatgggttctacaaagaattgggcaggggcgattctgtgaccaagcttcactgtgacatgtctgatgcagtaaatatcttaacacacacagctgaagtcacttgtcagactgatattggcttaattgaaaaaatccaaaaagacatgagagagcaagatctgcaggaactatatgggggtctaaattcccgctctgagctcaagttgtcaccagctccaactgaatgcagggatgaatctgttgatgaaggattgaagacctcatatagtagagaaggcaattgtgtaaatagagacaattataatggtttggacatcaatgcattaccacctgatgacgatggagatattgcaaaggataaagaatcatctcctggatcagagtggcaaagtgaactaggtcagagttcagatcacaacaatggggtcaacacaactgatgagatgtacaatggagctcattacatttcacacaatcaaaaaagcactggcaggaaagttggcattaaacctcaagaagagaaatctgaaaaggctgattgcagtggcacatgtgcttatctaaaaggaagttctgaagataatccggaaatgcctattgtggagagctcagaggagcagagcaccggtggtgctctatgggatatcttccgcagacaggattctgataaattgcaagattatcttaggaagcattgctctgaattccggcatatttactgcaatccagtcaaaaaggtatttcacccaattcatgatcagtccttttacttaactgaggagcataagagaaagctcaaggaagaatatggtattgaaccctggacgtttgaacagaagcttggtgaagctgttttcattcctgctggatgtcctcaccaagtgagaaatttgaagtcctgcatcaaagttgcgcttgattttgtttccccagaaaatgttggtgagtgtgttaagctgacggaggagtttagacgacttccatctttccacaaggctaaagaagacaaactagagatcaagaagatggctgttcatgccctgaacgaagctgtaaacttcctggatcctcgttcctcagaagagttgaaaattggggttggtgagaacatctgtgaggatgaatctgtagatgagaaggagctgccgcctagaagaggagttgaagtgtcaggcgttgatgagaagcctaaatagaaggcgagggaggcatcaagtccaaaagtgaagctgctgatgaggtcgcccattttaggttctcggaatcgtggttaattgatttgtcaaagcccctgttcatgtatggtgatcgctggctgacaccgatggatgaagagaagcaggacacgtgtgtgctgctgatatgtcgtgtcggcgagtgacatgaatagcatccctatccctatggtattattggtcttttatgtttatgtttgatcatttgtcttattcagttttttttacaaataataaaacaagaggttaaaagtaaatgacgtcatttatttaattttaagacggggcagatgcaaaactgaaggtagccaaaaaaaaaaaaaaaaaaaaaaaaaaaaaaag

SEQ ID NO: 966 - DNA, 1155 bp, Zea mays
cgggaaggactggccgccatctagttcttttgatcagagattgcctcgccatcctcccgtccgtatcagtgcattgccatttcctgagtacactgatcctcgatatggtccgctgaatcttacagtcaagctacctgatggtgcattgaagccagatcttggaccaaaaacttacatcgcttatggattttaccaagagttaggcaggggtgattctgtgaccaagcttcactgtgacatgtctgatgcggtaaatatattgacacacacagcacaagtgccctatgcgcgttatcaacttgagaagatagaggaaaccagaaagaaaatgaaagaacaagatcttcaggaactttatggtgtttcagaactaaacctatcatcaccttttactgattccaggaatataagtgctgatgaaatgtcaaagacctcatgtttggacgtcaatgatgtaccacctgttaatactgaatctgaggtacaaagtggggcaggccagtgttcagattacattgacaaggatagaagttatgctgggatgcataacggggagagaaccggtggtgccttatgggatattttccgaagagaagattctgacaagatacaagattatcttaggaaacatgccacggaattccggcacatcttttgcaatcctgtgaagcaggttattcacccaattcacgatcagactttctacttaaccgaggagcataagagaaagctcaaggaagaatatggtgttgaaccctggacgtttgagcagaagcttggtgaagcggttttcattcctgctggatgtcctcaccaagtgaggaacttgaagtcttgcattaaggttgcgatggactttgtctccccagaaagcgtcaacgagtgcatgaaactgactggagagtttaggcggcttccacctgatcacagggctaaagaggataagctggagatcaagaagattgctcttcatgctctgaaccaagtagtaaatttcttggatccttcctcggagtggtcgaagagttggtttgcccaacccaagaacaaaaaaaaggctggagctgaagaacaggagaagcctaaaaggaagcgtggccgcccatgtcgcaagtccaacgatgaagctgctggcgataggcacagaaagaagaa

SEQ ID NO: 967 - DNA, 940 bp, Zea mays
gctgcaagtactgcttttatgatctgtgccttgactgctgtgtggagatccgcagaggtgagattcctggaggagaagagataatgagagtaaagcctgaagatagaggccgagcatatctttttggtactactaactcaaaggatgggagtaaaaggttctccaccacgcggcccagctcatccctggagaatgagccttccaatgtagtaggttctagtgagggggcaaataactctctggagctgtggaaagcagaaagtgatggtagcataccttgcccaccaaaggagctaggaggctgtggcggttcgattttggatctcaagtgtttttttccagaaaagatgctttcaaatttagaagaacgagctgacagaattatgaggagcgaagtatttgcaaaagcagtagccaaaagaagtgaccagtgcccttgttatgaccattcaggaaacataagaactcaggacgtgcgagagactgcaaatacgaaaggctcaagtgataaccatctctactgcccagttgccactgctatcaaggaggatgacttggcgcactttcagatgcactggacaaaaggcgaaccagttattgtttctgatgttctgcatttgacttctggtctaagttgggaaccattagttatgtggcgggcattgcgagagaaaaagactaatggtgacgtagaagatgagcactttgctgtcagggcattagattgccttgattggtgtgaggtcaggagttatatttcattgaatgtttgagtgcattctgtgaccttttatatttatgtatatatttaaatgtttccgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 968 - DNA, 1235 bp, Glycine max
gtcttgacggtcccattttcaccccattgtgcaaattgaaagtagtagggaacccctactatagctactacatcatcacaatgacgtcaccttaacgtctctcgtgttgacacgtagctcagtgaggctatttcgctgcatcctccaagaaggtgtttggaaggatccttcccaccccatgccaaaagcaagcatattaattaaaaaaaatagaaaaaaataaaacacaattttattttattataggatatttattagttatttattggatataagtggcagcatgctttagtcctaggcgtgataaaaggccaaagactcttaggtttttggctctttgcagaatctttgagtgacacatacctagctatcacctcaatggattactattttggaaaccttaatcctaacccttattaccatcactctgccgtagtgaacatggcatctccctcctccgagttcatgttatctgattatctcgtgttggaagatgctcttgttgttgatcatcatcaagagtcttggtcacaaagcactgaaactgaatcatcggagaaagcaacctccagcgatgcaagtcatgggttcggtgatgcaacctccaccaacaccaacatgcatataaagtgccaaaatagtgggattaagggaaagaatgcagaagtgagtcaaaggatcacgtttagaaccagatcgcaacttgaggttatggatgatggatataaatggaggaaatacgggaagaaaacagtgaagagcagtcccaacccacggaactactacaagtgttcaggtgaaggatgcgatgtgaagaaaagggtggaaagggatagggatgactccaactatgtgttaacaacgtacgacggtgtccacaatcatcagaccccgtctactgcctactacagccaaatgcccttgctgcattctaatcatgattgggccctccacccttctgcaaactcataatatcctccttaatatagtaatatccagagataggagaatcaacttatacttttaggattactttttatctttattatttattttttataagagattttaaaaaataaataatgagaatagagaataattttaaaagaattattgttgatgtaagttaatctctactctgtatatatatatagttattgactcatttagtatattgcctgtcaataaccattattacatgtatattgattattatgcaggttcccctccacgct

SEQ ID NO: 969 - DNA, 974 bp, Glycine max
tttttaggaggcaaaacttttattattaaacagagtacaagagagatactctaatcctaatacaagatacttacttttaagatttgaacaactttacacatggagaatcatgttccttgttacatgaactagcaaaggctgatttttaattgagagatatattaaacgtggaaccaaaaaaaggtatagaaactctcttcaacctattacagcatgaaaataaattatgattgattagacaatgcaatgatacatagcttcccctgctcgatcgaatcttccaagctttttcttggcacataattaagctagggaggtgtaaatgcccaaaagggtttgaagttggtgtcatttgaaagtagtatcagaatgtacgaaggagatggggctgtagtatgtggtaaatgggctctcatgattgtgcacaccttcatatgttgttatcacgtagctgtagtcatctctatccctttccacccttttcttcacactgcatcctccacttgaacatttgtagtagttccttagattgggactgctcttcacggacttcttgccgtacttcctccacttgtatccatcatccatgatctcaagctctgatttggttctaaacgcgatccttggacccactccacctttgttttcattaatcccatttttgcagtttatgttattattcttagaggttgcaccagtactgaatccgtgagtggcatcattgaaggttgctttttcagatgactcggtgctttgtgatgatcgagaatcttgatgatcaacatagtcatcgagcatgagataatcggatagtgcaatctcaggggaagatagagccatattaagagaattatgagcataattattgggataaggaggagagtttccaaagtagaagtccattgctgataactaaatatggtagtaaatgaaaacaaagactatggtgcgtagagcaacgagcagaattctga

SEQ ID NO: 970 - protein, 243 aa, Oryza sativa
MAAAAAGASTPFNFCRHGSHAEYDAVFSGSWMARRPSAAPHGGGASGSGSGSGYGAASYVAPTFGAAFRQQHLDLLDYLSDDQGVPAPPPAAVPSASYVTPAPAMAPAEPVVPDAVAAAGGYPRSVAAAAAAVAGEGRDRTTTDKIAFRTRSDDEILDDGYKWRKYGKKSVKNSPNPRNYYRCSTEGCNVKKRVERDKNDPRYVVTMYEGIHNHVCPGTVYYAAQDAASGRFFVAGISHPDLN

SEQ ID NO: 971 - protein, 221 aa, Oryza sativa
MAAVGAHAAVYHHPVSGLSAPAGDAAYSMSSYFSHGGSSTSSSASSFSAALAAATTPPLPDPSGSQFDISEFFFDDAPPAAVFNGAPTAALPDGAAANATRSAAEAVPAPAPAAVERPRTERIAFRTKSEIEILDDGYKWRKYGKKSVKNSPNPRNYYRCSTEGCNVKKRVERDKDDPSYVVTTYEGTHNHVSPSTVYYASQDAASGRFFVAGTQPPGSLN

SEQ ID NO: 972 - DNA, 743 bp, Zea mays
agatcgagatcctggacgacggctacaagtggaggaagtacggcaagaagtccgtcaagaacagccccaacccaaggaactactaccggtgctcgacggaagggtgcaacgtgaagaagcgggtggagcgggacaaggacgaccccagctacgtggtgacgacgtacgaggggatgcacaaccacgtcagccccagtacggtgtactacgccagccaggacgccgcctccggccgcttcttcgtcgccggcacgcagccgccgggctccctcaactgatccccggcggcccatcgcgacgtacggtccgctccaccgcaccaatctggtttcgactcccagatggcagctagctagtcggcggtatacactagtagtagtaggataggccggccgacacccccgataggtgatcggctggtgggtcggtttcccgaggtggatttctcgtttgggtttctagcacacccctccgctcctccctcttttccccgtccttttcctgctccgatcatggaaagggccggcggctggctggctggctggctgttgcgatcgaatagtatgtagtggtggtggtgctgctgttcatgctgggttccaagagaggtttaatttcccattgccttgagctcagctaaattattagtccgggacggaaatgtagcatatactgcattgaccgtgtaataagatgtacagaagctgtcccaacgttggacacaagatacttagattatatct

SEQ ID NO: 973 - DNA, 680 bp, Zea mays
ggccgcggacgacgcggatcgcgttccggacgaggtcggagatcgagatcctggacgacggctacaagtggaggaagtacggcaagaagtccgtcaagaacagccccaacccaaggaactactaccggtgctcgacggaagggtgcaacgtgaagaagcgggtggagcgggacaaggacgaccccagctacgtggtgacgacgtacgaggggatgcacaaccacgtcagccccagtacggtgtactacgccagccaggacgccgcctccggccgcttcttcgtcgccggcacgcagccaccgggctccctcaactgatccccggcggcccatcgcgacgtacggtccgctccaccctaccaccgcacctatctggtttcgactcccagatggcaggctggcagctagctagtcggcggtatacactagtaagtagtagtaggataggccggccgacacccgatcggtgatcggctggggggttcggttccccgaggttggatttctcgtttgggtttctagcacacccctccgctcctccctcttttccccgtccttttcctgctccgatcatggaaagggccggcggctggctggctggctggctgttgcgatcgaatagtatgtagtggtggtggtgctgctgttcatgctgggttccaagagaggtttaatttccca

SEQ ID NO: 974 - DNA, 823 bp, Zea mays
  misc_feature (9)..(9): n is a, c, g, or t
  misc_feature (802)..(802): n is a, c, g, or t
ccggccggngatattcaggcaggcgcattgactggtacgcatacaactacaagcaaggcggctagctacagcggctagtgcgcgcgtggtgcaggcgcagctagctagtgcgtgcaatggcgacttcgctgggactgaaccctgaagatctcttcacttcgtactcgtcttcctactactcctcgccgccgttcatgtccgactacgcggcgagcttcacgccggcgggcggggactccacggccttctcctcggagctcgacaaccttcaccacttcgactactcaccggcgccgatcgtcactgctgccggagccggggctgggggcggcgatcgcaacgagaagatgatgtggtgtcagggtggtggtgacgagagaagactcagaagcaacggaaggatcgggttcagaacgaggtcacaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccgcagccgctgctatcatcgtcccgtacggcaacggcggcggcaatagcggcttctacagcccgccgcacagcggctccccgtcggccacctcctactcgggctccctagtcttctgacttttccgggccttgacccatagttacctttacaccccagtcgtcggatgagaagaatcttcagcggncggctaaacagtctcaactgc

SEQ ID NO: 975 - DNA, 834 bp, Zea mays
cattgggtacctcgaggccggccgggaagttacttgcagctggccatgcacatggcgctatcgtcccgcagctcattcgccgccgacgtcctcctcccagccaccatgtcgtatcgtcagccgtgcagcggtgcttccagctacttgggctctcagcccgcggcccctttcccgtcggcagcgttcggcgcggtggcgcagctggacgtcttcgactgcctgtcgtcggacgaaggcgttggcgtcccggcagctgtacctggtgcgttcgcgccgccgccgccgcttatgccggccgagcgcgtcgtcccggacgctgctgcaggctacagtagtcatactaggagtgcagcggctgtggcgggtgaggggtcgaggactacgcacagaattgcgttccgagtgaggtcggacgaggacgaggtactcgacgacggctacaaatggaggaagtacggaaagaagtccgtcaagaacagccctaatccgaggaactactaccggtgctcgacggagggctgcaacgtcaagaaaagggtggagcgagacagggacgacccgagatacgttgtgaccatgtacgagggagtgcacaaccatgtgagtcctggtaccgtctattacgccacccacgacgccgcctccggccgcttcttcgtcgccgggatgcatcagccaggccattgatcaacgagcagatcagagagcgtcttaattagtgtaagatatgtataccgactatctgttttaggccttgttcatgttttaggtcttgtccagttattccaaatcatatagattggaatgtattgaaatgaattgagatagatttag

SEQ ID NO: 976 - DNA, 890 bp, Glycine max
  misc_feature (850)..(850): n is a, c, g, or t
actcctcctcctcctcctcctaccctttcattttcatttcccacatttctctctctctctctcctatacttcctctttacactccccatctctctcacttttcattttcatctccattttttttctctaaaactccaatttcccattttacccctcactgtcgatccccccccggccctcgctccgattcctaggaacagggttttcagttttcactgttccattaagtttccgagctcaattcagcttccgattcgccgcgcgcaaaacgacttcgtttttggattttggcgtcgcgtcctattcagaagctatatactataagatgagacgaatgaagaaagatattgaagatgaggtgcttcccaatgatatgagtggggcacagttgaatgatgagagttatgaaggaagtgctggcattgttctgaagaaggggccatggacatcaactgaagatgatattttggtggattatgtcaagaagcatggggaggggaactggaatgctgttcagaagcacaccgggctggttcggtgcggaaaaaggtgtcggctgcggtgggccaatcacctaaggccaaatttaaagaaagggggcgtttgccgcagaagaggagcggctgattgctgaacttcatgccaaaatgggaaacaaatgggcacgcatggcagctcatttgcctggtcggacagataatgagataaagaactactggaacacccggatcaaaaggcgtcaacgggctgggttgccactttatcctccagaagtgagtttgcatgctttgcaagagagtcagcatagccaaagcactggtggacttaaatggtggcgataaaatgcatnctggattcttgcagaaaaacagttatgagatacatgatgc

SEQ ID NO: 977 - DNA, 2373 bp, Oryza sativa
ggaaaaatggggtgcccatgcggccctgcccaatagcgttgctgtacctttcagctttataatctcgcccctcgcgagagagactccccccatcctgcaggcgcgccccgctctcttgctcagctcctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccagttgagacgccatgtatcgggtgaagagcgagagcgactgcgagatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatgtcagaattcaaatgaattctgtatttggtatttgccagacgctaaagcagattcttggtatcgttcttgctcattgtttggatcataacttgaggaagatctcgtcggttgtaattctgcattgctgacagagtccttgatggcatgcaggcactatcagatgttctcttatgcgactagcccttttgtccaataaagtagtgcatggagataagccggttaattattgttttcttttttgtattagagaaccctttttgtcatctctattgccggaattctgttggaaattcgtcatgtttgtttgaacaaaaaaaaaaaaaaaaaaaaa

SEQ ID NO: 978 - protein, 141 aa, Oryza sativa
MYRVKSESDCDMIHQEQMDSPVADDGSSGGSPHRGGGPPLKKGPWTSAEDAILVDYVKKHGEGNWNAVQKNTGLFRCGKSCRLRWANHLRPNLKKGAFTAEEERLIIQLHSKMGNKWARMAAHLYLLKFIFVGFTPAWMRS

SEQ ID NO: 979 - protein, 553 aa, Oryza sativa
MYRVKSESDCDMIHQEQMDSPVADDGSSGGSPHRGGGPPLKKGPWTSAEDAILVDYVKKHGEGNWNAVQKNTGLFRCGKSCRLRWANHLRPNLKKGAFTAEEERLIIQLHSKMGNKWARMAAHLPGRTDNEIKNYWNTRIKRCQRAGLPIYPTSVCNQSSNEDQQCSSDFDCGENLSNDLLNANGLYLPDFTCDNFIANSEALPYAPHLSAVSISNLLGQSFASKSCSFMDQVNQTGMLKQSDGVLPGLSDTINGVISSVDQFSNDSEKLKQAVGFDYLHEANSTSKIIAPFGGALNGSHAFLNGNFSASRPTSGPLKMELPSLQDTESDPNSWLKYTVAPALQPTELVDPYLQSPAATPSVKSECASPRNSGLLEELIHEAQTLRSGKNQQTSVISSSSSVGTPCNTTVLSPEFDMCQEYWEEQHPGPFLNDCAPFSGNSFTESTPPVSAASPDIFQLSKVSPAQSTSMGSGEQVMGPKYEPGDTSPHPENFRPDALFSGNTADPSVFNNAIAMLLGNDLSIDCRPVLGDGIMFNSSSWSNMPHACEMSEFK

SEQ ID NO: 980 - DNA, 1970 bp, Zea mays
tagcgtggggcagggcgagggcgagggcgactgcgaaatgatgctgcaggaacagatggactcgctggtggccgacgacgtcagcagcggaggagggtcgcctgaagaaggggccatggacgtccgcggaggacgccatcctggtggactacgttaagaagaacggcgagggcaactggaacgcggtgcagaagaacaccgggctgttccgctgcggcaagagctgccgcctccggtgggcgaaccacctcaggcccaacctcaagaagggggccttcacccccgaggaggagcgcctcatcatccagctccacgccaagatggggaacaagtgggcgaggatggctggtcacttgccagggcgtactgacaatgagatcaagaactactggaacactcgaataaagagatgtcaacgagctagccttcctatttatcctgctagtgtatgcaatcaatctacaaatgaagatcagcaactgtctggtaattttaacggtggcgagaatatatccaatgatcttctatctgggaacagcctttatctgccagattttaccagtgacaatttcattgcgaacccagaggctttatcctatgcaccacagttgtcagctgtttcaataagcaatttgctcggccaaagctttgcatcaaaatgcggctcctgcatggatcaggttgaccaagcggggatgctgaaacaatctggctgtgtgcttcctgcattgagcgatgccattgacagtgtgctttcctcagctgatcatttttcaaatgactctgagaagctcaggcaggctttaggttttgattatctgaatgaagccaatgctagcagcaagagtattgcacctttcggggttgcacttactggcagccatgcctttttaaatggcaatttctctgcttctaggcccacaaatggtcctttgaagatggagctcccttcactccaagatactgaatctgatccaaatagctggctcaagtatactgtggctcctgcaatgcagcctactgaattagtagatccttacctgcagtctccatcagcgaccccttcagtgaaatctgagtgtgcatcgccgaggaacagtggtcttttggaagagctgcttcatgaagctcaggcactaagatctgggaagaaccaacaatcatcggtccgaagttcaagttcttctgctggcacaccttatgagactaccacggtggttagcccagagtttgatatgggtcaggaatattgggaagaacagcccagttctttcctcagtgaatatgctcattttagtggaaattctttcactgaatccactcctcctgttagtgctgcgtcacctgatatcttccagctctccaagatttctcctgcacaaagcccttcaatgggctctggcgagcaggcgttagagcctaaacatgagtcggcagcttcacctcgtcctgaaaacttgaggcctgatgcattattctctgggaacacagccgatccatccattttcaataatgccatagccatgctcctgggcaatggcattgatgccgagtacaaacctgttcttggtgatggaattgtgctcgattcttcgtcatggaacaacatgcaacatgcttttcagatggcgggattcaaatgagttccatgcacttgtttgtgatgctgaagggcttcttgttgcttgttttggggtcagtatcagcgaaggccgcattgattgtgacgctgcattcctgacagagggcgtgcaggtgcagcagctaccatatgtgatcttcatgctaatagtccttttgtctaataaagtgcatgaagataaaccggatatttttttttttgctttgtattagagaaccgtttttgtcaaccctgtcaggattctgttggaaatgtgtcatgatttttgtttgaacaatttaatatctgtcattggtactgtgctgtgtgccaaaaaaaaaaaaaaagg

SEQ ID NO: 981 - DNA, 620 bp, Zea mays
  misc_feature (1)..(1): n is a, c, g, or t
naccgctggccggctcacagtaccagaggagtccaccggaggagctcagctagactcccaccctggtggctcgatcggcaccggccgctgcctgcgagactccgccagcgcgcgatgtaccgggtgaagagcgagggggagggcgagggcgagggcgactgcgaaatgatgctgcaggaacagatggactcgctggtggccgacgacgtcagcagcggaggagggtcgcctcacaggggcgtcggcacgcccctgaagaaggggccatggacgtccgcggaggacgccatcctggtggactacgttaagaagaacggcgagggcaactggaacgcggtgcagaagaacaccgggctgttccgctgcggcaagagctgccgcctccggtgggcgaaccacctcaggcccaacctcaagaagggggccttcacccccgaggaggagcgcctcatcatccagctccacgccaagatggggaacaagtgggcgaggttggctggtcacttgcccgggcgtactggccatgagatcaagaactacctggtacactcgtattaagagatgtcaacgagctagccttcctatttatcctgctagtgtatgcaatcaatctacaaatg

SEQ ID NO: 982 - DNA, 1388 bp, Glycine max
taaggctaatgcaacatattaataggaaagaagcagtttaacaaattgcctacgctttgtgtagcactaatcatgatttacacccgaaaattccccacaatacttgtcttgtttttgtcctctcactaaggacaaaaaatatagaaccatcaaagtgaaaacgaagaaagctaataccaccaaactgttggttgttctggcaaagaaggtattctttgatgagtgcattgtgcttgggaaacgaactactgcacgagaatgctttgaattcccaacccttaatcttattctccggtgtgctgggccttgtggggcaggttgcatctgtgtaggatcctgtgggcttgtgtgactctctaccaagactgatgattcatctaatttgatgatatcatcctttagtatctctgcataacaatcctcttcatacccctcctttggttgacctgaagattcagtgaaagtagcttcgttaactggtcgctgattcgattcggacacagaatcaatttgctccattgaaggagaaccataactgctactgtccctcttggagctacatccaacctctttgtcttgctcacaagcatccctttgatcaataccacctcctgagatagcacaaccactttcatgtgaattcaccggatgcctttgacttgatgaagctctattcgaagcatcgctcaaacggaactctgtgttcctcttgaggcgacaaatgaccaaagattcctgagatttgtcattaatgcagtactcgtgcataatccattcagtcctttcccctttaggtgcacgccctaagtggaacaccaaagtccgcttcgttcctataatgttggaacctgactttacattacgctctttgccagttgccttccagtatccacattcagttgctcttttactttgtgaaccatttgggtactttcttccgcggggagagaagaagaaccattcgttgtctgactgaatgaatgattgggctggtaaatcccaaggctcgtatttacaaagctcaccctcagaaatgacttgaacactctcctcatgaccctccaacttcttcctcaggtaataagaaatcaactcctcatcggtagggcagaatctgaatccaggaaacatggacgaagcagcaatcgacatctgagcctccctcgaaaccccttccatcatccaccaccctgctttttgcaccctcctctgtgttttttttttcctcaaccgattgccgacacaataatgaaaaaaaaagctagctacccagggtttaaggtggttgatggttataaacgaacagggttgctgtcggaagagttattccttgggggcagggaggggtggctccgcttatgaggttcaagtgtggttgtgctttgctt

SEQ ID NO: 983 - DNA, 1688 bp, Glycine max
  misc_feature (6)..(6): n is a, c, g, or t
cacgcnaagctaagcggcccgcaaaagctacaagagaagaaaaaaaaaaagagagaaaagaaaaaatttgttttataactttttaacttattgttcacttcttcttcttcttcttcttcaatatcttggttctttgatattattctattgagcaaaaaatgggagttccagagagagaccctcttgcacaattgagtttgcctcctgggtttaggttttaccccacagatgaggagcttttggttcagtacctttgccgcaaggttgctggccatcatttctctcttccaatcattgctgaagttgatttgtacaagtttgatccatgggttcttccaggtaaggcagtgtttggagagaaggagtggtacttttttagcccaagagacaggaagtacccgaatggttcacgaccaaacagagtcgcgggttctgggtattggaaagcaactggaacagacaagatcatcaccactgaaggtagaaaagttggcataaaaaaagcacttgttttctacattggcaaagcacccaaaggctccaaaaccaattggatcatgcacgagtatcgccttctcgattcttcccgcaaacacaacctcggaaccgcaaagcttgatgattgggttctatgtcgtatctataagaagaactcaagttcacaaaaggttgaggctaattttttggctatggaatgcagcaatgggtcatcaccttcttcatcgtcccacgtggatgacatgctgggatcgttgccggagataaatgaccggtgcttcaccctgccacgagtgaactcactcagaacaatgcaccagcaggatgagaaattcgggtctccgaacatgggatccgggtttttctcggattgggttaactcgaccgatctcgattcgatttccgaattcgagtcgggttgccaaacccaaagaatggtgaattatgattgcaatgacttttttgttccttctctgccgcccttgggccatgtggactacatggtggatgcacctttggaggaggaggttcaaagtggtgtgagaacccgacgggtcgacgggccggggcattttcaaccgaatccagatacccgattgttaccgggctcaggtgacccattcgggtttgggtttattatgggtcagcaagttgggttcggggttagggagtgaagtgaaggatcagaaagtgtaattgtgtaaataattggggattttagtttaatttgaattctatgaccattgttatggtttgtgttattgattcccgcttggaaaggaaaaattgcaattttggtcatacttttcggctagaacaagatgaaggacggttgacacattatgaaactgagaaaggacgcaatggtgattgcaccacaaccacaacaatgcatgctgaaaagtaattgctttgtaagacattattgcctaaacatgaatcacgttgtacttcaaagcattaatacatagcaactattttccaaagtttagtttagaactttagatattggtatttttatttggctagtgtcccatgcatccttgtagacaacctgattaacatgtaatgaagatatgtccaccatttgctataaagttgtcttgcctcgctgattgtgaaaaaagtgagatcaacgtgtgaaatgaaccctccattttatgtatgaaacaaatggatttggattgatt

SEQ ID NO: 984 - DNA, 1406 bp, Glycine max
cccgcaactacgggaaaaaaaaaagagaagataaaaaaacttggttttatcttctttgttattattatattcacttcttcaatatcttggttctttgatattattattcgattgagcaaaaaatgggagttccagagagagaccctcttgcacaattgagcttgcctcctggatttagattttatcccactgatgaggagcttttggttcagtacctttgccgcaaggttgctggccatcatttctctcttccaatcattgctgaagttgatttgtacaagtttgatccacgcgtccgcccacgcgtccgacggctccgtgttgacgacagaagggtggaaagcaactggaacagacaagatcatcaccactgaaggtagaaaagttggcataaaaaaagcacttgttttctacattggcaaagcacccaaaggctccaaaaccaattggatcatgcacgagtatcgccttctcgattcttcccgcaaacacaacctcggaaccgcaaagcttgatgattgggttctatgtcgtatctataagaagaactcaagttcacaaaaggttgaggctaattttttggctatggaatgcagcaatgggtcatcaccttcttcatcgtcccacgtggatgacatgctgggatcgttgccggagataaatgaccggtgcttcaccctgccacgagtgaactcactcagaacaatgcaccagcaggatgagaaattcgggtctccgaacatgggatccgggtttttctcggattgggttaactcgaccgatctcgattcgatttccgaattcgagtcgggttgccaaacccaaagaatggtgaattatgattgcaatgacttttttgttccttctctgccgcccttgggccatgtggactacatggtggatgcacctttggaggaggaggttcaaagtggtgtgagaacccgacgggtcgacgggccggggcattttcaaccgaatccagatacccgattgttaccgggctcaggtgacccattcgggtttgggtttattatgggtcagcaagttgggttcggggttagggagtgaagtgaaggatcagaaagtgtaattgtgtaaataattggggattttagtttaatttgaattctatgaccattgttatggtttgtgttattgattcccgcttggaaaggaaaaattgcaattttggtcatacttttcggctagaacaagatgaaggacggttgacacattatgaaactgagaaaggacgcaatggtgattgcaccacaaccacaacaatgcatgctgaaaagtaattgctttgtaagacattattgcctaaacatgaatcacgttgtacttcaaagcattaatacatagcaactattttacaaaaaaaaaaaaaaaaaaaaaaaaaaaaa

SEQ ID NO: 985 - DNA, 879 bp, Glycine max
cccacgcctagggaaaaaaaaaaagagaagaaaaaaaaacttggttttatcttctttgttattattatattcacttcttcaatatcttggttctttgatattattattcgattgagcaaaaaatgggagttccagagagagaccctcttgcacaattgagcttgcctcctggatttagattttatcccactgatgaggagcttttggttcagtacctttgccgcaaggttgctggccatcatttctctcttccaatcattgctgaagttgatttgtacaagtttgatccatgggttcttccaggtaaggcagcgtttggagagaaggagtggtacttcttcagtccaagagacaggaagtacccgaatggttcacgaccaaacagagttgcgggttctgggtattggaaagccactggaactgacaaaatcatcaccactgaaggtagaaaagttggcataaaaaaagcacttgttttctacgttggcaaagcacccaaaggctccaaaaccaattggatcatgcacgagtatcgccttctcgactcttcccgcaaacacaacctcggaaccgcaaagcttgatgattgggttctgtgtcgtatctataagaagaactcaagtgcgcaaaaggttgaggctaatcttttggctatgggatgcagcaatgggtcatcaccttcttcatcgtcccacgtggacgacatgctgggatcgttgccggagatcgatgaccggtgcttcaccctgccgcgagtgaactcactcagaacaatgcaccagcaggatgagaaattcgggtctcgaacatgggatccggtttttctcgatcggttacttgaccagaaaacccaagaatgggaatatgatgcatgacttt

SEQ ID NO: 986 - DNA, 824 bp, Glycine max
  misc_feature (715)..(715): n is a, c, g, or t
caactagagaattaatttttgagaaaaaaaaaaaactcggttttatcttctttggtattattatattcacttcttcaatatcttggttctttgatattattattcgattgagcaaaaaatgggagttccagagagagaccctcttgcacaattgagcttgcctcctggatttagattttatcccactgatgaggagcttttggttcagtacctttgccgcaaggttgctggccatcatttctctcttccaatcattgctgaagttgatttgtacaagtttgatccatgggttcttccaggtaatttatttcatcatttatcataaaaaaaaatctaaaaacgatctttaaccacgatttttgtcacaatatcaaagtttttagagttcgcaatcacaattgcgaccgcttagatcacatttgtcttcaatttcttgccatattaaagattgtaatataattgtagttgtgattacaacggtaatttaaaaaatttataaccttggttaatgtctatttgcacatgcacaaaaatgaggactactaggattattattattatgtttttaattgaatgtggttatggtggtgtacgtaaagcaccgtttggagagaaggagtggtacttcttcagtccaagagacaggaagtacccgaatggttcacgaccaaacagagttgcgggttctgggtattggaaagccactggaactgancaaatcatcaccactgaaggtagaaaagttggcataaaaaaagcacttgttttctacgttggcaaagcacccaaaggctccaaaacccattggatcatgcacgagtatc

SEQ ID NO: 987 - DNA, 1384 bp, Glycine max
ggttcttttccttctgagaagatcgaattgtgttttgcaaaaatgggagttccagagaaagaccctctttcccaattgagtttgcctcctggttttcggttttaccccaccgacgaggagcttctcgttcagtatctgtgccgcaaggtcgctggccaccatttctctcttccaatcattgccgaaattgacttgtacaagttcgacccatgggttcttccaagtaattatcaaatcgctcacccatctccatttttttttaagttaattactttgttctaaattgaatagatttgattgattaattttgcaggtaaagcgattttcggtgaaaaagagtggtactttttcagccccagagacaggaaatacccgaacgggtctcgacccaacagagtagctgggtcgggttattggaaagccaccggaaccgacaagatcatcaccaccgaaggtagaaaagttggcataaaaaaagccctcgttttctacgttggcaaagcccccaagggcaccaaaaccaattggatcatgcacgagtatcgcctcctcgactcttcccgaaagaacactggcaccaagcttgatgattgggttctgtgtcgtatatacaagaagaactcgagtgcacagaagacggcgcaaaacggcgtggttccgagcaacgagcacactcaatacagcaacggttcctcttcttcttcttcgtcccagctggaggacgttctggaatctctgccatcgattgatgaaaggtgtttcgcgatgccacgcgtcaacacgctgcaacaacaacagcaccacgaggagaaggtcaatgttcagaacttgggtgcagggggtttaatggattggaccaacccttcggttctgaattcggtcgccgatttcgcttcggggaataatcaagtggtacaggaccagactcaggggatggtgaactacaactgcaatgacctttatgtccctacgttatgccacttggactcatcggttccgttaaagatggaggaagaggtgcaaagcggcgtgagaaaccaacgggtcgggaataataattcgtggtttcttcagaatgatttcacacaggggtttcagaattcggttgacacgtgtgggtttaaatacccggttcagccggtcgggttcgggttcagaaattgaaccggctgatggattaataatagtaatgtttaaatcgggtttatttggtgtaaataggtggggattctttgggcttaactcgtgggggttttagattcctttttagaaaagggaagaagaaggtgcaaattttggtcctcattttcggctaaagatggagggtatactacaaacgttcaatgaatcaatccacgagataaagcaaaaaaaaaaaaaaaag

SEQ ID NO: 988 - DNA, 1845 bp, Glycine max
gaattcggctcgagcttgaccatgatgatactgaaaagcagatgctgagaaagttaagtaaacaacttagtggtgaggaccagatatagatcctattgcccagcacagtgtgttcaaattgttccaaaacatttccctgctacttcatcttcttcttcttcttcttcttcatcaccggtggttctgttcattcttccttgcaccttcttctttgaagatcgaaattgtgtttttgaaaaaatgggagttccagagaaagaccctctttcccaattgagtttgcctcctggttttcggttttaccccaccgacgaggagctcctcgttcagtatctatgccgcaaggtcgctggccaccatttctctcttccaatcattgctgaaattgatttgtacaagttcgacccatgggttcttccaagtaaggcgattttcggtgagaaagagtggtactttttcagccctagagacaggaaataccctaacgggtcccgacccaacagagtagccgggtcgggttattggaaagccaccggaaccgacaagatcatcaccaccgaaggtagaaaagttggcataaaaaaagccctcgttttctacattgggcaaagcccccaaagggcaccaaaaccaattggatcatgcacgagtatcgcctcctcgactcttcccgaaaaaacaccggcaccaagcttgatgactgggttctgtgtcgtatctacaagaagaactcgagtgcacagaaggcggtgcaaaacggcgtcgttccgagcaacgagcacactcaatacagcaacggttcctcttcctcttcttcgtcacaactcgacgacgttctggaatcgctgccagcgattgatgaacggtgtttcccgatgccacgtgtcaacacgctgcagcaacagcagcacgaggagaaggtcaatgttcagaacttgggtgaaggggggttactggattggaccaacccttcggttctgaattcggtcgttgatttcgtatcggggaataataatcataatcaattggtgcaggaccagacgcaaggcatggtgaactacaacgcgtgcaatgacctctatgtccctacgttatgccatgtgggcacgtcagttccgcaaaagatggaggaagaggtgcaaagcggcgtgagaaaccaacgggtccagaacaattcctggtttcttcagaatgatttcacacaggggtttcagaattcggttgacacgtctgggtttaagtacccggttcaaccggtggggttcgggttcaggaattgaaccctgttatcgattaataatagtagtaatcttttaaatcggtaaataggtgggggattctttgggcttaactcgtgggggttttagattaatcctttagaaaagggaagaagaagaagaagaagaaggtgaaaattttggtcctcattttcagctaaagatgtagggtatacaaacgttcaatgaaccaatccacgagataaagcaatgacgggaccattttaatttgttacgacgtagttttcggcccacacaagcccttactcagccacatgaatcacatttgtacttcaaatgaacagcaagaattttttttactaaaaaaaaaaaaagagctctaataaaaaatacataatctttgaagtctgagaaaaaacatgtctaaagtatttggattgaaaatcatctacctttaaaaagacaccgggggggggggtctaaacccaatctgctttttccagactgtgaaaacactgcctttggggcccctgatgacacttacgttctggatacacctgggggtgctcgagttgaacctccctactcatgctccccttgggcctgc

SEQ ID NO: 989 - DNA, 1557 bp, Glycine max
tacggctgcgagaagacgacagaaggggagaagaaaaaaaaaacattttcatcatcttcttcttctttttcatcaatcatcaccagtggttcttttccttctgagaagatcgaattgtgttttgcaaaaatgggagttccagagaaagaccctctttcccaattgagtttgcctcctggttttcggttttaccccaccgacgaggagcttctcgttcagtatctgtgccgcaaggtcgctggccaccatttctctcttccaatcattgccgaaattgacttgtacaagttcgacccatgggttcttccaaatttgattgattaattttgcaggtaaagcgattttcggtgaaaaagagtggtactttttcagccccagagacaggaaatacccgaacgggtctcgacccaacagagtagctgggtcgggttattggaaagccaccggaaccgacaagatcatcaccaccgaaggtagaaaagttggcataaaaaaagccctcgttttctacgttggcaaagcccccaagggcaccaaaaccaattggatcatgcacgagtatcgcctcctcgactcttcccgaaagaacactggcaccaagcttgatgattgggttctgtgtcgtatatacaagaagaactcgagtgcacagaagacggcgcaaaacggcgtggttccgagcaacgagcacactcaatacagcaacggttcctcttcttcttcttcgtcccagctggaggacgttctggaatctctgccatcgattgatgaaaggtgtttcgcgatgccacgcgtcaacacgctgcaacaacaacagcaccacgaggagaaggtcaatgttcagaacttgggtgcagggggtttaatggattggaccaacccttcggttctgaattcggtcgccgatttcgcttcggggaataatcaagtggtacaggaccagactcaggggatggtgaactacaactgcaatgacctttatgtccctacgttatgccacttggactcatcggttccgttaaagatggaggaagaggtgcaaagcggcgtgagaaacccaacgggtcgggaataataattcgtggtttcttcagaatgatttcacacaggggtttcagaattcggttgacacgtgtggggtttaaatacccggttcagccggtcgggttcgggttcagaaattgaaccggctgatggattaataatagtaatgtttaaatcgggtttatttggtgtaaataggtggggattctttgggcttaactcgtgggggttttagattcctttttagaaaagggaagaagaaggtgcaaattttggtcctcattttcggctaaagatggagggtatactacaaacgttcaatgaatcaatccacgagataaagcaatgatggaaccatttaatttgttaggacgtagttttcggccatacaagcccttacttagccacatgaatcacatttgtacttaaaatgaagaactagaaaattgtttgctatatgttaggtttcgttaattaattaattccaatctggttattatgaaaattataact

SEQ ID NO: 990 - DNA, 3233 bp, Glycine max
aagtcaaatctattgatgcatgattcgtaacttaagcgcaagaaatgcttcaatataatgtaatgatggaagtcttccatgatgaaattcaaacattagaagcatgtggtggagccaaccataaacaaatcaaataaaaacactaccaacataatcttgcactgcaaagtgcaaaccatttcaatgttatacatagacatcatgtcttctcgactttggggtcataatcgtaatttgatattacccacaacttattaatgttagcttttggatacctatcacagccttgaaggagactggtaccagccccacggttcatcagagatatattgggtcacttgcttcacactcaagtaattatcaagtccccattctcctaattcacgaccaaaaccactgcgtttaatgcctccccatggggcttgagtgaagcatggttgagagcaattaatccacacaattccagccttaaaagccttagtaatgcgctcacatctttctagatcatttgatattacagcagaacccaagccatatacagtgtcatttgctagatcaatagcttcttcctcagtgctaaatgtttttacacagagaactggtccaaatacttcttctctccaaatttgcatggaggtagttacatcagttatgacagttggttcaacaaagaatcccttctttagatgctctgggcgagacccaccagtcaaaatggttgcaccctcactcttagcatttgagataaacttcaatatcttttcatactgtccttcactaacaatagggcctagtctgcaaccttcttccaagggatcagaaattttgatgttttttgacccatttcacaatcctattcaaaaattctgttgctatactttcatgtacaataaggcgggaagttgcactgcatatctgaccatttgtccagaagcaaccaaatatggtccattcagcagccttgtcaaggtcaacatcctcaaaaacaatgattgggcttttcccaccaagctctagtgaaacaggcttgatcagctgagctgcagctgtcataattttgctcccagttgcagagcttccagtaaaggcaatcttgtctacatcgggatgagctgctaaaggagcaccagcttcatgtgcctaatccagtaacaatgtttaatacccttggaggaaggccaacttcatctgcatatttcagacagctccaaacagtcgacagatgccaattcagatggcttcaatattgctgtacgttccagcagctagagcaggagcaactttccatgtagccatcaatagaggatagttccatggagtaattaatgcaacaactccgatgggctccttgagaacataactcttgaaggtttccataggaagggatacaggagcattttgctttgcgtccaatccttctgcaagctcggcatagtagttaaaacaaccaataacatcatccaggtctgccagtgcttcatctagtggttttccacaatcaattgcttcaagctttcctagttcatcctttttctctgttatctttgaagcgatggctcgaagatagcgagcacgaacagagccaggagctgaagaccaatctttgcctttgttatgggaaaaggctcttttagcagcatccaccgcaaggtcaacatcttccttagtagcggctggaatatgccctatgatgtcttcagtagcggggttgatgatcggaaaccgatttgttgagaagagggaactttccactctccatcttagtgaaaagttgtctactgggtagtggagattgccatttttctcttctcacttctcactctatgctatgttattgcccacgcgtccgcccacgcgtccgcccacgcgtccgcccacgcgtccgcccacgcgtccgcccacgcgtccgtctgaattgaataaatttgattgattaatttttgcaggtaaggcgattttcggtgagaaagagtggtactttttcagccctagagacaggaaataccctaacgggtcccgaccccaacagagtagccgggtcgggttattggaaagccaccggaaccgacaagatcatcaccaccgaaggtagaaaagttggcataaaaaaagccctcgttttctacattggcaaagcccccaaaggcaccaaaaccaattggatcatgcacgagtatcgcctcctcgactcttcccgaaaaaacaccggcaccaagcttgatgactgggttctgtgtcgtatctacaagaagaactcgagtgcacagaaggcggtgcaaaacggcgtcgttccgagcaacgagcacactcaatacagcaacggttcctcttcctcttcttcgtcacaactcgacgacgttctggaatcgctgccagcgattgatgaacggtgtttcccgatgccacgtgtcaacacgctgcagcaacagcagcacgaggagaaggtcaatgttcagaacttgggtgaaggggggttactggattggaccaacccttcggttctgaattcggtcgttgatttcgtatcggggaataataatcataatcaattggtgcaggaccagacgcaaggcatggtgaactacaacgcgtgcaatgacctctatgtccctacgttatgccatgtgggcacgtcagttccgcaaaagatggaggaagaggtgcaaagcggcgtgagaaaccaacgggtccagaacaattcctggtttcttcagaatgatttcacacaggggtttcagaattcggttgacacgtctgggtttaagtacccggttcaaccggtggggttcgggttcaggaattgaaccctgttatcgattaataatagtagtaatcttttaaatcggtaaataggtgggggattctttgggcttaactcgtgggggttttagattaatcctttagaaaagggaagaagaagaagaagaagaaggtgaaaattttggtcctcattttcagctaaagatgtagggtatacaaacgttcaatgaaccaatccacgagataaagcaatgacgggaccattttaatttgttacgacgtagttttcggcccacacaagcccttactcagccacatgaatcacatttgtacttcaaatgaacagcaagaattttttttactatatgttaggtttcgttaaataattccaatcttgatattactttgttaaccaactaaagtacctaaagaaatgcaactcattagaaaaaaaaaaaaaaaaaaaaaaaaag

SEQ ID NO: 991 - DNA, 1340 bp, Zea mays
cccacgcgtccgcccacgcgtccggaccaacaccactccactccctccatttccctcacctcccgcagcagctagccgccgccagccaacaaccgaaccaaccaaccaacccacagcgagcgaggaaagcgtccaatggtagcgatggcggccgtgcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccgtgggacctgccggagcgcgccctcttcgggcgccgcgagtggtacttcttcacgccgcgggaccgcaagtaccccaacggctcccgccccaaccgcgccgccgggtcgggctactggaaggccacgggcgcggacaagccccgtggagcacgggggccggacggcggggatcaagaaggcgctcgtgttctaccacggcaagccgccgcgcggggtcaagacggagtggatcatgcacgagtaccgcctcgccgaagccggcggcgcccgcgccaagaagtccggcgccggcacgctcaggctggatgactgggtgctgtgccgcctgtacaacaagaagaacgagtgggagaagatgcagcagcagaaggagaaggagaaggagaagaaggcgatggagtcggaggcgtcgctctcgcactcccactccgacacgcggacgccggagtcggagatcgacgacgacacgttcccggagctgggctccctgccggcgttcgacgacatgggcccagccccagcagcagcagccactgccggcgtcgtcctgcccaaggaggaggtggaggaccttcggcgacctcggcggcgacgactggctcgcgggcatcaacctcgacgacctgcagatgccgggggacgccgccgatttctacggctccatgctcgtctcgccgatggccgccaagatggagccggacggcggcttccccttcttctgagatccttcggcgactccggggacgaccggatgcagcgcaacgcaaactgtgtatagttcagattttcttcatggaaccaacaacaacaacaaaaaaagttctgctaatatcttgttctagtggtgtagtgcagaagtagcagcaggcatgattgaagttccattgtagtactgatgttcatcgccacttgatctgtgacaagtgacggcattctttcgtttcttggctgcaaattcttcgttgttcagaatataatttcagatgggtaatgccaattcgggcccgtctttagcggtt

SEQ ID NO: 992 - DNA, 581 bp, Glycine max
  misc_feature (560)..(560): n is a, c, g, or t
cctgctcgccgtgcaggactacaacgtgccgttattcgattggctccccgccggtgtcggacaccatccttcgccgtctccggccagctccaacgtccccgactcctccgaggtgctcaacacgccggcgtcgcctaatttttcgtcgatttcctcgtcgtcgaatgaggctacggtcaataacaactccgaacaacagagtgggaaagaattacaagaagaagaaggtggtaatggaggcagaggagataaccaagatcaagacaagactaagaaacagcttaaagcgaagaagaagaagaagaagaagaaccaaaagaagcaaagagaaccaagattcgcgttcatgacaaagagcgaggttgatcacctagacgatggttataagtggcgcaagtacggcccaaatagctgtgaaaaacagcccttatccaaggagctactaccgttgcaccagcgcgggttgcggcgttaagaagcgcgtggagcggtcctccgaagacccttccatggtggtgacaacctacgagggtcagcacacgcactcgtgccctgcttcngctcggtctagccttggcttc

SEQ ID NO: 993 - DNA, 986 bp, Glycine max
tacggctgcgagtagccgtcggaagcggctcgaggagaagagagagaaagagggaaactcaaagtcatcatcatctaccatggcaaattctgtggcattttccgacgagattcctaacatgagcatgagcttccctttctcccctgctttctctagtagcatctttgacatgatgccaccaccaccaccttcctcatctcacgatcctaaagctcccaactttgctaatagcttcatggacttgctcgctgtccctgctgattattataccccttctttattcgactggtcccaaaacaccgcccccacgtcagcaccaccaccttccaccacccaaatcaaccaccctcttccgtcgccagccagctccaatgtccccgacggctccgaggttctcaacactccggcgtctcccaattcttcgtctatttcatcatcgtccaacgaagcagcagccgccaccaccgccaacaaaacaacgggaaatgataatgaagaggaggaagatgaaacagcaatagatgcaacagcaggcagagaagaagaagatcatcaagaccaagacaagactaagaaacagctcaagccaaaaaagaagaaccaaaaaaagcaaagagagccgagatttgcgttcatgacaaagagtgaagtggatcacctcgacgatggctatagatggcgcaagtacggtcaaaaagccgtcaaaaacagccctcatccaaggagctattatcgttgcaccaccgcgacatgcggcgtgaagaagcgcgtggagcgttcctcggaggatcctacggtggtggtgacaacctacgaggggcaacacactcacccgtgtcctgccacgtcacgggctagcttcgggttcatgcactccgaagcaagtgggttcggacccaccagtggactaggttcggcacactttatgctgcaacaacaacaacagtttcgggaccaagcacaagcacaagcagcaatgttgtata

SEQ ID NO: 994 - DNA, 1616 bp, Zea mays
cccacgcgtccgctcgtccttgataagtgagcaagcggcgaggccgggcggggcgcccatgtcgtcgagagacttatacttccacgacgagctggcgtcgctgttcgcgcagcggccggcgccggccggagaggcgatgatgacgcaccagcaccagcagcagcaacaggcgccggcgtcgtggttcgcggactacctgcacgcgggcgccccaggcatggggatggactacgacctgctgtgccgcgcgctggacctgccgctgccgggggacgacgtcgtcaagagggaggaggagctgctgctggtggacacaggcggggacggaggaggcttcgccgcgcccacgcccacgcccagcgggggcggcacggcgccggtcacgcccaacaccacgtcgtccatgtcctcctcgtccagcgaggcggcgggcggcgccgccggaggaggaggaggaggaggaggaggaagggaggaggactcgccgcaggggaggtgcaagaaggaggaaggggatggggcaggagagcaaggcgctcgacaagggggaggaagacgctgacaagggcaagaaagggtcagcggcggcaggcaagggcaagggcaagggcgagaagcggcagcggcagccgcggttcgcgttcttgaccaagagcgaggtcgaccaccttgaggacggctaccggtggcgcaagtacggccagaaggccgtcaagaacagcccataccccaggagctactaccggtgcacgacgcagaagtgccccgtgaagaagcgggtggagcggtcgtcccaggacccggcggtggtgatcaccacgtacgagggcaagcacacgcaccccatcccggtcacgctccgcggcagcacccacatcctcgccgcgcagctgcaccaccaccacaaccaccacctcggcgccttcccgacgccgctgccgcagacgggcgcggcgccgttcgggcgggctgcaggcggtggcggaggcgtcatcgacatgctggggctcctgcccccgcgcaaccacggcatgagcggcggcccgatgagcgccgtggctggcgccgcgacgacgacggccgccaccattactactacctccaccacaccgtcgtatcccccctcgctccagatgcagcacttcatggcgcaggacttcgggctcctgcaggacatcatgctgccgtccttcgtccacggcggcggcggcggtaacatccagccctgaatcgatcccaattgctcaccgccatcgcaagcgcagcaagctaatgtgaggaaggaagctagctagataagagatagtagtttggttcttgttgatgcttaccctctttaatccttcgttttttttttcaccgacgacgatttactcctctagacgggaccgcgcgcgcgtgccatgcatatcggtccttgatttgcctttccgcctgcagctgtactggcgccggcaggcctggtctcgtaacgtttcttaattatgcatgatcgtcgagctagtccttgcaggtagtactagccgttcttgtacatgtacctaattaatcaactcccccgccggctcgtcctggccatgagctatgataattttatgctagctcctctttgcatt

SEQ ID NO: 995 - DNA, 810 bp, Zea mays
  misc_feature (657)..(657): n is a, c, g, or t
cctcgaggccggccggcgcaacttttaagcgagcatggagaattatcacatgctgtttgggacgacggcgacgcatgcgcagccctcttcagctgccggaaccccaagctcctacaacttcattgccaccagcaccagcagcgctagcggcttgcggcgcgaccacgaccgaggccagcacagcgggcacgtgcacgccgccggcggatcctcgtcgccgtcctccttcttcgtcgcggagcggctgtcccacaacgacgactccagcaaggacggtggtggcggtccaggtccagccgcagctggcagtggagagaaggaggccgaggcggacgacaggccggcggcggccaggaggaagggggagaagaaggagcgccgcccgcggttcgccttccagacgcgcagccaggtcgacatcctcgacgacggctaccgctggaggaagtacggccagaaggccgtcaagaacaacaacttcccacgaagctactacagatgcacacaccaagggtgcaacgtgaagaagcaggtgcagcggctgtcaagggaccgagggccgtggtggtgaccacatacgagggcacccacacacaccccatcgagaagtctaatggacaacttcgagcacattctcacccagatgcagatctactnccggcatgggatcaaccttcagcaggagtagccacgacatgtttcactgagtgaacgacccttccaaacacacttccatcaagcgtccgatcgagcaccatgcaaacaagcaagaaaattgatccatagatttttattaatttgtacattaat

SEQ ID NO: 996 - DNA, 2414 bp, Glycine max
  misc_feature (8)..(8): n is a, c, g, or t
gaccacanactgtcatgccatcctcagttctatctagtgatagtatgcacattgggcttcttgcagctgctgctcatgctgcagcaactaatagctgctttacagtgttctataacccaagggctagtccatctgaatttgtcataccgctttcaaaatatatcaaagctgtgtaccatacgcgtgtttctgttggtatgcggctcgggatgctttttgagactgaagaatcaagtgtccgcaggtatatgggtacaataactggcataagtgatttggattctgttcggtggccaaattctcattggcgctctgtcaaggttggttgggatgaatcaacagctggagagagacaaccacgagtgtctctgtgggaaattgagccattaacaacattcccgatgtatccatcattatttcccctcagactgaaacgtccatggcatcctggcacctcatctttgcatgatgggagagatgaagctactaatgggctaatgtggatgagaggtggacctgtagaccaaggtctcaattccctaaattttcaaggagctggtatgttgccctggatgcagcagagactggatccaactttactaggaaatgatcagaatcaacagtaccaagccatgttggcagctggtttgcagaacttagggagtggagatttaatgagacaacaaatgatgaattttcagcagcctttccactatcttcaacaatctggaaaccccaatcctcctttgcagcttcagcagccgcaaccagttcaacaatctgtgtcttctaacatgctgcagccacaagctcacgtgttgacagagaacttctctcagcacctccttcagaaaccacataacaatcaagaagtccaagcacaacagcagcagcatacttatcaagactcgctcttaattccgagtgatcagctccatcagagacaacactctggcattccttcaccatcatattcaaaaccggatttcttggattcgagcatgaagttccctgcttcagtttcccctgggcaaaacatgcttagttcactttgtcccgaaggaagtggcagtctcttgaatttatccaggagtggtcagtccttgctgaccgaacagttaccccaacagcaatggactcaaaaatatgcacctgtgcaggtcaatgcctatggaagcactgtgtcacatccacaatattccggaaaagattctgtaatggtgctaccacattgtaactcagatgcccaaaattctactctttttggtgtcaatatcgattcatctggccttctcctccccaccaccgtccctggttacaccacctcgtccgctgacactaattcatcaacaatgccattagcggagtctggtttccagggttctctatatggttgcatgcaagattcatcggagttgttgcaaagtgcagggcatgttgacccagaaaaccagactcaaacctttgtcaaggtttacaaatcagggtcagttgggcgctcacttgacatatcccggttcagcagctatcatgaactgcgcgaggagttggctcagatgtttggaattgaggggaagttagaagaccctcttagatcaggctggcagcttgtgttcgtcgacagggagaatgatgttcttctccttggagatgatccgtgggaatcattcgtcaataatgtttggtatatcaaaatactttcacctgaagacattcagaaaatgggggatcaagcggtagaatcccttgctctaggttcaggacaaaggctaaacggcactggtgctgagtctcaggacattgtttctggaccaccatcaatcggctcacttgagtactgagaaaactgaaacatgtattccttcagaccaccatggtcaagagaatttctctacatgttttattacttaagttggaatatgttgtgtatgatctgttccccctttcagccctccttattattactatcagcattgaagaaaagtatacatttatgattaaaaaaaacccttaggacatgcttctgtgccaatttgaacttggagcactgcaagctagagttagtgttaatgctattttagcataatatttgatcaaacttttgcatgaactaatgtactctagataggaaactagagaaggctgtttatgcttgagctgtctttgtattctacaatgccattagttcccagttaaggggtcgaacttttaactcaaaatgtatgagtagtattttactatattgccattgaaaccatcaacccaccatacgacatgtctcttaaatgctactattttgtagctctataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 997 - DNA, 2021 bp, Glycine max
attcggctcgagtattattctgagtgtggtgcaagccacctatgtactatttttcctttacttatgcaaaagctacctttgtactatttttcctttacttctgcacaagccaccttcgttttgcaggtacatgggtacaataactggcataagtgacctggatcctgttcgttggccgaattctcattggcgatctgttaaggttggttgggacgaatcaaccgctggagagagacagccccgggtatcattatgggaaattgagcctttaacaacgtttccaatgtatccatctctatttcccctcagattgaaacgaccctggcatccgggcacctcttcttttcatgatggcagagatgaagcaactaatgggcttatgtggctgaggggtggacctggagaccaagctctcaattccctgaattttcaaggttctggtttgttgccatggatgcagcagagaatggatccaactttacttgcaaatgatcataatcagcactaccaagccatgtttgcatctggtttgcagaacttagggagtggagatttaatgagacaacaaataatgaattttcaacagcctttcaattatcttcaacaatcaggaaaccccaatcctcctttgcagcttcagcaaccgcaagcaattcagcaatccgtatcttctaataatattctacagccacaagcccaagtaatggcagagaacctgtctcagcacctccttcagaaatcacacaacaatcgagaagaccaaacacagcagcagcagcagcagcggcacacttatcaagatacagttttacttcaaagtgatcagctccatcagaggcaacactctggtctaccttcaccgtcatattcaaaaccggatttcttagattcaagcatgaagttccctgcttcagtttcgccaggacaaaacatgcttggttcactttgtcccgaagggagtggcaatctcttgaatttatccagaagtagtcagtccatgttgactgaacagttacctcaacaatcatgggccccaaagttcacaccattgcagattaatgcttttggcaactcaatgcaacatgtgcagtattctggaaaagatactgcaatggtgccaccacattgtaacccagactcccaaaatcctattctatttggggtcaacattgattcatctggccttctgcttcctacgactgttcctcgttatactactgcatcagctgaaattgatgcatcagcaatgccaataggagagtctggattccagtctcctctatatccttgcgggcaagattcatcagagttggtgcaaagtgcagggcaagtcgaccctcaaaaccagacacgaacattcgtcaaggtttacaaatcagggtcagtagggcgctcacttgacatctcccggttcagcagttatcatgagctgcgggaggagttggcacagatgtttggtattgaggggaaattagaagaccctcttagatcaggctggcagcttgtattcgtcgacagggagaacgatgttcttctccttggagacgatccgtgggaatcatttgtcaataatgtatggtatatcaaaatactttcacctgaagatatccataaaatgggagaacaagccctggaatcccttggtccaagtccaggacagaggctgaatagcactggtgcagattctcatgaaattgtttcaggactaccatcaattggctcccttgaatactgagagaattttaacatgtatttttctctcaggtcctacggttaagaagactattacatatccacatgtttagtacttctgtttgaacactacttttcgaccttgcatatctgaatcaatatatactgtattgtctgtttcactttcaaaaacatcgttattatttcgtagaggattgttgagattttcaggacaaaaaatctatattatatatatgatgagaaagaaacctaggacaaacttttgtgcctgtaaccttgtgttgacatagagttaaaactattgtagc

SEQ ID NO: 998 - DNA, 3152 bp, Oryza sativa
  misc_feature (3084)..(3084): n is a, c, g, or t
  misc_feature (3138)..(3139): n is a, c, g, or t
cccgggctgcaggaattcggcacgaggtctctctcgccccccggccccaccctttctccccaccatggtggcgatctccgagctcgggtgagcggaagagaaagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaagagaagaagtgcctcaactcggagctatggcacgcctgcgccggcccgctcgtctgcctccccaccgtcggcacgcgcgtcgtctacttcccgcaaggccacagcgagcaggtggcggcgtcgacgaacaaggaggtggagggtcacatcccgaactaccccaacctgccggcgcagctgatctgccagctccacgatgtcacaatgcatgcggatgtggagactgacgaggtgtacgcgcagatgacgctccagccactgaacccacaggagcagaacgatgcgtaccttcccgcggagatggggataatgagcaagcagccgacgaattacttctgcaagacattgacggcgagcgacaccagcacgcacgggggggtttctccgtgccccgccgtgctgctgagcgcgtcttccctcctctggatttcacacagcagcctccagcccaggagctaattgcacgggatattcatgacatcgggtggaagttcaggcccctctttcggaggccaacccaaacgacacctgctaaccactggctggagcgtttttgtcagtgctaagagacttgttgctggagattctgtgcttttcagctggaacgcggcacgccggcttttacttggaataagacgtgccagtcggccacagactgtgatgccttcctctgttctttcaagcgatagcatgcacataggtctccttgcagcagcagctcatgctgctgctacaaacagccgtttcactattttctacaacccccgggcaagtccatcagaatttgtcataccactgtcaaaatacatcaaggctgtttttcacacccggatatcggttgggatgcggttcaggatgttgtttgagactgaggaatcaagcgttcgcaggtatatggggactataactgaagttagtgatgcagacccagtccgttggcctagttcctattggagatctgtgaaggttggttgggatgaatcaactgcaggggaaaggccaccaagagtttctttatgggaaattgaaccattgacaacctttccaatgtatccatctctgttcccactgagagttaagcatccttggtattcaggagttgcttccctgcatgatgacagcaatgctttaatctggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaattcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtcctttgtgaatagtgtatggtacatcaagatactttcacctgaggatgtgcataagatgggaaagcaaggaaatgatccacggtatctgtcctgaagtgagagaacatggtgccatttctgggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaacccaaaaaaaactgcaataatcgaagcgcacgaggattgtttccaaaaaaaaaaaaaaaaaaaaattttnaccgattgtccggttatgtcagtttcgagaggagctgtcaaaaaaaaaaaaaannaaaaaaaaaaaaa

SEQ ID NO: 999 - DNA, 2536 bp, Oryza sativa
ataagctcaatagttcttgaactgaattttcacagttgcatggaaaaccttacttgctgtcattaacagtacattgcaggaggaaaacatcatcaatatacagaatatggccgaagctagcgcctgcggcactacagcactactcaacatgaacctaataattagatgccctaagttaacatgatcagtattccaggaaacaaagtgtcggcatgtataccaaaatgtaataggtaccactaaaagtcaatgtaatatgacataattaccagacagcgcataacttagagctacacttgacctatgtgcttgggttccaggtcacagaactaagagctacagagacgtacagaactggacgcctaacgccgggtgctatgagctccctatttctcagaactcaactgagcccaccgacgcgattccagtgcttaggcttcttgattcctgcctgctcatgtagttgtcacagctgttgccaagtctccttgcagaagtcgagaagagttcaatgcccggcttgcccatctgctgaacctcctgcggcgaaagtatctttatgcaagacacactgttcacaaattcctgccacggatcatcgccaactagaagaaccgtcgtcctctcggtcaacaaatacaagctgccagccctgatctcaaaggggtcttccaactggcccctcaaggcccaaaaggcgccctacctcactacgaagttcatgataactgctaaatctagtgatgtcgagcaaccttccaacggttccagatttgtaaaccttcacaaaggttgcatgcggtcgcttcacttgatcagcattatctgaacatggaacatatcctgattcatctaagcagcccggagtagttagtgtttgactcaatgcctcgtccccttgcctgcggctaaggaagttggatgtggaatatggaattgtgcttgaactgttttcattgtgaaggcttggaatgccatcttgcatcaaaagtgactgtgagtctatatttacaccaaacaagaagtgattttgaggatcagagctcccatcttgatccaccaggcattcccttccaggcagtggtgctaacgtggagttttgaggaatactagaaggtgtcaagtcgaagttctctatctgtgatgaaatgtcatgtgggcgagaagtgatcgtagattccactgcaactcgcttagatgaccatgggtcagagacaggtacaggggtgattcttgccacacctgggaggtctgaagcagcttctgaagggaatgatctcagtgtatcgtgcatggatgagacattggatggagagagacaactgatatttgtgtcagggaaattatgttgctgtgagaatggtgaaactgtctgcaatgtggagggtgtagactgaggggtggaggaaagctgtgaaaaaaccgacaatgcatttggtacagtctgaaagttggacaagtgtttctgttgtcccatttgttgatgctgaggttgctgctggtgtgattcttgctgctgttgctgcggctgcaactgaggcttctgttcgttaaatgatgggcaatgttgaagcggttgctggaggtactcaggctgactatgcccttggattgagttgccattgatgttttggtggtacatctgctgaaattgaggctgtgcttgctgcagaatctgactggatagaagagaagatctaccgacaatgttttgcggctgctggaactgcagcatggcaggtgatacttgcttagtggtgttctgtaaagccgccgccgccgctatcgtttggtacatgtcaggttgcagaccaagtagggaactatccagccttggctgcatccacggactcataccaagtcctccaaaattcagagattggaaacctgtgttttgactatctcgaagccacataagagaagaagccaagtcatcctcctttccgccatataaagaaggtaagcctgttggccatggacgctttagtctgagaggaaaaggagatggatacatcgggaaagttgtcagaggctcgatctcccaaagagacacccttggctgtctctctccagcagtcgactcatcccatccaaccttgacagagcgccagtgtgagttcatccaacgaacaggatcaagatcacttattcctgttattgtccccatgtatctcctaacactggattcttctgtttcaaaaagcatccggaaacgcatgcccaccgatatgcgggtatggtagacagcctttacatatttagccagtggtataacaaactccgaagggcttgctcttggattatagaaaatagtaaaccggctatttgttgatgcggcgtgagcagctgcagcaagcagaccaatatgcatgctgtcactagacaatactgatgatggcatgaccgtttgtggcctatttgcccgacgaattcccagaagcagctgattactgtcattccagataaaaaggacagagtctccagcaacccctcgcgccgcactcccgcagccccgccaacccgtagtcagaagatg

SEQ ID NO: 1000 - DNA, 650 bp, Oryza sativa
ctgcaggaatcggcacgaggattgctgcgacggtccaggtttggttagttgttgagggagaaaaaaatggaagatatttctgggcgcaagagaggaaggcaggtgtttgctgctgctgctgggagcatgatgggaagctgaccagcagcttctccggtatcctggtgcggcggagtttcgtgctctttggcgacgggtgcactggtgattggagatgaagctctctccgccggcgtcagcggatatgccgcaggccttgccggagaacgacggggaacaaagatgtctgaactcggagctgtggcatgcatgcgctgggccccttgtgtctttgccagtggtcaggagcagggtcgtctactttccacagggccatagcgagcaggttgcggcatcaactaataaggaagttgatgctcaaatcccaaattatccaaacttacctcctcagttaatctgccagcttcataatgtcaccatgcatgctgatgcagagacagatgaagtttatgctcagatgacattgcaaccattgagcccggaagagcaaaaggagcctttccttccaatggagttgggtgctgctagcaagcaacccactaattacttctgcaagacattgactgcaagtgacacgagcactcatggtg

SEQ ID NO: 1001 - protein, 908 aa, Oryza sativa
MKLSPSAGGVSDQPPSPPEVAEEQKCLNSELWHACAGPLVSLPAVGSRVVYFPQGHSEQVAASTNKEMESQIPNYPNLPPQLICQLHNVTMHADAETDEVYAQMTLQPLSPQELKDPFLPAELGTASKQPTNYFCKTLTASDTSTHGGFSVPRRAAEKVFPPLDFTQQPPAQELMAKDLHGNEWKFRHIFRGQPKRHLLTTGWSVFVSAKRLVAGDSVLFIWNDSNQLLLGIRRANRPQTVMPSSVLSSDSMHIGLLAAAAHAASTNSRFTIFYNPRASPSEFVIPLAKYVKAVYHTRISVGMRFRMLFETEESSVRRYMGTITGISDLDPVRWMNSHWRSVKVGWDESTAGERQPRVSLWEIEPLTTFPMYPSPFPLRLKRPWPTGLPSLYGGKEDDLASSLMWLRDSQNTGFQSLNFGGLGMSPWMQPRLDSSLLGLQPDMYQTIAAAAALQNTTKQVSPAMLQFQQPQNIVGRSSLLSSQILQQAQPQFQQMYHQNINGNSIQGHSQPEYLQQPLQHCQSFNEQKPQLQPQQQQQESHQQQPQHQQMQQQKHLSNFQTVPNALSVFSQLSSTPQSTPSTLQTVSPFSQQHNFPDTNISCLSPSNVSSMHDTLRSFPSEAASDLPGVPRITPVPVSDPWSSKRVAVESTITSRPHDISSQIENFDLTPSSIPQNSTLAPLPGRECLVDQDGSSDPQNHFLFGVNIDSQSLLMQDGIPSLHNENSSSTIPYSTSNFLSPSQDDYPLSQTLTTPGCLDESGYVPCSDNADQVKRPHATFVKVYKSGTVGRLLDITRFSSYHELRSEVGRLFGLEGQLEDPLRSGWQLVFVDREDDVLLVGDDPWQEFVNSVSCIKILSPQEVQQMGKPGIELFSTSARRLGNSCDNYMSRQESRSLSTGIASVGSVEF

SEQ ID NO: 1002 - protein, 863 aa, Oryza sativa
MSSSSAASIGPPQPPPPPAPPEEEKKCLNSELWHACAGPLVCLPTVGTRVVYFPQGHSEQVAASTNKEVEGHIPNYPNLPAQLICQLHDVTMHADVETDEVYAQMTLQPLNPVRRLGFLHDVCSAEVLMQEQNDAYLPAEMGIMSKQPTNYFCKTLTASDTSTHGGFSVPRRAAERVFPPLDFTQQPPAQELIARDIHDIEWKFRHIFRGQPKRHLLTTGWSVFVSAKRLVAGDSVLFIWNEKNQLLLGIRRASRPQTVMPSSVLSSDSMHIGLLAAAAHAAATNSRFTIFYNPRTSPHYLWEFYNWASIKIHNILMRPMHTLMKHRYMGTITEVSDADPVRWPSSYWRSVKVGWDESTAGERPPRVSLWEIEPLTTFPMYPSLFPLRVKHPWYSGVASLHDDSNALMWLRGVAGEGGFQSLNFQSPGIGSWGQQRLHPSLLSSDHDQYQAVVAAAAASQSGGYLKQQFLHLQQPMQSPQEHCNLNPLLQQQILQQASQQQIINPDAQNIQTMLSPSAIQQQLQQLQQMQQVQNDQKQKIQPDQSYQVPTSAVLPSPTSLPSHLREKFGFSDPNANSSSFITSSSSDNMLDSSFLQGSSKAVDLSRFNQPVASEQQQQQQQAWKQKFMGSQSVSFGGSVLHNSPTSKDGSVENKIGRDVQNQSLFSPQVDSSSLLYNMVPNLTSNVSDGNLSTIPSGSTYLQNAMYGCLDDSSGLLQNTGENDPATRTFVKVYKSGSVGRSLDITRFSNYAELREELGQMFGIKGQLDDPDRSGWQLVFVDRENDVLLLGDDPWEFINIYMNVSNAKKSYIMKRREYNTLVSWFPQLIAYRGKTVLPSIICVGQSLYVDAQLPKTLRESKHQT

SEQ ID NO: 1003 - protein, 662 aa, Oryza sativa
MKLSPPASADMPQALPENDGEQRCLNSELWHACAGPLVSLPVVRSRVVYFPQGHSEQVAASTNKEVDAQIPNYPNLPPQLICQLHNVTMHADAETDEVYAQMTLQPLSPEEQKEPFLPMELGAASKQPTNYFCKTLTASDTSTHGGFSVPRRAAEKVFPPLDFSQQPPAQELIARDLHDNEWKFRHIFRGQPKRHLLTTGWSVFVSAKRLVAGDSVIFIWNDNNQLLLGIRRANRQQTVMPSSVLSSDSMHIGLLAAAAHAAATNSRFTIFYNPRASPSEFVIPLAKYVKAVYHTRVSVGMRFRMLFETEESSVRRYMGTITSISDLDSVRWPNSHWRSVKVGWDESTTGDKQPRVSLWEIEPLTTFPMYPSAFPLRLKRPWASGLPMHGMFNGGGNDDFARYSSLMWLRDGNRGTQSLNFQGHGVSPWLQPRIDSPLLGLKPDTYQQMAAAALEEIRYGDPSKQHPATLQYQQTHNLNSGLNSLFASHVLGQVQFQPQQSPLQVVQQGHCQNTGDSGFLQGQLPRLQLHNTQQLLKEQELQQQQRQHVLQEQSSQEMQQQLPSSDHHVADVASESGSAPQAQSSLLSGSSFYNQNLLEGNSDPPLHLHNNFHNFSYQEASNLLILPRSSQLMASDGWPSKRLTLESAVHPEAPSMHPKIEK

SEQ ID NO: 1004 - protein, 917 aa, Oryza sativa
MRLSSSSGSVLPAQAASPEAVEEQKCLNSELWHACAGPLVSLPAVGSRVVYFPQGHSEQVAASTNKEMESQIPNYPNLPPQLICQLHNVTMHADAETDEVYAQMTLQPLSPQELKDPYLPAELGSANKQPTNYFCKTLTASDTSTHGGFSVPRRAAEKVFPPLDFTQQPPAQELIAKDLHGNEWKFRHIFRGQPKRHLLTTGWSVFVSAKRLVAGDSVLFIWNDNNQLLLGIRRANRPQTVMPSSVLSSDSMHIGLLAAAAHAASTNSRFTIFYNPRASPSEFVIPLSKYVKAVYHTRISVGMRFRMLFETEESSVRRYMGTITGISDLDAARWPNSHWRSVKVGWDESTAGERQPRVSLWEIEPLTTFPMYPSPFPLRLKRPWPTGLPSLHGGKDDDLTSSLMWLRDSANPGFQSLNFGGLGMNPWMQPRFDASLLGLQPDMYQTIAATAFQDPTKQVSPTILQFQQPQNIGGRANTLLPSQILQQVQPQFQQQQYLQNINETTIQGHAQSEFLQQQLQRCQSFTEQKPQLQTQQQQQESQQQQQQQSQCMQVPQHQQMQQQKNMTNYQSVPNALSPFSQLSSPSQSSPMTLQTVLPFSQPQSYPDTSMSSLSPSNTSTMHNALRPFSSEAPSHLSMPRPTAVPVPDPWSSKRVAVESLLPSRPQVTSQMEQLDSTAPSIPQSSALAPLPGRGCLVDQDGNSDPQNHLLFGVNIDSQSLLMQGGIPSLQGENDSTAIPYSTSNFLSPSQNDFPLDQTLSSADCLDESGYVPCSQNSDQVINRPPATFVKVYKSGTYGRSLDITRFSSYHELRRELGRLFGLEGQLENPLRSGWQLVFVDREDDVLLVGDDPWQEFVNSVSCIKILSPQEVQQMGKPFELLSSAPGKRLGSSCDDYVSRQESRSLSTGIASVGSVEF

SEQ ID NO: 1005 - DNA, 3210 bp, Zea mays
aattcggcacgaggcttccttctcctaccccccacaccctcgcccccccccgctcccgcccgccgcgccctcctcctcccagtccgccccacccttccggccctccccctcttttatatccagtaccatggtgatctccgagctcgggtgagctgatgagaatgcggccgatttgaggaaggctgtgggcgcgatggatgcggtttcgggcggattcgcgaggaggctgtagaggttaggttccggtgtcccccggcccggccggtcgtgggagatgagctcctcgtccgcggccagcatcgggcagccgccgccgcccgcgccgccgccggaagaagagaagaagtgcctcaactcggagctgtggcacgcctgcgccggcccgctcgtctgcctccccaccgtcggtacgcgcgtcgtctacttcccgcagggccacagcgagcaggtggcagcgtcgacgaacaaggaggtggacgggcacatccccaactaccccaacctgccgccgcagctgatctgccagctccatgatgtcacaatgcatgcggatgtggagacagacgaagtgtacgcgcagatgacgctgcagccgctcaatccacaagagcagaacgacgcgtacctgcctgccgagatgggaatcatgagcaagcagccgacgaattacttctgcaagacgctgactgcgagcgacaccagcacgcacggcgggttctctgtgccccgtcgtgcggccgagcgcgtcttccccccgctggatttcacacagcagcctccagcacaggagcttattgcacgggatattcatgatgttgagtggaagttcaggcatatcttccgaggccagcccaaaagacacctgctgacgactggctggagtgtgtttgtcagtgctaagagacttgttgctggagattctgtgctattcatatggaatgagaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaattttctataatcctagggcaagtccaacagaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttggcctagttcctattggagatcagtgaaggttggttgggatgaatcaaccgcaggagaaaggccacctagagtttctctgtgggaaattgagccactgacaacctttcctatgtatccatccctgttcccactgcgagttaagcatccttggtattcaggacttgctgctcttcatgatgacagcaatgctttgatgtggctgagaggagtaaccggtgaagggggctttcattctttgaacttccagtcacctggtataggttcctggggacaacagagactccatccatccttacttagcaatgaccatgatcagtatcaagcagtggttgctgccgcagctgcctcccagtccggtggttatctgaagcagcaattcctacaccttcaacaacctatgcagtccccacaggagcagtgcaatctcaatccgctgttgcagcaacaaatactacagcaagcgagccaacagcagatggttagttctgatgctcaaaatattcagtccgtgctcaacccaggtgctattcagcagcagctccaccaactccagcagatgcagcatactcataatgaccagaagcaaaagattcaaccagatcaacagtaccaagttgctagcagtgcggttctcccgagtccaacatcattaccaagccatttgcgtgaaaaatttggcttctctgatcctaatgtgaactcttccagcttcatcagctctagcagcaacgaaaacatgctggaatcaaacttccttcaggtaagttcaaaatccgtggatttgtctagattcaaccaaccagtagttagcgagcagcagcagccgcaacaacaacaggcatggaagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgtagcactgttcacgacggcctgctctactgtgctcgcatgttcgcccgtgtcatctgtagcatgcaccaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtaaaaaaaaaacaaaaaaaaaaaaaaaaaaaaaaaaaaaaaaaaactcgagagggg

SEQ ID NO: 1006 - DNA, 3988 bp, Zea mays
aattcggcgcggggcgaaagcaagcaaggagcaccgcaccacgccactccagtactccactccactctcgtcccctcctcgatccagccatggcggcctagcccccccccccccctcccctagggttctctgccagcccccacccacccaggcgcctcctgccgctcccacccggtggtcgcgctgcccgcgtcgaatgggaggccacccggcgctcggagtcgggcgtgaccgcgcgctgccggaggttccctgagctcggcggcggcgggagcgtggctggtccggagcgcgccgcgcgtgcaatgggaggttcgagtggggttcctgcgagccgccgcggcggtctcggttctgcgagcgcgtggcccatgcttcgcgaagggtagggttgtctgtctgtctagctagctgctagctgcttggtctgatgagctcagctccggcgccccgcctcggcttccccgcgcgcttgctccgtcggctgcccagaacccagcttgcccgctccggcgcttctcttcgcttcttcggggaaaggttggagctttgaggtggtgcgggtgctcagccgaggactccgggcgatgacgcccgcagtggcgcgcgtttgccgcgacagtcctgggttcgggtagcgagttcctcgagcggatttggctgctgctgcgtcctgcgtgggaaggggaggcggcggcggcggcagcagcagaggaaggggaacggttgctctgaagcggagggggagcgggctgacattgcttctgggagcatggcgagcttctaaggacgcgcagctcccgcagcccagccattctcatcgccgcaccttggtgttcttgcccccaggtcgtactggttggtgggagggaacatgaacctctccccgcccaagatgtcggagccatctccggcacgtggcggggaacaaaggtgtctgaactcagagctatggcatgcatgcgcagggccccttgtgtccctgcctgtggttgggagccgggtcgtctactttcctcagggccatagtgagcaggttgctgcatcaactaataaagaagttgatgctcaaatcccaaactatccaaacctacctccacagttaatatgccagcttcataatgtcacaatgcatgctgatgcagagactgaagaggtgtatgcccaaatgacactgcaaccattgagcccggaagagcaaaaggatccttttcttccaattgaattgggtgctggtagcaagcagccaaccaattacttctgcaagacgttgactgcaagtgatacgagtacccatggtggattctctgttccgcgccgagcagctgagaaagtcttccctccattggatttttcacaacagcctccagtgcaagagctggttgcaagagatctgcatgataatgaatggaaatttcgtcatatttttcgtggtcagccaaaaaggcatctactgacgactggttggagtgtttttgtaagcgcgaaaagactagtagcaggggattctatcatatttatctggaatgataataaccagcttctcttgggaattcgccgtgcaagtcgtccacagactgtaatgccctcttctgtgctatcaagcgatagcatgcacattggtcttcttgctgcagcagctcatgctgcagccacaaacagtcgtttcactattttctacaaccctcgggctagcccttctgagtttgtcattccactggctaagtatgtgaaagctgtttaccacacgcgcgtatctgttggaatgcggtttcggatgctttttgagacagaggaatcaagtgtcagaagatacatgggtacgatcacaggcataagtgatctggactcagagcgctggccaaactcgcactggcgttctgtgaaggttggttgggatgagtctacagctggtgataaacagccaagagtttcactctgggagattgagccactgacaacctttccgatgtacccaactgcttttccattaaggctaaagcgtccgtgggcttcaggactacctatgttcaatggtgggaggagcgacgagttcgctcgttattcttctctcatgtggcttcgagatggaaaccgaggggctcagtcactgaacttccagggacttggagcatcaccatggcttcagccaagaatagattatccattgttgggtctgaagccagatacttaccagcagatggctgctgccgcactggaagaaattagagctggggatcatttgaagcaggcatcttctctcctgccagtgcagcagcctcaaactttgaatggtggattagatcctttgtatggaaatcctgttctgcagcagatgcagttccaatctcagcagtcaacactgcaagctgtgcagcaaggttatggtcagaatgcaaacgactctgggtatgttcaaaatcaactgcagcagctgcagctgcaaaagcagcaggagccaccaccaccacagcagcagcagcagacacaagtccttcagcgacaagcacatcaggaaatgcaacagcacctctcagctagttgtcatgatattgctaatgtagcttctggtgtgtccatgtctggatctgcttgtcaatcacaatcttctctgctttctgggtcatcgttctaccaacagaacatctttgatggaaatggtggtccagatctgcatctgcacaacagtttccacaacttttcaagccaagagtcctccaaccttcttaacctcccaagaagtggccaattaatggcatcagagggatggccttcaaagaggttggctgtggaatctcttgctggtcatgagatccaacctctgcagcacaagcttgagaaagttagtcaccagagtactgtgtctcactgttctggcaccttgccgccactatcagcaagagacggttctagtgcccaggcttgtggtacaaatgttcagagtcacctgcttccatcatcatttgcaatccatgatggattgtcaaccatcaggagtggtggtgttggcagtggaactgatgcgataaccatagcttcgttgagatatagtgatgcgaatttgctacctgaaaactccatagcaacttccagttgtttgggtgaatcaggaaccttcaattctcttgacgatgtttgtggtgtaaacccatcacaaggtggaacctttgtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtagggtgcataaagatcctctcgccgcaagacctgcagcagatggcccgcggcggcggaggtgaccttctgtctgcgcctggagcgaggatgctgcagggcagtgtctgtgacgactattctgcaggccacgacgtgcagaacctcaccggcagcattgcgcctgtggtgcctctggactactgaagaggactgaggcgaaggccgggatctgaagctctgaaccaaaaccggcaatccagcatttgcaggatttgccatccgcaagtcgtttcgttcctgtgttatgatcctctcagtctcaggccctgttgatcgggaataacctagtcgtttaatatagctagatgatgatccatgtatcattatggtaatggacatgctgtacgatagctactgtagctctaaatgcaggcaaggcaagaattgatctatcaaagaacgaatgaatgcaggcactcactgtagaggtgatctagccctgtactcctaagtcctaagatatattctcatagctaaaactgatggttccatgtggcattggcacccaagctattgaaaccagtcacctttgccgattcctcctgcgaaaaaaaaaaaaaaaaa

SEQ ID NO: 1007 - DNA, 2886 bp, Zea mays
gtcgacccacgcgtccggtctacctccgcagcttatatgccaactgcataatgtgactatgcatgctgatgctgagacagatgaggtgtatgcacagatgacactgcagccactcagtccacaagagctcaaggacccatttttgcctgctgagttaggcactgccagcaaccagccaacaaattatttttgtaaaacactaactgcaagtgatacgagtacacatggtgggttctctgttccacgccgagcagctgagaaggtgtttcctccactggatttcaatcagcaacctcccgcacaggagttgattgcaaaagatcttcatggcaacgactggaaatttcgccatatttttcgaggtcagccaaagcggcatcttctgacaacaggttggagtgtctttgttagtgcaaagagactggttgctggcgactctgtcctttttatctggaatgacaacaaccagctgcttctgggaattcgacgggcaaacagaccacaaaccgtcatgccatcatcagtactttctagtgatagcatgcatattggcctgctcgctgctgcagctcatgctgcatcaacaaatagtcggtttactatcttctataatccaagagcaagcccttgtgaatttgtcatacccatggctaagtatgtgaaagctgtgtaccatacccgtatatctgtgggcatgcgtttccggatgctttttgagacggaggaatctagtgtaaggcgttatatggggacaattacaggaataagtgatcttgatcctgttcgctggccaaactcgcactggcgctcagtaaaggttggatgggacgagtcaactgctggagagaagcagccaagggtatctctttgggagattgaaccgttgacaacttttccaatgtatccatctccttttgctcttggattaaagcgcccatggcctgcaggcctgccttctttatacggtggaaggggtgatggcttgacctcttctcttatgtggcttcgagacagggcaaacccgggtttccagtcactgaatttcagcgggcttggtatgagtccctggatgcagcctaggctggataattccttacttggtctccaatctgacatgtaccagaccatagcagcagcagcagcattacaaagcactacgaagcaagttccaccttcagcaatgcagttccaacagcctcagaacattgctgatagatctgctcttctatcaagtcagattctgcagcaagtacaacctcggtttcagcaaatttaccctcaaaatctcaacgaaaacaaaattcaaggtcatacacaacctgagtacctccaagtccaacagcagcttcaacgctgccaatcatttaatgagcagaagcctccgatgcatccacagcaacaacagcaggaaccacagcagcagcaatgcgtccaaacaccacaggatcaacaaatgcaagaacagaagcatctgcacaacttccactccttgccagatgcattatcggccttttctcagctttccccagccactcactccccaccttccgcattgcagacagttccagcattctcgcatcaacaaaacttcccagatacaaacattagctctctctcaccatctactggcccttcaatgcatggcatgttggggagattaccttccgaagcagcttcgagcctcccatgtgtggcaatgaacgcccctgtatcggtatctgacccatggtcatccaagagagttgcagtggagtctgttaacccttgtcgacctcatgtttcaccacatatagaacatttggatatggcgacgtgtaacatgccgcagagctctgcactagcaccattacctggacgagaatgcctagtggatgaagatgggtgctctgatcctcaaaatcacctcttgtttggtgttcacatagactcacattcacttctgatgcaagggggcattccagcccttcagaatgataacagttcaggcactattccatactcaacctccaatttcctgagcccttctgataacgatttccccttgaatcaaccgctacgcagcgctggctgcttagatgagtcggattatcttccatgtgcagagaatgccgaacaggcaaatcaacagtttgcaacctttgtgaaggtttacaaatccgggaccgtcggaaggttgctcgacatcactagattcagcagctacgacgagctccgtagcgaggtggggcgtctgtttggcctcgagggccagctggaagaccctttgagatcaggctggcagcttgtatttgttgacagggaggacgatgtccttctggttggcgatgacccatggcaggaattcgtgaacagtgtgtcctgtataaagatactttcaccggaggaggtccagcggatgggaaagccgggcatccagctcctgagctcggctccttcaagaaggctgggcaatggctgcgacagctacgcgagcatgcaggagccgagaggcctggacgctgggatggcgccggtgggttcggtcgagttctgaagacggcggagggaagcccaccatggccctcgggtcgaggattactctccctcctgtatgtttctgcagcacttgctagctctgcgacttggaacaaagcacgtagatcaaatggagctctgtgctgctccccgtctgatgatgtcttatggtatagactcgtagcagtaactactacatgttgtatacatgccggcacttcagttcttatcgagtagcaataccgctagtttagtccatccaatcaactacgttcttgttcctatgatcctgttgttgcgatgcagtaaaactttttttttcgtcataaaaaaaaaaaaaaaaaaaaaaagggaaaaaaaaagggcggccgc

SEQ ID NO: 1008 - DNA, 3033 bp, Zea mays
ccgcttgtttccttgcccgcggtgggtagccgagttgtgtacttccctcagggccacagcgagcaggtagcagcatcaacaaacaaggaaatagagtctcagatccccaactatcctaatctgcctgccacagcttatatgccaacttcataatgtgacgatgcatgctgatgcagagacagatgaggtatatgcacagatgacactacaaccactcaacccgcaagaactgaaggacccatatttacctgcagaattaggttcggccaataaacagccaacaaactatttctgcaaaacattaacagcaagtgataccagtacccatggtgggttctccgttccccgtcgagcagctgagaaagtgtttcctccactggatttcacccagcaacccccatgccaggagttgatggcaaaagatcttcatggcaatgagtggaaattccgtcacatctttcgtggccagccaaagcggcatcttctaactacaggttggagtgtctttgtaagtgcaaagagactcgttgctggcgactctgtcctttttatctggaatgacaataaccagcttctgctgggaattcgtcgtgcaaatcggccacaaactgtcatgccatcttcagtcttatcaagcgatagcatgcatatcggtcttcttgctgcagctgctcatgctgcttcgacaaatagccgatttacaattttttacaacccaagggcaagcccttcagagtttgtcataccactcgtaaagtatgttaaggctgtgtatcatacccgcatatctgtggggatgcgattcaggatgctttttgagacagaagagtctagcgttaggagatacatggggacaattaccggaatctgtgatcttgattctgttcggtggccaaattcacactggcgttctgttaaggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggtgggaaggatgatgacctggctaactctctcatgtggcttcgagataccgcaaatcctggttttcagtcgttaaattttggtggacttggtatgagcccttggatgcagccaaggctggatgctaccttacttggtctgcaacctgacatgtatcaggcgatggccacagctgcttttcaggatgcaacaaagcaggcatcgcccacaatgctgcagttccagcagccccagaacatagctggccgggcttccccgcttctttcaagtcagattttgcagcaagcacatcatcaatttcagcagcaaccgtaccttcaaaacatctctgagagcacaatccaagcacagggtcagtctgagttcctcaagcagcagatccaacgcagccagtcattcaatgagcagaagccccagatgcaacaccagcaagaatcacagcagcagcagcaaccacagtgtctgccagtcccccaacatcagcaaatgcaacaacagaatatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtatggagaaatactaatcatctggatgtagccaggcctatgctctctaatggttgatcgggtaatacagcccctcgcacacaaaaataagtcgacgcggccg

SEQ ID NO: 1009 - DNA, 931 bp, Glycine max
attaatcagaataaatcttgatatcaaaaaaatgaaatttacagaagatatcaaaaaattgtaagttatatgtttttttgatgatttgataatctccgtataagtacttacgttttctatgtttatatagtaaaagaagaaaagagaaaacttcaaggcaattgccaaatgcgatcctcaaaatgctttgctttgtcaaaatatcttcagcagttatcagtttcctcatcagtagcagttgaactgatccccacctgcaaccatggcgaagaactgccaccagctttcatgtcctttagctcactcagtttcgccaacttgatcttactatcagcttcattatccatgttttgcattgagttgttgttgttgttgtttttgtcctcatcattgtcaacatcaacattgttattagggttatggagactttgacaatggctattattggtatcatctttagcatcctttgatgcaacccaaggctgcaagtaaaattctgtgttcacattccttcttgcaaggtcattagagggtgcaggaaggttaaggtctaatttgagatcaagaggctcggaagaggtatcaaatttgggtatttgatccaagtgctcttggaattgttgaaatcttgttaatgtggaggtgtcaggagcatttgaagtgatccaatggcaccttttgtgtccccccaatgcttgtcccgaagagaagctcctatggcaaatggagcattcatgcactttggattttctcttggaggaagaggccaatgagggattggagcttccatggtcaaattggagggtggagtttgattttgtagggaaaaactcttcatgtgtgatgacatcatcctccatgagatcgtcatcaaggttgtctagccttgcagcaaagcaacccttgacctttttgtggcttgcctcgagcc

SEQ ID NO: 1010 - protein, 558 aa, Oryza sativa
MQPSPSSPRAPPPTAAQASGYKHFCRVCNKGFTCGSALGGHMRAHGVGDGDGLGADDDDDDDDDSLGDEAVRRARGGADDPWNAGGPSSSGAATHVYELRTNPNRVTRSRQVCKNCGKEFTSWEHFLEHGKCSSGEDDDDEDDVDHSLQPWSPSPEADGEEDSAPAAGWLKGKRSRRCKGTGVDLSPTPSACAAGEEEDLANCLVMLSSSKVDQAGVTEAEQRSSSSASKEHKRLITFMEPTTYVLDTVMALPPPAPAPQYVSTVPRGMFECKACKKVFSSHQALGGHRASHKKVKGCFAAKLESNAAEVAEPSHHAEVADRSEDNPAKATSDARRNVHASIDGDGNAGTSDAAAELSMAIVPIEPPVAALAAAPLKKKGKMHECSVCHRLFTSGQALGGHKRCHWLTSSSADHTASVPPLADDLVPLSFRPMLDAPEPALDLSIAANPPLLASAATVRPKVGGSSFHLDAPPPVYIPSSPAIPSQRNKATATTGSQNANDAVGLSTAAAEDEADSTTVKRARLSDLKDVSMAGETTPWLQVGIGSSSRGGADDNDKE

SEQ ID NO: 1011 - protein, 694 aa, Oryza sativa
MVGGDLTGAFPLRPCLQGHHAPGARGALPHYDPQVRRLEVDSAGFLLHLLSLCYFQRPNKTWVGKRRGERGKFGSPRFRQVGYSEGEWMYWRADLVGARGWVGRIKLPHKRHVNVTWDKDLVKGATFRRTRGIAAIMQPSPSSPRAPPPTAAQASGYKHFCRVCNKGFTCGSALGGHMRAHGVGDGDGLGADDDDDDDDDSLGDEAVRRARGGADDPWNAGGPSSSGAATHVYELRTNPNRVTRSRQVCKNCGKEFTSWEHFLEHGKCSSGEDDDDEDDVDHSLQPWSPSPEADGEEDSAPAAGWLKGKRSRRCKGTGVDLSPTPSACAAGEEEDLANCLVMLSSSKVDQAGVTEAEQRSSSSASKEHKRLITFMEPTTYVLDTVMALPPPAPAPQYVSTVPRGMFECKACKKVFSSHQALGGHRASHKKVKGCFAAKLESNAAEVAEPSHHAEVADRSEDNPAKATSDARRNVHASIDGDGNAGTSDAAAELSMAIVPIEPPVAALAAAPLKKKGKMHECSVCHRLVTSGQALGGHKRCHWLTSSSADHTASVPPLADDLVPLSFRPMLDAPEPALDLSIAANPPLLASAATVRPKVGGSSFHLDAPPPVYIPSSPAIPSQRNKATATTGSQNANDAVGLSTAAAEDEADSTTVKRARLSDLKDVSMAGETTPWLQVGIGSSSRGGADDNDKE

SEQ ID NO: 1012 - protein, 265 aa, Oryza sativa
MDANTIGASADADGKAAASGVGAGEIVLAGASSTDMAMMMSVEDFAPTPLAPSAVSPFKKKGKVHECSICHRVFTSGQALGGHKRCHWLTSGATDPLTKLQPVAQDHAMMAAMCHQLTLGRPIFDPTDQRILDLNVPTNPLAEAVAARQQQQQQVAALNDGALCLNAAASVYLQSWTGHSNGSHVNKTTATSSRINDAAGGVTTEDDEADSTSAKRAKIGDLKDMKGQGSRCPGCRLASEFHQRAKKRTLKRNLVMTRRSCRLMN

SEQ ID NO: 1013 - protein, 195 aa, Oryza sativa
MSQKTSKDEVIGGRSPSGDGDKAEEELREARSGDDDDDDEAGTRQPYNCTFCRRGFPTAQALGGHMNVHRKDRVGRATPSSSSSTTAAAARRSVSYDTLVRLFRPPASGGSEDAAASTAAGGGASLRSRTAEPAPQELRLFGRGAGRREEGGGRDRRDRYGCCSKDGDGNGGHDHGEEEELDLELRLGGSGSAGS

SEQ ID NO: 1014 - DNA, 1337 bp, Glycine max
gaattcggctcgagggatggctcatttatcatagtagtgcttcctcctttaccatttgaccatatttatccatctcaatcacttcccactttttatgagcattggccaacccccacgcttcctttattctccctctcaagcttcaagctactcacaccaatgaagatccagtgcgacgtttgcaacaaacacgaggcctccgtcttctgcaccgccgatgaagccgccctctgcgacggctgcgaccaccgtgtccaccatgccaacaaactcgcctccaaacaccaacgcttctctcttctccgcccttctcctaaacaacaccctctctgcgatatttgccaggagagaagagcctttacattctgtcagcaagacagagcgattctctgcaaagagtgtgacgtgtcaattcactctgccaacgaacacacccttaagcacgataggttccttctcaccggtgttaaactttctgcttctgctatgcttcgttcgtcagaaactacctctgattcaaactcaaacccttctcttcttaacttttcacaccaaacaacattactacctccatcttccaccaccaccaccaccaccagcaacaacaacaacaacaaggttgctgttgaaggaactggttcaactagtgctagcagcatatcggagtatttgatagagactcttcctgggtggcaagttgaagactttcttgattcatattctgttccctttggtttctgtaagaatgatgaagtgttgccacggtttgatggtgaaatggaggggcatctgagttctttctcaaccgagaacatggggatctgggttcctcaagcgccaccaactcttatgtgttcttcacaaatggatcgggtgatagttcacggtgagaccaatatcaaaggtagcagcagatcaaggttgaaggatgataatttcactgttccacagattagtcctccttccaattccaagagagccagatttctgtggtagaaacaaataaacaaacaaacaagcctcagtttccattctcttgaggcagaattaacaaccctctttgttttgttttgtcccttttctctttttcttaccctggcttgtagtttactctgcccatgttttcaatttggttcagtttgactttttttttttccctttttcttgtttctcctccctctttccctactgggctgtgttttgataaatttgtgcacctttctactagtgattgtaaatataaaccttttcaaatgcatgttgttttttgacacatgtttagaagagaaacaacagagtatgagcttaatagatatgttgagtaaaattcccccccc

SEQ ID NO: 1015 - DNA, 1173 bp, Glycine max
attcggctcgagccttcctttattctctcctcttaaacctttcacttcaagcttcaagttttcaagctacccacccactgctcatactcacacccaatgaagatccagtgcgacgtgtgcaacaaacacgaggcctccgtcttctgcacagccgacgaagccgccctctgcgacggctgcgaccaccgtgtccaccatgccaacaaactcgcctccaaacaccaacgcttctctcttctccgcccttctcataaacaacaccctctctgcgatatttgccaggagagaagagccttcacgttctgtcagcaagacagagcgattctctgcaaagagtgtgacgtgtcaattcactctgccaacgaacacacccttaagcacgataggttccttctcactggtgttaaactcgcagcttctgccatgcttcgttcatcacaaactacctctgattcaaactcaaccccttctcttcttaacgtttcacatcaaactactccacttccatcttccaccaccaccaccaccaccaacaacaacaacaacaaggttgctgttgaaggaactggttcaacgagtgctagcagcatatcagagtatttgatagagactcttcctgggtggcaagttgaggactttctcgattcatattttgttccctttggtttctgtaagaatgatgaagtgttgccacggttggatgctgacgtggaggggcatatgggttcgttttcaaccgagaacatggggatctgggttcctcaagcgccaccacctcttgtgtgttcttcacaaatggatcgggtgatagttcaaagtgagaccaacatcaaaggtagcagcatatcgaggttgaaggatgatactttcactgttccacagattagtcctccctccaattccaagagagccagatttctatggtagaaacaatcctctttgttttgttttgttttgtgccttctctctttttgttaccctggtttgtagcttactcttgcccttgttttcgatttggttctgtttgactttttttcttcttctttttcttggttctcctccctctttccctaccgggctgtgctttgaagtattgataaatttgtgcacctactagtgattgtaaatataaaccttttcaaatacatgttttttttgacacatgtttagaat

SEQ ID NO: 1016 - DNA, 857 bp, Glycine max
attcggcgcgagcaaaagcaaaagatgaagatccagtgtgatgtgtgtgacaaagtggaagcctccgtcttctgtcctgcagatgaagctgctctttgccatagctgtgatcgcaccattcaccgcgccaacaagcttgcaaccaaacacgcccgtttctctctccactaccccacctccaaagacttccctctttgtgatatatgccaagagaggcgtgcatatctattttgccaagaagacagggcgttgttatgcagggaatgcgacgttcctatccacagagccaatgagcatacccaaaagcataacaggtttcttctcacgggtgtgaagctctctggtacttgtttagatcctgcttcgtcctccaccaattacaccaataataatagagtcactggctctgaaggaagaaacgacgctcgatctagaatgaacagacccagatcatcagtttccaatgaagaaaatgcaagtaattcttcttgcaaggttgaagacaacgtggctagtgacactggttcgatttcaactagcagcatttctgagtacttgattgaaacaatacccggttactgttttgaagacctccttgatgcttcgtttgcacctaatggtttctgtaagaagcagaactttgatcatccctgggcgtttcaggaccaaaagcgaacaagtggagacactatggccgtgccgttcctgaaactagtcatccattgatcaaaatatctaaaccctcgcggtcataaactgtttgtaaaaatctgttggaaaatatcttctttatttttgttatttgtaaaaatctgaaactttatgattttattttttattctctattcccaaccaca

SEQ ID NO: 1017 - DNA, 1242 bp, Glycine max
acggctgcgagaagacgacagaaggggaatctttttgtaagaacgtgaaacatgacaccctaactcgcgttgcttgcttgagtgatttgactcgtgtcgagtgtattgtatttagtttaagcgtggctgatcgagtgagtatcagaatcaattcaattttgagctagtcatgaagatccactgcgacgtgtgtaacaagcaccaggcctctttcttctgcaccgccgacgaagctgccctatgcgacggctgcgaccaccgcgtccaccacgccaacaagctcgcctccaaacaccaacgcttctccctcacccacccctctgcgaaacattttcccctctgcgatgtttgccaggagagaagagccttcgtgttttgtcagcaagatagagcgattctgtgcaaagagtgtgacgtgcccattcattctgccaacgacctcaccaagaaccatagcaggtttcttctcactgggattaagttctctgcttctgccacgccttatgattattcatcaccaccaccaccaccaccaccaccacccaagagaaaccctgttctcgattctccttcaacaccgtcaccgcctaagcctgggggaaactcgctaacaaacgaagaagaacctggtttcacaggtagcagcatttcagagtacttgataaactctatcccaggcatgaagttcgaagatttcctcgattcacattctcttccctttgcttgctccaagaatagtgatgacatgttgtcgctgtttggtgagggaaacatggtttctttctcacccggtgggttctgggttcctcaagcaccaccatcttcagtacaaatggatcggcagagtgggtacagagagacaagggaaggtagcattagatcaagttttggagatgataatttcatagttccacagatgagtcctcccagcaatgtgtctaataagagatccaggcttctctggtaaaacagatatagctagttacaactagctaacccccttatgtggctttgtgtgacttaaatttcactctcccctcctattttgtattttttatgtggtattgttttaatttttgtttgttcgtttggttttggtccctctcccttcctgaactacactactcttctagctactttctctcttgataagttggtgtatctcttccaaattgtaaatatgaacgttttaagagctctctgggttgagataaaaaaaaaaaaaaaaaaaaaagcggccaa

SEQ ID NO: 1018 - DNA, 1111 bp, Glycine max
ggctcgagttcaaatcctcctttctattaatctgaaacaagttattagtcatgaagatccagtgcgacgtgtgtaacaaacagcaggcatcgttgttctgcaccgccgacgaagccgccctatgcgacggctgcgaccaccgcgtccaccacgccaacaagctcgcctccaaacaccaacgcttctccctcagccacccctctgcaaaacattttcctctctgcgatgtttgccaggagagaagagcctttgtgttttgtcagcaagatagagcgattctgtgcaaagagtgtgacgtgcccgttcattctgccaacgacctcaccaagaaccataacaggtttcttctcactgggattaagttttctgccctcgattctccttcaacacctcctaagcctgcaggtggaaactccctaacaaatcaacaaccacaacaacaaactggtttcacaggtagcagcatatcagaatacttgataaacactatcccaggcatggagttcgaagatttcctcgattcacattctcttccctttgcttgctccaagaatagtgatgacatgatgttgtcgatgtttggttgagggaaacatggtttcgttctcagccggagggatctgggttcctcaagcaccatcttcagtacaaatggatcagcagagtgggtacaaagacacatgggaaactagcattagatcaagttttggggatgatagtttattagttccacagatgactcctcccagcaatgtgtttaataataagagatccaggcttctatggtaaaacagttacagctagctatcaagctaaccaccttatgtggcttttaatttcactctattcttaatttggttttctttgtttttttgtccctctcctccttcctgagtactacactactcttctagctacttaattccctcttgcgttctcgataagttgatgtatctcttccaaattgtaaatgtctatgttttaagagctctctgggttcagattaattgtttctgctacatgttaaaagatgactcaagtcttaattaacattgcataaatgaaccggaagaagacttaggcgatatcttcaaaaaaaaaaaaaaaaagg

SEQ ID NO: 1019 - DNA, 1018 bp, Oryza sativa
  misc_feature (202)..(202): n is a, c, g, or t
ggcgactcgagcaaccacgcggtcgcagaagaaagagagagagagagatggcggcatgagcacctcctcctgcatcgccacctcccccgatcccccgcaaaccctagcgaccgcgccccccaccgtcatccttctctgcggcggcgccctggtgaggagggaggaggaggatggggaggtggagagggcggtcgctgcgacntgtgcgcggccgaggccggcctcggtcttgtggtgggcggacgaggccgcgctgtgcgacgcgtgcgaccgccgcgtccacagcgcgaacaggctcgccgggacgcgccggcggttctgcctcctccgaccggtggcgtggtggtggtccgcccagaagccaccggcgggcgcctcccgtcaggagaagagggggttcttgttctgcaaggaggacaggggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccgcctcctcctcctcagacgggctatttcaggtcagttcatccactgttaacgatccaaactttccatggcaacgaaaacctgaatacgtattcagtccggttcatgcatgaaaccctgaaaaaccaatccacacacgttcttgtgagcaccatgaacgaagcacaggcaaagcacggcgcgccaaactctgttcaggccctgccggccgtcgtgggcacataagccaatctgttcacaatatcgtgagcggacaaattttaccatgcaggtagtttgtagtcatgctcacacagctagcaataac

SEQ ID NO: 1020 - DNA, 478 bp, Oryza sativa
gcacgcctcggacccgtccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagacatgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggagaagagggggttcttgttctgcaaggaggacagggcgatcctgtgccgggagtgcgacgtcacggtgcacaccacgagcgagctgac

SEQ ID NO: 1021 - DNA, 1393 bp, Oryza sativa
  misc_feature (1378)..(1378): n is a, c, g, or t
  misc_feature (1380)..(1380): n is a, c, g, or t
  misc_feature (1387)..(1387): n is a, c, g, or t
  misc_feature (1390)..(1390): n is a, c, g, or t
tttgttccctccacttcggcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtagggaggggagcagcatctccgactacctcaccaccatctgccccggctggcgcgtcgaggacctcctccccgacgacgacgccttcgccgccgccgccgcgcaggcggggaaagagaaggacgagcgcgtgccgttcctcgacgccgacctgttcgacgtggtcgcccgccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgtaaaantnaaaaaanttnaaa

SEQ ID NO: 1022 - DNA, 427 bp, Oryza sativa
ccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcagagcgagctcaccatgcgccacagccggtacctcctcaccgtgcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccact

SEQ ID NO: 1023 - protein, 250 aa, Oryza sativa
MKVQCDVCAAEAASVFCCADEAALCDACDRRVHSANKLAGKHRRFSLLQPLASSSSAQKPPLCDICQEKRGFLFCKEDRAILCRECDVTVHTTSELTRRHGRFLLTGVRLSSAPMDSPAPSEEEEEEAGEDYSCSPSSVAGTAAGSASDGSSISEYLTKTLPGWHVEDFLVDEATAASSSSDGLFQGGLLAQIGGVPDGYAAWAGREQLHSGVAVAADERASRERWVPQMNAEWGAGSKRPRASPPCLYW

SEQ ID NO: 1024 - protein, 337 aa, Oryza sativa
MRVQCDVCAAEPAAVLCCADEAALCSACDRRVHRANRLASKHRRLPLVHPSSSSSGDGGAAAAPLCDVCREKRGLVFCVEDRAILCADCDEPIHSANDLTAKHTRFLLVGAKLSPAALAEQPLPSSDCSSDDDAAAAATEEEYHSSAASTGAAVSAPLDASSNGAGGGGGVGGSSISDYLTTICPGWRVEDLLPDDDAFAAAAAVSTTNPSLRRVLATSPSMKPRLTYDSLEQQAGKEKDERVPFLDADLFDVVAGRPEKKGGAWAPHVPHLPAWCLDEVPVVVAASAAPAATPVKAKQGHVRDSHWSDSDAFAVPEFSPPPPPAKRARPSSQFWCF

SEQ ID NO: 1025 - DNA, 700 bp, Zea mays
  misc_feature (163)..(168): n is a, c, g, or t
  misc_feature (594)..(594): n is a, c, g, or t
  misc_feature (596)..(597): n is a, c, g, or t
  misc_feature (609)..(609): n is a, c, g, or t
  misc_feature (636)..(637): n is a, c, g, or t
  misc_feature (664)..(665): n is a, c, g, or t
  misc_feature (669)..(669): n is a, c, g, or t
  misc_feature (690)..(690): n is a, c, g, or t
gaattgttctctgtttcttttaagcggcaatgaagatccagtgtgatgtgtgtaacaaacacgaagcttctttattttgcaccgccgatgaagctgccttatgtgattcctgtgaccaccgtgtccaccatgctaacaagctcgcctacaaacaccaacgttnnnnnnttaatcacccttctgcagaacatttccctgtctgtgatgtttgcacggagagaaaggcttatgttttttgtcagcaagatagagcgattttgtgcaaagagtgtgacttgcctattcattctgcaaacgaacataccaagaagcataataagtttcttctaactgggattaagctctctgcttctgccaccctttattcatcactaccctcttctaattccaagtctgtgatgaaaaatcctgtgattgattcttcttcacaacaacctttgatggataagacttcttcttcaacagtatcagtgcctcccaccatcagcaaggctaatgaagaagctggtttcacaagtagcatatctgagtacttgataaatactatcccgggttggcaatttgaagatttgctcaattccccttctcttcctntnngtttctctaagnatggtgatgatatggtgtcactggtgnntggtgatgttgggggaaatatgttttnnttcncaccacccgagagcattggtnggatctggga

SEQ ID NO: 1026 - DNA, 1364 bp, Zea mays
gaattcccgggtcgacccacgcgtccgcccacgcgtccggtcctctcctctgtctctctctctttgagcctcctttttcaacctaacctttgacgctgtagctcgagagcaagcatagtgcctagtgcctaccagattctctccctgagcggctgagctctgccgatccgcgataggctcgcgccatgcagatgctctgcgacgtctgcgccgccgcgccggccgccgtgatctgctgcgccgacgaggccgcgctctgctccgcctgcgaccgccgcgtccaccgcgccaacaagctcgcccacaagcaccgccgcatccccctcgcccagccctctggcgacgaatccgacgccgacgccaagccgctctgcgacgtgtgtaaggagcggaggggcctcgtgttctgcgtggaggaccgcgccatcctgtgccccgactgcgacgaccccatccacagcgccaacgacctcaccgccaagcacacccgcttcctcctcgtcggggccaagctctcagccgcgctcgtcgacgcccaggcgccccactcccctgacgacgacgacaacgactgcggccgcggcaacggcgccgccgccgagcccgacgctgtccccgccgtctgcgcgcagggctcctgcgcggccaaggcctcgtctcttgagtccggtggcggcggcggcggcggcagcggcagcggcagcagcatctccgagtacctcaccaacatctgcccaggctggcgcgtcgacgacctcctctttgacgactcggcgttctcagcggcatcgaaggccgacagctgcgacgacgggcacgagcaggtgccgtccctggacgccgacctcttcgacgtggtggctggcgccggctggccggggaagcgcggcagcgcgtggtcaggagtcggagctctgggcttcgacaaggtgccggcctccgttgttgtcgtcccgacggcggccaagcaacagcaggggtgcgtgagggagaggacctgggactcggacagcgacagcgacgtgttcgcggtgccggagctcccgcaaccaccgcaggccaagaaggcgcggccggcgccggctccggcgccgactttctggtgcttctgagctgcactgtcccagtccggtccggccggcctgtgtgcactgtgtacttgccgtgacttctgtaaccagtgtgtgtgagcgagcttgctcgtgctttttacccatgtactgttgttactgcatacacacacacacttaccactactattagtagctagcagtgctcaaacccaagttaattaagtttggcgcagtttatattatgacttaatcataaggtgattttgcggcggccggtcgagatcttgaact

SEQ ID NO: 1027 - DNA, 779 bp, Zea mays
ctcgaggccggcccggcccgccatgtcctctcctctgttcctctccagcccccttttcaacctttgacgctgtagcttgagagcgagattagtgcctaccatattctcctcctgagcgactgagcgctggtctccgataggctcgccatgcaggtgctctgcgacgtctgcggcggcgcgccggccgccgtgctctgctgcactgacgaggccgcgctctgctccgcctgcgaccgccgcgtctaccgcgccgacaagcgccgccgcatcccgctcgtccagccctgcggcgacgactccgccgccgccgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgcgctcgtcgaccaggcgcccccctcccctgacgacgacgacgacgacgtcgccgagcccgacgctgtccccgccgcctgcgcggccaaggcctcgtctcttgagtccggcggcggcagcagcatctccgactacctcaccaacatctgcccgggctggcgcgtcgacgatcttctcttggacgactcgtcgttctcagcgccatctaagaccggctacagcgacggccacgatcaggtgccgtccgtggatgccgacctcttccacgtggtggccagcggccggccaggcaagcgcgtcggcgg

SEQ ID NO: 1028 - DNA, 1627 bp, Zea mays
cgggatggtctacaaccgtatgcgtactttatcagttaactgcccatgatctagcagtggtccaatgtttgtcctagactcctagggggaaaaaagatctgcactttgtgctgtgctgtttcttcttcttgttgttgttgtacgtagcgccgagatttcccagcaccgcttgcgatttagaaacccacagtttgttctttttcgtttaggggatggctgtacactgctgctgcttcttactaatgatagaaaggagaggtgaagttcgcagttgctgagatagacagatgatagaaggcaacgctagctaccgcgagggggaggaagatgagcaatcgggaaagcacggcatcaagcaagttgttgccttgtagttgtaggagtgtccttattgcgactttgtcaccctggtgacctgagcgctcccacgcggccatgtctgatgaattacggcggcccattcgctcccatcagcaaacacccacgaatggccaatcgttgcccagcagcagcgggcttcagtattcgtcaaccaaattgtcagagagagtccttttgcgccccccggggcgcatactacagaggaggttgagcggagtaggcggcggccagcaatgaaggtacagtgcgacgtgtgcacggccgaggcggcctccgtcttctgctgcgccgacgaggccgcgctgtgcgacgcatgcgaccgccgtgtccaccgcgccaacaagctcgcggggaagcaccgccgcttctccctcctgcacccgtgttcttcctcttcctcctccgccgcgcacaagccgccgctctgcgacatctgccaggagcggaggggcttcttgttctgcaaggaggacagggcgatcctgtgccgggagtgcgacgcgccggtgcacagcgccagcgacatgacgaggcggcacagccggttcctgctcaccggcgtgcgcctctcgtcagcgccggtggactctgcgggcccatccgaagaggaggagcaggagaacagccgcggcccctgcaacgacgaatcctgcagcagcggcagcggcgccggcggcgcgaccacggcgaccgccagcgacgggagcagcatctccgagtacctgaccaagacgctgcccgggtggcacgtcgaggacttcctcattgacgacgcgtccgctggcgacgtcggcgcctgctcggatggcctctatcagggacaaaatggacagatcagtggggtgctgcaagaagcttacctgccgtggacggagcgggagcaggtgcaaactgacgtcgcagacgagcgggccagctgggagcggtgggtgccacagatgcatgcggagttcggcggcggcggcaagcgacctagagcgtcgccttcgcctccctgttcgtactggtgattggtgaaaagttcgccgtcttcagcaagatgatttgtattgggctaattagtagagctactgtaggaacgaccgaaaaatgagccaaaaaagtaacggcctccatcgagctcgttttaaattattctctgcctaaagccaaactttcagaaaggagaacggtattttcctgttcgattaattaggtcgatttcgatcgaactcgttccaaaaaaaaaaaaaaaaagggcggccgc

SEQ ID NO: 1029 - DNA, 835 bp, Zea mays
ggtctagctaggactagtaagtagcataccattaccatcctccgcgcggctagctccggctcgctttcatccatacgattgcccggagctcaagccctgagctgagccgccagagcgcgcgcgatcatcgcttgagggaaaagcagagtggagtggccgagatgaaggtgcagtgcgacgtgtgcgcggccgaggcggccgaggtgttctgctgcgccgacgaggcggcgctgtgcgacgcgtgcgtaccgccgcgtgcaccgcgccaacaagctcgccggcaagcaccgccgcttctcgctgctcagcccggcgccaccgccgccgccgccgctctgcgacatctgccaggttcactcgatcatccatcccccgatccccgtgcaaaataaatctcttcggacggcgttctttccgattgttcagcctgccaggtgtgccctgcctgcctctgatcgatatgcatgcaggacaagcgggggctcctgttctgcaaggaggaccgcgccatcctgtgccgcgactgcgacgtgtcggtgcacacggccagcgacctgaccatgcgccacgcccggttcctgctcacgggcgtccgcctctccgccgagcccgccgccgcgtgcccggcgccggaggatgaggaggaggaggacgacgagaacagcagcggcagcttctgctgcagcgccggcgacgcagccgcacatcctcctcctcttccgtcgtcggcgcccgccaccagccacgggagcgacagcagcagcatctccgagtacctcaccaagacgctgcccgggtggcacgtcgaggacttcctggtggacgaggcggccgc

SEQ ID NO: 1030 - DNA, 727 bp, Zea mays
  misc_feature (477)..(477): n is a, c, g, or t
  misc_feature (481)..(481): n is a, c, g, or t
  misc_feature (490)..(490): n is a, c, g, or t
  misc_feature (492)..(492): n is a, c, g, or t
  misc_feature (499)..(499): n is a, c, g, or t
  misc_feature (587)..(587): n is a, c, g, or t
  misc_feature (642)..(642): n is a, c, g, or t
  misc_feature (644)..(644): n is a, c, g, or t
  misc_feature (708)..(708): n is a, c, g, or t
ccggccgggctttcctgctaagccccggctagctaggaagtatcactagtagcatcccccatcatccagcctcgcggtcgctacagttagcttcgctttcctccagcccatccttctatacacgattgacctgagctgagccgcctcccgtctcgagagggagggagagggagagggagagcgagagctagcgcgcgcgatcgcaaagagagcggtgaaagatgaaggtgcagtgcgacgtgtgcgcggccgaggcggcgtctgtcttctgctgcgccgacgaggccgcgctgtgcgaggcgtgcgaccgccgcgtgcaccgcgccaacaagctcgccggcaagcaccgccggctctcgctgctcggcccggcggcgccgtcctcgtcggcgcacagacacccgccgccgcctccgctctgcgacatctgccaggagaagcgcgggctcctgttctgcaaggaggaccgggcgatcntgtnccgcgactncnacgtgcnggtgcacacggccagcgagctggcaatgcgccacacccggttcctgctcacgggcgtgcgcctctccgcagagcccgccgcgcgcccnccgccgtcggaggaggacgagaacgacagcagcagcagcagcatctccgagtacntnaccaagacgctgcccgggtggcatgtcgaggacttcctggtggacgagaccgccgccgcaactnccattggcgtctccgcaga

SEQ ID NO: 1031 - DNA, 1033 bp, Oryza sativa
ctcctcctctctgatatgttactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggtttcgggtgaatccaatcaacagttcaatgatcacatgatgatgggcggatcagatgtcttcctcacaccgtctccgttccgaccaaccatccaaagcatcggcagtgacatgatccagcgatcatcttatgatccatacgatatcgagagtaacaacaagcagcatgccaatggatcaaccagcaagtggatgtcgacccccccaatgaagatgaggatcataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaagtccctttgcaacgcgtgtggcatcaggcaaaggaaggcgcggcgggcgatggccgctgctgccaacggcggacgcggtggcccggcaaagagcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcggccgctctagaggatccaagctagtacgcgtgcatgcgacgtcatagctcttctatagtgtcacctaatcatcg

SEQ ID NO: 1032 - protein, 353 aa, Oryza sativa
MSTIYMSQLPATLPLMEGDQDQGLYPAFHRAKDPPILFPFMIDSAVEHQGQIYGDQGLRRQQVLGESNQQFNDHMMMGGSDVFLTPSPFRPTIQSIGSDMIQRSSYDPYDIESNNKQHANGSTSKWMSTPPMKMRIIRKGAATDPEGGAVRKPRRRAQAHQDESQQQLQQALGVVRVCSDCNTTKTPLWRSGPCGPKSLCNACGIRQRKARRAMAAAANGGAAVAPAKSVAAAPVNNKPAAKKEKRAADVDRSLPFKKRCKMVDHVAAAVAATKPTAAGEVVAAAPKDQDHVIVVGGENAAATSMPAQNPISKAAATAAAAAASPAFFHGLPRDEITDAAMLLMTLSCGLVHS

SEQ ID NO: 1033 - DNA, 448 bp, Glycine max
gaagagggacaagaacaccatctgcggagcaaatccaacaaatcacggcacagcttaggaggtttggaaaaattgaagggaagaatgttttctattggtttcagaatcacaaagcaagagaaagacagaaacgccgccgtcaaatggagtcagctgctgagggtcatcacacccgtgactttgatagtactcttgaaaagaaagacttaggcgcaagtaggacagtgtttgaagttgatcagaccaagaactgggcaccctctacaaactgcagtactcttgcagaggaatctgtttcaatacaaagggcagcaaaagcagcgattgcagagtgtagaacagatggatggctccaattcgatgaaggagagttacaacatagaagagactttatggagaggaatgccacgtggcatatgatgcagttatcttgtcctccccctcctac

SEQ ID NO: 1034 - DNA, 480 bp, Glycine max
tcttctgggaagattgaagggaagaacgtgttctactggttccagaatcacaaggccagagagagacagaagcggcgtagaagggaaatggaggaaaataataataacaatatttctgcttcttcttctggtgaagggttgaaagagacaggttgtggagttaaagagacaaagaagtgggcatccacttcaaactgcagtggacatgcagaggaatctgctgcactggatatagcagaaaagggatctaatgggtggactcagtttgaggggaaagacagcatacaagttttgatgaggagaaacatagccgaaaaacaagctaagttgcaggaaattatggaaatgccttgtttccctcctgttactatggaagcatcaactcctacaacttcacacagaagaacaacgcattataacacacaacttttaacccctcaaaactataaataattaccatcttcagtcatcaacagagaa

SEQ ID NO: 1035 - DNA, 924 bp, Zea mays
ggagcgagagagagagagacagaaagagacacagtcacacagcgtagggcgctgcggcctgcggggacgaagggcaccagcttggtctttctcatccattcgcaaatacgcaacaaatcttgcatcttatcttaccctagaaaaacaaatcttgcatcttcagctgtctgtacgtgtgtgtgtgagagagagacactgcgtgccgcagcagcagctctggacaggcttacaggcaagtcagagagcgacggacgagccgggaagacgacgccggacggaacaaaagggcgagtttggttctttcctctaccacctggagcgtccccttgctagcgcccggtccggtgagctccataccatccagggagtgtgaggaaccgtcgtcgttgctggcgatccaagagaccaggagatgggcagcggcaggaacggcgctgtggtgaggcggtacgttcggtccaaggagcccaggatgaggtggagcgccgtcctccaccgcagcttcgtgcaagctatcgactccctcggcggccaacacaaggctacgccgaagctcattctccagttcatgggcgccagggggcttaccatatctcatgtcaagagccacctccagatgtacagagctgcatgccttggcgcagaaagaggaggagggacgccagcccagctgctgcaaaggaggtactcatgcagcggtgatgagcgaggcccccccaaggaggagttcctgtgctgcccaccaccacctctgaaaagggcccggatgggatacgagagcatgcagggaagccatggagtcagtgatgcgaggactactgctgggggactgtactgcatcgatgattacatgcaagccatggccgtgggctggagaataaaggaggagggcctcatcagatggcagaggagagatgcggctgc

SEQ ID NO: 1036 - DNA, 994 bp, Glycine max
atctcgtaattcgcctggaggtggaggacagaaatttttagtctcagccagcacaatttatctcttgcaatccaaaatgaaacaacatttgttcctcccccttcaacagctcggtctgtgtcaatgagagatatgggtaccgaaatgacccctattgctagccaggagccatcaagaacaggtaccccagtgagggcaacaacaccaatgcgcagccctaattcttcccggccttctactccccccagagcctcccctgcatctactttaactgatctacatagtgacaatctgaatctcaacatgaatgagttgtccgaaaaggagctacaaatgaaaacaaggcgagaaataatggttctcgggacacaactaggtaaaatgaacattgctgcctgggctagcaaagaagaggaggataaggatgcatccacttccctgaaaacaaaagcagaattacctaagagtgtcgttgaagcacgtgcagcagcatgggaggaggctgagaaggccaagtacatggccaggtttaggcgtgaggagatgaaaattcaagcatgggaaaatcaccagaaagcaaaaacagaagccaagatgagaaaaattgaggtagaagttgaaaggatacaaggtaaggcacaagataagctaacgaataaattagcagctgcaaggcataaggccgaggaaaagcgtgcagcagcagaagccaatagaaatcatcaagctgcaaaaactgaagagcaagcagagtatatacgaagaactggtcatgtcccttcctcatatttatcattttcttgctgcaattggtgctcttaaaaaaagccaatctttgtcaatgtttattttttgtttctataggtatgaaatgccttttgctgcttacacccaagcatgttaaatatgcctgttgcatttccctcctggtgtaaaatgttacattgttctgaagaataattgcaatttgaaagtgctttgctatttgttcagt

SEQ ID NO: 1037 - DNA, 479 bp, Glycine max
gataaaaattgagttgaatttcagcacaagatggaagaggactttgagttgcatgcccttcaaagtccaaagaactcttatgtgatggagtgctgaagtttgagagttgactgatacatttgaataggaaaaccaagatgttggtgttgaaaattaagtagaagttgaaaggatacaaggtaaggcacaagataagctaacgaataaattagcagctgcaaggcataaggccgaggaaaagcgtgcagcagcagaagccaatagaaatcatcaagctgcaaaaactgaagagcaagcagagtatatacgaagaactggtcatgtcccttcctcatatttatcattttcttgctgcaattggtgctcttaaaaaaagccaatctttgccaatgtttattttttgtttctataggtatgaaatgccttttgctgcttacacccaagcatgttaaatatgcctggtgcatttccctcctggt

SEQ ID NO: 1038 - DNA, 609 bp, Oryza sativa
ttttttttttttttttcatgacatttggcattcagcaatctggtatatatcaccttgaaaaatcagagttttttgatacacatgacaccattatctcccacatctccatcttcacacgtcccaaacatccactacaatcaacaagaacccgttgatctcccgaacaaattggcattcttgatccttcttccttggcggctagctgatcatatctaatagtagttcaggaggttgccactgatgatgttgttgctgccattgcaggggaagcagccgcaggaggcgttgctgccggcgaggtggtggtggtggtgatggtggctggtggccttggcccgccggacttgctcggcggcgcgcttcagctgctggaggtgctgcgcctgcgccgtcgctctccactcctcggcgcgccggtgcacgggcggcatcctcctcatcagcttctcctccaggtttgatctcatcttctgaatcttcacctctagctttctggactgtgcttcagccttggcactctccaggttgatccaagcttgaatctttgcctcttccctctgataccttatgcagctcttggccctgtcatcgtcctcccaccgggagtcg

SEQ ID NO: 1039 - DNA, 1415 bp, Oryza sativa
  misc_feature (570)..(570): n is a, c, g, or t
  misc_feature (598)..(598): n is a, c, g, or t
ggagagagagagaactagtctcgagttttttttttttttttttttttttgcacagaaaaaggcaagaagcttgcatcttatatactgctccatagttacttacaagtgactcgtcttcttctgacttatatctactgaaaccaatcaaaagacaatattctacaagatcacggtaaaaacagatgatggcgcttcaagtcttgcgagacatagtgaggagagctttttgcttgcttcagttgcttgagcttagctacgctactacgagcaccagttccagcagccaatggaggacggcatcctgccggttctcctgatgtggtctgcctgctccgccgtctttgcagccgcacggctccgtttcagctccgccgcggcccgcttctcgtcggcagtgtgtctcgccgatgcgagctggctcatcagcttgtcctgcgcacgggctcgcatcctttccacgtcgacctcaatttttctcatttcagcttcgatttttgctctctgatgatcttcccatgcttggatcttaatctcttctcgtttaaatcttgctaaatatttagccttctntgcctcctcccacgctgctgcacgaatntctgttaccttctgtgtagattggtccatgggcactcctttaagcgaaagtgatgcatctttttcctcttccttctggctggcccatgcagcaatgttggttttaccaagctgagtgccgaggagcattatctccctcctagtcttcatttgcaattcttgttcacttaattccacgttgctacattcaccatggccaataacagcaccgattgcattggggcctattgtttttcgtggagtagttgggcgagaacaatctggactcgttgctctcaccggtgttcctgttcgggatggctcctggctcgcaataggggtcatttctgtacccatgtctctcattgacactgatcggactgttggtgggggaggtatgcatgttgtcgcgctctgaagcgtggcagatgaatcatggcgactaaaagtaacagctgaatcagctactgtaatttcttcagcaagtgcagactttgcacaagtctcaacttctggatatggctcagcccgggcccaattcaccgctttttgccacccaatttcccttttctcttggcttggatcaaccctcttagtatctatctcctctgtggcctccaacacaaccttcgtagccggcagcctcccgccaccaaagctagttttttccatcttcctctgtggcactccaccagccctaccaggacggtttgttgtcgggctggcgatccatttctgggcatcgtcccactttgatggtgcaggctttgagaatggaggaacgattgccgccgtcacagaccgagcagaggcccctcgtgccgaattcctgcagcccg

SEQ ID NO: 1040 - protein, 510 aa, Oryza sativa
MEYERIEKPFPTQGGGFSPKRLRAMLLGVEKRRKGQEEEEEGDAGEVDDEYGAVPKSSVRSDADSDARRGGSMCEEYKDVDVVSTISESSSSLETGSGHRSRDTHSMGSRVRVPEEDSCDSESVASNFEFHKERGASARSVTAAIVPPFSKPAPSKWDDAQKWIASPTTNRPGRAGGVPQRKMEKTSFGGGRLPATKVVLEATEEIDTKRVDPSQEKREIGWQKAVNWAPPDPYPEVETCAKSALAEEITVADSAVTFSRHDSSATLQSATTCIPPPPTVRSVSMRDMGTEMTPIASQEPSRTGTPVRATSPDCSRPTTPRKTIGPNAIGAVIGHGECSNVELSEQELQMKTRREIMLLGTQLGKTNIAAWASNKEEEKDASLSLKGVPMDQSTQKVTEIRAAAWEEAEKAKYLARFKREEIKIQAWEDHQRAKIEAEMRKIEVDVERMRARAQDKLMSQLASARHTADEKRAAAELKRSRAAAKTAEQADHIRRTGRMPSSIGCWNWCS

SEQ ID NO: 1041 - protein, 426 aa, Oryza sativa
MLLGLEKNQHNGEDTSPEANDSGELDDQSKSTTPEMVLHSSIILIYGFTKSLIASTGSMECSTSTEMSSNSGHRSRNRAQDDDSFDSESSSSGPPTVKRPAAVTALLPPFSRPTPSKWDDAEKWISSPTANRGGRVGSAAGAAPKKSALAFPEHVSRPPAVAKVVAEVPINTGTLVKNSVALAQPISFNPAQSASIVDEPAPAVRSVSMRDMGTEMTPIASQEPSRTGTPIIASSPTSSRTPTPQRNAEISIGEFGPNKMEMSEEELQMNTRKEIMDLGQRLGKTTIAAWASKEEKSTTSFANVITDKAVEIDREARAADWEEAEKAKYLARFQREEVKIQAWENHQKAKIEAEMKRMEAKIEIKRAREQDRLSSKLAAARHKAEARREAAESRKNQEAARTEEQAAQIRKTGHIPSSISCWCWCL

SEQ ID NO: 1042 - protein, 493 aa, Oryza sativa
MEPKSSSSSHYLQPSATLPSTRRNSFQGVGAEAGGGGGGMNPFGPTFSDPLCSLNLKETSEFVRSSFPMATMARSNSSNGATGNGGHGYHRETSTASSSSSSSASAQRRRAEQQQQQVPATPGRPLLFFNSSSPAHHQLVSARRSVPSKWEDAEKWVRQASSDHHGGHHHHHGKGSKLQEEKRASAVRRSVDADVTALALYTAPAAEVFLKDKFTDNVEPSKESFVFRSSYCEPTKNTAAQAVAAGNGIDHRRDIGTEMTPLGSSTTSRCHTPIKSTSPARHNTPASRSGPLVPYAGGGGGAGQDISDLADCHFAKLDLGAQFDAMLINWSSKEEEEEEVSKSLRHFEASVAAVGEKRGGAGDCRWEDDDRAKSCIRYQREEAKIQAWINLESAKAEAQSRKLEVKIQKMRSNLEEKLMRRMTTVHRRAEEWRATAQAQHLQQLKRAAEQVRRAKATSHHHHHHHLAGSNASCGCFPCNGSNNIISGNLLNYY

SEQ ID NO: 1043 - DNA, 1210 bp, Zea mays
ccacgcgtccgggctgctgcttcagcagcagctgttaatttcaaccgccatgatgcatccaccacgcttcagagcgcagcaacatgcatacctcctccaacaacggtccggtcagtgtcgatgagggacatgggcacagagatgacgcccatcgcaagccaagagccgtcccggaccgggacgccggtgagggcgacgagtccaaactgctcccagccaacgactccacggcggacgctcggcggccccagcgcagtcggctccttcatcagccacggaggagaatgcagcagctcggagctgagcgagcaggagctgcagaccaaaaccaggagggagatcatgctccttggcacgcagctaggcaagaccagcatcgcggcatgggcgagcaagaaggaggaggagaaggacgcctcgctctcgctgaaaccggtgcccatggaccagtcgacgcagaacataaccgcgatccgtgcggctgcgtgggaggaggcggagaaggccaagtatttagcgagattcaagcgagaagagatcaagatccaggcttgggaggaccatcagaaagcccagatagaagctgagatgaggaaaatcgaggttcgcagactgttttctgttcttctgttcagtttgccatagatgttcaggttcagaagaacatacaaaaccaaagggtgcagcgcggagctgtgtttgtggatactgcattgttggtatcgatagttttaaccatggcccgtgctttgcgttcctttcctcaaggtcgaggtggagcggatgcgtgcccgcgcgcaagacaagctgatgaccaagctcgcgtcggcgaggcacagcgcagacgagaagcgtgccgcggcggagctgaaacggaaccgtgcagccgcgaggaccgctgagcaggcagagcacatcaggaggacggggcgggtgccgccgtcgtttggctgctggaactggtgctcatgaagtgcccatggaagatgagtcgcccgttgagaatgagtcgcttgtaagctgttgtaactatatatatatatatacacacacacgcgtatgtaagatgtgagatccatgcgtcctgtgctgtggtggttactgtgtaagtgtaacagatgtaccgaattcaaggccgagcttggattcctaaaaaaaaaaaaaaaaaaaaaaaaaaaaaaaaaaaaaaaaaaaaaaaaaaaaaaaaaag

SEQ ID NO: 1044 - DNA, 572 bp, Zea mays
gaattcccgggtcgacccacgcgtccgcccacgcgtccgaagagatcaagatccaggcttgggaggaccatcagaaagcccagatagaagctgagatgaggaaaatcgaggtcgaggtggagcggatgcgtgcccgcgcgcaagacaagctgatgaccaagctcgcgtcggcgaggcacagcgcagacgagaagcgtgccgcggcggagctgaaacggaaccgcgcagccgcgaggaccgctgagcaggcagagcacatcaggaggaccggccgggtgccgccgtcgtttggctgctggaactggtgctcatgaagtgcccatggaagatgagtcgcccgttgagaatgagtcgcttgtaagctgctgtaactatatatatatatacacacgtatgtaagatgtgagatccatgcgtcctgtgctgtggtggttactgtgtaagtgtcacagatgtaccgaattcaaggccgagcttggattcctagtccacatatgtgataaacttcacaccatgctagttgtgactggatttgatttgtgctctaaaaaaaaaaaaaaaagggcggccgc

SEQ ID NO: 1045 - DNA, 736 bp, Zea mays
ggccgcttttttttttttttttttgttttttttttttttttttttttttttttttttttttttaacgggaaggtttccttctccatgttcatgcatggggaaagaaagaaccgttggaatttttctaccactgtccatgctgggtgacttggcggaaaatatccgtcaaaatcacgggcaccagcaccagcaggagaaggacgaaggcgtatgcccggtgtatcggatccgggccgcctgctcctccgtcctcgcggcttcctggttccgcctcgcctccggggcctcccttttcgcctccgctcgggggcttacggctgccagcttgctggcgagcctgtcctgctcgcgcgctcgtttccgctctatcttggcctctatccctttcatctcagcttcaattttcgctttctgcagattttcccaagcttggatctttgcttcctccctctgaaaccttgcaagatacctggccttctccgcctcctgccaatctgcagctcgactctccctgccgatatcgacagccttgtaggctgtgctatccatgaaacgtgcggcggatttctcttccttgcttgcccatgcggctatagtggtcttccctaacctttcaccaagatccataatttcctgtctcggactcatctgtacctcctcctcttcaggcatctcgatcttcttaggatctatataactcacactgaattctgcggtgcgttgcgggggttggtgt

SEQ ID NO: 1046 - DNA, 1659 bp, Zea mays
ggctcgagctcgagccgcacaaccacaagacccacacacccgtcggtaaatgcaaagatcgcaagtccacggcccaccccccaaatcggccaatctccacttcttaagctccctgtcgcctccgcctcctcgtcgtccggcctcccgcgccaccaccggggcctcgccgccacgaatggagtacgagcgcatccacgagccactcccgcgccgtcagtccggcggattctccccagctaagctgcgagcgatgcttcgcgggctagagaaacaccagcgcaacagcggcgaggacacgtcgccggaggccaacgactccggcgagctcgacgaccggaggagcttggaatgctccacctccaccgagatgtcgagcaacagcggccacaggtcaaggaaccgggccccggacgacgacagcttcgactcggagagcagctcgtcggggccgcccacggtgaagaggtcggccgcggtggccgctttgctgccgcccttctctcggccaacgccgtccaagtgggacgacgccgagaagtggatttccagccccacgtccaaccgtactggccgtgccgggcctaccgctggaactatgccaaagaagtccgcattggcatttcctgaacatggagcccgccagccagccgttgctaaggtggtcacggatgtgcctactatcgctggaccattggttaagaattcagatggtctcgcccatcctgatttgcttaaacctgcacacgatgcttcaatagttgatggaccagctcctgcaagttaggtctgtctctatgagagacatggggaccgagatgactccaattgccagccaggagccttctcggaccgcgactcctatggttgcatccagtccaacctcctctcggacaccaactcctcaacgcaccacagaagttcagtgtcgcgcaatatagattctaacaagatggcgatgtctgaagaggaggtccatataagtacaagacaggaaattatggatcttggcgaaaggttaggcaagactactatagctgcatgggcaagcaaggaggagaaagctgctgcacgttccacggatactgcagccgataatgctgttgatgtcaacagggagaatcgagcggcagattggcaggaggcagagaaggcaaagtatcttgcaaggtttcatagggaggaggcaaagatccaagcttgggaaaatctccagaaagcgaaaattgaagctgaaatgaaaaggatagaggccaagatcgagcggaaacgggcgcgcgagcaagacaggctcgccagcaaactggcagcggtgagccaccgagcggaggcgaagagggaggccgcggaggcgaggcgggaccaggaagccgcgagaacggaggagcaggcggctcagatccgagaaaccgggcacacgccttcctccttctcatgctggtgctggtgcctgtgactctggttccttcactgcatgaccagcacagcacgtcatccaactgtaacatagcatgacccgtgagactgatctccggccatggtagaaaaatttgctcactgtacgacttgtgtagttccttggtctaatggtgtccagttttttggtgcctcgcggttaaaaaaaaaaaaaaaaaaaaaaaaaaaaaaaaaaaaaaaaaaaag

SEQ ID NO: 1047 - DNA, 1941 bp, Zea mays
gcaccgcgtgccccgccgccggccgcccctctctctctctctctctgtcgccaggagggcgccgccgccaccaacgcaacgcgcgccgccgcagatctccgccaccgacgcgccggccatggagtacgagcgcattgagaagccgttccccgtccagggcggcgggttctcgcccaagcggctgcgcgcgatgctgctgggggtggacaagcgccgcaaggggcaggacggcgccgccgaggaggacgaggacggcggcggcggcggcgactacggcgccctgcccaaggcccacgccagatccggcgccggcgacggtggtggcgccacgtgcgaagaatacaaggacgtggacgtggtgagcaccacctcagagttctcgtcctcgctggagacagcgggtgggcaccggccccgggacgcccaccccgtcgccacgggttctaggaccagggtgccgcccgaggaggactcgtgcgactcggagagcgtggcatccaacttcgagttccacaaggagcggcgggcagcggcgggcggcgtcggtcgtccctccattctcaaagcccgccccgtcaaagtgggacgacgcacagaagtggatcgccagcccgacggcgaactgccctggcaggggtggcgcggctcctgcgccgaagaagacagagaaacctggctccggcatcgggaggctgccgctgccggcgaccaaggtcgtggtagaggccaccgaggagatagataccaagaggatggatccgagccaggagaagcgtgagattgggtggcagaaagcggcgaggtgggcgccgcccgacccctgtccggaggcggagccctgcccaacaaagaccacactactcgctgtagaaactacagtggctgctgcttcagcagcagctgttaatttcaaccgccatgatgcatccaccacgcttcagagcgcagcaacatgcatacctcctccaacaacggtccggtcagtgtcgatgagggacatgggcacagagatgacgcccatcgcaagccaagagccgtcccggaccgggacgccggtgagggcgacgagtccaaactgctcccagccaacgactccacggaggacgctcggtggccccagcgcagtcggctccttcatcagccacggagaatgcagcagctcggagctgagcgagcaggagctgcagaccaaaaccaggagggagatcatgctccttggcacgcagctaggcaagaccagcatcgcggcatgggcgagcaagaaggaggaggagaaggacgcgtcgctctcgctgaaaccggtgcccatggaccagtcgacgcagaacataaccgcgatccgcgcggctgcttgggaggaggctgagaaggccaagtatttggcgagtcacgcgacagaagagatcaagatccaggcttgggaggaccatcagaaagcccagatagaagctgagatgaggaaaatcgaggtcgaggtggagcggatgcgtgcccgcgcgcaagacaagctgatgaccaagctcgcgtcggcgaggcacagcgcagacgagaagcgtgccgcggcggagctgaaacggaaccgcgcagccgcgaggaccgctgagcaggcagagcacatcaggaggaccggccgggtgccgccgtcgtttggctgctggaactggtgctcatgaagtgcccatggaagatgagtcgcccgttgagaatgagtcgcttgtaagctgttgtaactatatatatatatatatacacacgtatgtaagatgtgagatccatgcgtcctgtgctgtggtggttactgtgtaagtgtcacagatgtaccgaattcaaggccgagcttggattcctagtccacatatgtgataaacttcacaccatgctagttgtgactggatttgatttgtgctcttttgtgctctaaaaaaaaaaaaaaaaaaaaaa

SEQ ID NO: 1048 - DNA, 706 bp, Zea mays
gccggccgggtccggaatgcacccgacctcgcgccctccacggcggagccgcgtcgtccccaaggccaggcgcggcgagcgccccggtgcggccgccgccgcgggagccgttccctatgctgctgcccgtgttcatcctcttcgtgctcctcctctgcttcctctccatcttcctcctgcgcgacctcctccacttcctctccctctggctgcgccgccggcgccgcctccgcgccgatgcggacgccgcgtccgacgccacgccggacacgcacgcgtcgcacaagccggccggtctggaccccgcggtcctcgccacgttccccacggtgcggtggttcgaggagacgcatcggcccgcgtcggggcaggccgagtgcgcggtctgcctgtcggagttcgccgcgggcgacgcggtccgcctgctcaccgtctgccgccacgcgttccacacggcgtgcatcgactcgtggctcggcgcacacaccacgtgccccgtgtgccgctccgaactggacgcgccggctgccacgccccgctacggcggcggtggacgcatcgcgatcctggtagacgatcagggagacggcagcgcggcggtggcggacaccgaccatgcggaatcatccccggcgaaacgttggcgtgcaatcgcgcccctgaccgatgacatacatattgtcccaaaatcgccgagtgccagacg

SEQ ID NO: 1049 - DNA, 1201 bp, Glycine max
gttattatacagcaaaacgctctccaactccaacccagttatccaacacacaccaccaagctgtcttacactctaatccttcacacaccgtagttcagcaacaactggtttgcacttctttctcagaactccttctccagccatcgcaattcttaccctaataaatggctcccttcaacttccaactgccgccccagaagttactcaccttcaccttcaccttcaactgccaactgcaaacatctaactactttcaggttcacttagccgagaatcagagactaatcactagagataccgagacctacttttcctcacatcaccaccaacatgcgttccagcaacggtacatcaagcagcagggcctccaacggtaacacagggcgccaccctgtttaccgtggagtgaggcgtaggagtagtggtaaatgggtttctgaaatccgtgagcccaaaaaacctaacaggatttggttagggacatttgccacccctgaaatggctgctattgcctatgacgtggcagcgcttgctcttaagggtaaggatgctgagctcaacttccctaactcggcttcctccctccctatccctgcatcatctgcagctcacgacattcagatggctgcagcactagctgcaaccgctgtcggagcagcgaatgatgcactggaaggaagccaaggaggaaatgtttcggtttcattggcggaagagttttcagggggaaacttaaatcactttgtggatgaggacttgatctttgacatgccgaatattctggtcaatatggctgaaggaatgctactcagccctcctcgttttgataattttgctgctaccgactatgaatacatggatgaagatcctaacctctgggggttccctaattactagttactacccatgggataattaaaagactttttatattactaatgcaaaaatcttaagaaggaaaggtaagtaagctgtaataataaattatgggagaactcttacatccagactttgcttagacaccaggaaagggtatggtgtgtgtgtggaaagtgtatctttctttccatatgttttttttccacctagtgtacagtggtaccttctagctatagtgaggtttgctgctgttgcacctcaaactcaaatatgtatgtaatgtttatataatgtgttaattaaataatcttttttggtcatt

SEQ ID NO: 1050 - protein, 193 aa, Oryza sativa
MEQRAAAAAQQRQGRRQSAAACGIRRARAETRHPVYRGVRFRAGKWVSEIRELRKPSRIWLGTYATPEMAAAAYDAAALALRGRGAALNFPDAARSRPAPASASADDVRAAATAAAAAMAHQEEDDDSRRQLEDGGGGGGVVDEDDVLEMPRLMVSMAEGLMISPPPVMLGLQADGGGIMDEGGGVVRLWDHS

SEQ ID NO: 1051 - DNA, 1078 bp, Glycine max
gagaaagcagaagagaggaatgaaaatcttgaatcagttgctgctgaagatggttcgttgaagtggatgcctgccaagatgagaattatgcggaagatgttggtgtcggatcaaactgatacatatactaattcagacaacaacactacgcacaagtttgatgatcagaaacaacaactgtcgtcaccgcttggaactgataacagcagcagcaacaactattcaaaccacagtaacaacactgttagggtttgttctgattgccacaccaccaagactcctctatggaggagtggaccaagaggccccaagtcactttgcaacgcctgtgggattcgacaaaggaaggcaagacgagccatggcagctgctgcggcttctgcatcgggaaatggaacagtaattgtggaagctaagaaatctgtgaagggacggaacaagttgcagaagaagaaagagaagaagacaagaactgagggtgcagcacagatgaaaaagaagcggaagcttggagttggatcagcaaaggcatctcaaagtagaaacaagtttggttttgaggatttgacgttgcgcttgagaaagaacttggctatgcatcaagttttccctcaggacgagaaggaggctgcgatccttctcatggctttatcttatggccttgttcattgatgaaccttaattaatagctagctagctagctagctagagctaccaccacttcacttaatttcagttcgttattaattaggttaacccccgcgtccgctgtcttatgactagctagtttttgttagattattattattgtgtgagatcaatggtttgagtacgttatatatgtgcgagaagagtatgtattgcagtactagtagtagttagtcaggaaatgggagggaaaataaagttacatgggtgtggggtgatcttatgtacttggtatgatattatgtctgatttgaacaagttgacgaccaaaaagtgtgggtctcttcttgatcttatgtacttttgtattaatcttttttttttatgtaaattttttaatatctttttttgtaaaaaaaaaaaaaaataa

SEQ ID NO: 1052 - DNA, 755 bp, Glycine max
gtacacacttgttatgattcccttccctagctagctacccaccctatccctcggtactgtccactgtccattatttttgcctaattattaacaacacatacagttctctctttttctctccatccatgactccttattctctgaacccaccaggcccttccatacaagctggtcaaacccaactcttcaatatttctcctaataatcaggattgccgtaccatttttaacatatttgatccaaggaaaaccaggatagaaattggagggttaagagaaaattatcatcaacaggatgacaagatgatggtattgcatgatggatcatcaagcaactgcaacaagtcgtccttcaataataatatttcacctgagacagtagttatggttgatccattaagcagcgcatgtgatcggcgtaatttaccatctgaggaagagagcaaaaataacgatcacgggtctgggaacaaatggatgtcttcaaagatgaggttaatgaaaaaaatgatgagaccgagtatcagtccaaccactgacaaagcaatcaattcaagcccaagattccaaaatcatcaagggctcgaaagcagaaggtacagccaaagaagccctcgtaacaacaacggcagtagcacccctagggtttgttcggattgcaatacaagcactaccccactttggaggactggcccctagggtcccaagtctctttgcaatgcctgtggcattagacagaggaaagcaagaaaggca

SEQ ID NO: 1053 - DNA, 823 bp, Glycine max
ttttcaacataaaatctcttggaattttattaaatatttatcgagattataggatactcatcatcatgaacaataagacactagtattttgtgtttgtcttcttgttcagatgcaacatacaattaacttgataaaaccataccctcctcataactttattgtccctatattatcagttttccatactaattaattaacttcactaaatctagcacaacactaattaagcattggtctcatacaataattatggttttaccaccaatatatctcataaatctaagtaattgacgtaacgatctgtgggaaagccatgaagaaggccataagataaagccatgagcaagattgcagcctccttctcatccggagggaagactttttggagagccaagttcttactcaatctcactgtcaaatcctcaaaagcaccaaacctctttctatacttcgctccaagtttgcgcttctttttcatatgtggtgcacccttagttttggacttcatccctttgctatgcaatttgtttcctttctttacttgagatttctcagcctccaccggattcattccgtttgccgttgcagccacggcaatggcacgccttgccttcctttgtcgaattccacaagcattgcaaagtgtctttggaccttttggtccacttctccagagaggggtcttagtggtgtggcaatcagaacaaaccctaacagtgatattgctgtggtttgcagaagaattgtagttattactatcatcagttcctagaggtgtcagtggtgggtttttctcttcattcttgctcgagccgaatcccg

SEQ ID NO: 1054 - protein, 126 aa, Oryza sativa
MARRTRRTQVVCCFDLIRDPIHDPFFQSLCNACGIRYRKRRRAALGLDSSATATATDGAEQQKKTKAKKEKAQEEEVTMELHTVGFRSKDAAVFKQRRRMRRRKCLGEEERAAILLMALSSGVIYA

SEQ ID NO: 1055 - DNA, 1164 bp, Zea mays
  misc_feature (10)..(10): n is a, c, g, or t
  misc_feature (12)..(12): n is a, c, g, or t
gggtaccctncnagtcctgccggggatgtagctagcgcatctattgtttgctctccacatctctctcgtgcgtgtgtccatgaaaaggatcacacacgaatgatctacacagcctaggcgagctctctcctttgtctctttataaaaggggctcccctcgggccggccgggatgatcgctacctcgctttccctcttgatccctggctgcaaattgccattccgacataataaccactgcaccagccgcttcggttcgcctcttcctactctccatatatctcatcctgatcttcactcatcacctaaccatacgagatctgcatatatagctccatcagatcttgagcgcaaattcctctcagtgcatcccatgtctgcaatctacatgagccagctctccactgccctccctctcatggagggagatcaccaagatcatcatcaccaccaccaaggccacttccaggccttcaccctgccaaaggaaacaccgatccttttcccctttgtgatcagcaatagtagcgccagcgaaggcagtttgagctatggatcggctgcagaccatcacttgttgaggcagcgtcatcaagctatgctggagccccaacatatgattggaggatcatcaactgcgactgggaatagtgtcttctcgacgccgttcccgaccgtggagagcatccgcgacgacatgatcgagcctgcctcgtacgatccatacgacatggggaagctgcaggtcggcgggtcgatggatgcttgcagctggacgccggcggcagccaagatgaggatcacgaggaaggccactgccgatcccagtgcggggaagaagccaaggagaagggcgcaagcagggtacgacgacaccatgagcggccaaccgaatttgggtgttattagggtgtgctccgactgcaacaccaccaagacacccttgtggaggagtgggtccttgcggccccaagtcgctctgcaacgcgtgcggtatcaggcagcggaaggcgaggcgggcgatgatggccgccgcctccggctcggtgtcagcagttcccactgacagcggcaaggcctcgcccagcaacgccgccgtggccgcagcagcagcacaccccaaggtgaagaaggagaagagagtggacgtggaccggtcgctgcc

SEQ ID NO: 1056 - DNA, 1914 bp, Glycine max
tcctctagagcggccgctttggtttttttttttttttttttttttcacaataccacaacaaaatactaagaagaaaaggacaacaccaaccaggcactattgaaaccagaccaatacgttctccaaacagaaggaagaatatatagatccatacaaagcagaaaaaaggtattgtgcaacgcaagactaattttctatttccaaagtcaacgcagaagctatcgtcatctagcaaaaacaaattcactctgagtgcgtggttctcattaatccctttttcagagtagaaaaacaaaacaaaaattatcgataaatacccaatatgttaatgaatacctaacactcagaaataaaaaaaaaacataaatgttatagataatatgatttcacgtataaaaaataaaaaatagttattaggtgtttaaaaaatgaatgtccatatatcataaagaaaacatatagtgaaaagggcaaaggcgtgcttaaccaaaaacaattataaacatgacaatttcaaaggctacccaaaataccaacactaaaaatatattgctttcaaattatccatagttccatacataatactactggaaggaagccagaggggcataatactacatagtaagcacgaacaaaataacctggttaattaaacctaggaacaaaggccctaatgattaataagtttctaattgaaaggccagaccaacattgagaagtgacagattcaacatgactacatacacaactagcattgagatgcagacactggaaatgttaactaattaagcattttgcattctgattgcgaaagcattaagaagctcttggtactgaaaaacatcttcaacgacacagttctctgcattattaataatgttttgatcattctccatagccatgctattaaacccattagaggtgtcgaattgctgcatgggaaaaccttgatcagaataaaaaacacctagaccctcgttctttggaaacccttttttcatgtcatcatcatagtattgttgcccggtggaaacaagcgttgattcagaaacaagcggagggagaagaagcgactcctcctgaggatttgcaaaagtagtctcgcatttactaggcttcgttctaggcaagaacttgttaactatctcctccaacaaccccgaatccgaagactcacgagagaaaaaaccatcaccatcatcacctttttcagcaaaattagttccacaagtgggaaacgtgttcatcttaacagacaaagagcctccacaagaattattcatcgaataactagggggagcaagagaaggagaaacaggtaacgatgaaaaagtagaagtactcttgttgtaaaactggtcgtggaagttctgagtggaagaagaagaaagcaaagaagggttagagtgaataaggtcacgaaagagaagcatgttgagagaagaagggtttcgaggggctgaaaagtcaacggagtgagggtggtcaaaacaagtgttggaaccggttatgtggcggttacggtggtgattgaagagtgagtgtttgtgaaagttgttgttgttgttgaagttagggaacaagtgttcggtggtggcggaagaaggttgcggagaagttgggtaaacgaagttggtgcgagctttgagacccctcatggctctagcagcgcagtcgtaggcgcaagcggcttcctccgccgtgtcgaaggttcccagccatcgccgctccttcgattgagggtcccttatctccgccgcgtaacgcccccacggcctgcgcctcacgccgcggtacctcatcgctccgccgccgccaccaccgccgccgtcttctcttaaagccctcttgttcacggccgaggtccgttttcccttctgtcgtcttctcgcagccgtacggacgcgtgggtcg

SEQ ID NO: 1057 - DNA, 821 bp, Glycine max
  misc_feature (804)..(804): n is a, c, g, or t
  misc_feature (806)..(812): n is a, c, g, or t
  misc_feature (815)..(818): n is a, c, g, or t
gaagctcggaatcggtcgaggcagtctctgcacccctccctccttgtttgtatcatatcaggcagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgtatcttttctgggcataattctgctaaatatataaaattgggttaaatatatttttggtgtctataaaatttcttttttttttttggtctctgtgaattattttgtatatttttagtctcttgtttatttttttgttatcaatatcagtttcttaaattttttatacttttttctgccatttttaatctctttgatagactgatatttatgacgaaaaaattaataaatgatttgaaatagtaaaaaaatgaaatttcattagagttaaaaatatatttaaccctataaattctgttctaaatcttacagaattatcgtcaattgtatttcttgtcgttgagatgagaattaatgtacactttcgttaatcggtcatgagtatctcatatagaagctatggaaaagtttgcatgttggtttgtataaaagaaaaaggtgtgactagtcggtcaattgangnnnnnnnagnnnnata

SEQ ID NO: 1058 - DNA, 917 bp, Glycine max
ggcatgcaagaaaagttccgcttgcaaattcaatgctataggccaaggccaagcaagttgtagccacatgacaattgttgaaccattagcaagaagctaaatgaaccagaaatacacatgcacatgcaggtggtctgcattaagtacatactgcccttgacgtacatcaacagatctgaatcatagattgccttaaaacacttgggaacattacaaagataaattaagtagcattatacataagggcttttagaatggcatgcccctttttggttaccctaaaatgcaaatataagtacccatatataataggatcaacttccatttcatatcccgcaaattaagtcactgtataatgagttgcaggcacccaaaattgtcttgcttcgtttaatttctgccacttcattggctagtcgaaaatcttgaagtccaatatttctctatttcttctgcagttcttccaggaattcttccagcaatcaaagaccacctttctccaaccagattatacaccatggcaataaggatttcctcagcttcagaaaattcaacatcagaaacttggcttgatttctctacaaaacacaaatcaattctgtatgtttatgtggataacaacgagtgagccaatcattgaaataaaactgcatagagatcgatcatcattgtgtactctcaagtttgtaggtgcatgttatattataatattatagacccatcaaaaactaatctcaagatatattcttatctagctatcagaattgattattgaagacaaatggattttaaaagggtaccaatagaatcagaagaaacattattatcaaaggagcgatctatgtcagccattgcaataacaagttctcaaaagagctttgaaagtttcagtcttgtatattgaagatgcctggtgc

SEQ ID NO: 1059 - DNA, 735 bp, Glycine max
aaagatgccttacgaatacacttaatgtatgtgtatacatgcaaagaaaaaatccgcttccaaatccaatgctttaggccaaggcaaagcttgttgtaaccattagcaagaaggctaaatgaaccagaaatacacatgcccatgcaggggatctgcattaattaagtacatactgttcttgccatgatcgaacagatctgaatcatagattgcctaaaacacttgggaacattacaaagataaaattaagtaacattaaacataagggcttttaaaatggcatgcccctttttgttggttaccgcaaaatgcaaatataagtccccatatgattaataggatcaatttccatttcatatccccacaaagtcactgtaatgacttgtaggcaccaaaaatttccttgcttcgttttctgccaccgatcattggctagtcgaaaatcttgaagtccaatatttctctatctcttctgcagttcttccaggaattcttccagcaatcaaagaccacctctccccaaccagattatacaccatggcaataaggatttcctcagcttcagaaaattcaacatctgaaacttggcttgatttctcagtagaaacagcagaaacattattatcaaaggagcgatctatgtcagccattgcaataacaagttctcaaaagagctttgaaagtttcagtgttgtatattgcccacgcgacacgcccacgcgtccgcgggcgcgt

SEQ ID NO: 1060 - DNA, 728 bp, Glycine max
tcgggattcttctctgtttcactccctccctgccacccaatcttcacgagcaaccatgttgtcctagcaatgaccttcttctattaataccacccaaataaccttgtccgggaaaccacttaattctccacgcctccttgcaatggctgactcggatctctcttcaagtcaaatttctacacattctactgattcaggaaatcgagggtcttccaaagttgaattttctgaagatgaggaaaccctcatcatcaggatgtataaactggtaggggagaggtggtctataattgctggaaggattcctggaagaacagcagaggaaatagagaagtattggacttcaagattctcgggctctagtgaatgaagctccggagtactacgattggtgttcagtctaggacgagcaagaagattttgggtgcaagattagtgtgattttgtgggacataaaaactgaattaaagttggcatagtttataggtatttgtattggctataaaaaaagaagtggggcagcaactatagaagctggtttgtgttatatttctccatcttgaaatgttccttggtgtgatattttccatcttgaaatgttccttggtgattggtcttttctgaattgtacttagtgctgttcatcttcgtgtatcttattcatttaccattttggctttttatcttgcgtctgaaatctgtattggaaatgagaattaattagagac

SEQ ID NO: 1061 - DNA, 680 bp, Glycine max
ttcgggatcgcgcccttaatttttccacgccttcaatacaccacactcttctagctccttgcaatggctgactcggatcgctcttctagtgaagtttctacacattctactgattcagggaagcgagggtcttccaaagttgaattttctgaagatgaggaaactcttatcatcaggatgtataaactggtaggggagaggtggtctttaattgctggaaggattcctggaagaacagcagaggaaatagagaagtattggacttcaagattctcaggttctagtgaatgaggtgccaagagttctactaccattggtggtcagtctaggatgagcaagaagattttgggtgcaagattagtgggattttgtggggcataaaaactggattaaaggtggccctattttatagggatttggatttggattggctataaaaaaaaaaagtggggcagcaactatagaagctgggttggggaatattttccatcctgaaatggtgcccggtgggatattttccatcttggaatggtacttggtgggtgggcttatctgaattggacttattgatggccaccttcgtgtatttttcttattcatttaccattttgggtttttatcttgtgtctgcaatctgtattggaagagtccaactatggaaatgagaattaattagagat

SEQ ID NO: 1062 - DNA, 1379 bp, Oryza sativa
tttggtgttggtggtaatgctatcactggaagggatttcatttatttacttgataagtacaagccatctttgcagtgggatgagaaaagttcagagcattttttcgtctattcagataaaggtttgagacatgctgtattctacccaacgctgatgtccctttctttacgtttggatgaagctcaagattggggaacagggctttcaatttgggaaattgggcaaggtttggactattttttcgatgttctttaggaatatctcacgtgtgttctttttattttgggagcaatgtcagttagaccacaactattgcaaagtattacaaggtcacccgtggacattatttgtttagcatcaaaactgtcacttcataactgattacatccttctgggaaatgtttccaaacaccaaatttccccttcagtgtactgctgcaaaatttagattaagtgatatgagatttttcatcttctttacagaataaacatggttgcttgtttactttagttacttcacttggtagtactatactgcctcattccttaagcaagtatgatgatgttggtctggttttgttattagcacatcatgctctgtgtatattaatgtaatacactttacatttggtacagcaatcttatagttatgcaactgtgcaattcccattattgtgagccagcttgtgatgcaattctaatagatcaaagaacaataaatagtcatggaataaacacattaattttgcattcagtttttcctccccttttgcatcaggcataagactgaggcaacacaaattatctaaattatagcctacttttagggcctaaatccttttctaaaaaagtttgcttctaaattgtacgctacttttagggcatacaccctttttccccccttatgtattctggtgctttactgcccagaacatttctacttcttttgctgttcttccagggattcttccagctataagttcccacctgttcccaacaagcctgtgcattctgaaaacgagatcttcctcttcttccgtgaaatgaacaaaattctgtgcagtgttattaacttcttttgtttcacaaccatcactggttttggaattctttccctggctaccactgctgctatccattaggcgtgaaaaactccaatgaaatgccgagttgagatcttgtgctagctaagatcctcagacccttgttatgaccttatgttttctagggcccttctctccggccggatgagcaaaactctggtttttaaagagatgggagttggtagtcaccttctgatctagctgtcctgagtactgactaatgctgctggctgttggatttcccctagtcttccattggctcccttatctgtaaga

SEQ ID NO: 1063 - DNA, 652 bp, Oryza sativa
gagaaaagttcaaagcattttttcgtctattcacataaaggtttaagacggggtgtatggtgacccaactctgatgtacctttctttacgtttcgatgaagctcaagattcgatgaaccatggtctttcacatttggtgaaattgggcataggtttggactatctctttcgatgttctttaggaatatctcacgtgtgttctttttattttgggagcaatgtcagttagaccacaactattgcaaagtattacaaggtcacccgtggacattatttgtttagcatcaaaactgtcacttcataactgattacatccttctgggaaatgtttccaaacaccaaatttccccttcagtgtactgctcttttgctgttcttccagggattcttccagctataagttcccacctgttcccaacaagcctgtgcattctgaaaacgagatcttcctcttcttccgtgaaatgaacaaaattctgtgcagtgttattaacttcttttgtttcacaaccatcactggttttggaattctttccctggctaccactgctgctatccattaggcgtgaaaaactccaatgaaatgccgagttgagatcttgtgctagctaagatcctcagacccttgttatgaccttatgttttctagggc

SEQ ID NO: 1064 - protein, 107 aa, Oryza sativa
MESSGGSQLGKNSKTSDGRETKATSSLLLLITAIHFVALCPKGENEDARKEVNSTAQNFVHFTEEEEDIVFRMHRLVGNRWELIAGRIPGRTAEEVEKFWAIKHQAT

SEQ ID NO: 1065 - protein, 78 aa, Oryza sativa
MDSSSGSQGKNSKTSDGCETKEVNNTAQNFVHFTEEEEDLVFRMHRLVGNRWELIAGRIPGRTAKEVEMFWAVKHQNT

SEQ ID NO: 1066 - DNA, 895 bp, Zea mays
  misc_feature (819)..(819): n is a, c, g, or t
attgggaccattgggtacctcgaggccggccgggaccttgtccagggactcaataggccagtaggcgattacaagggtggaagaaacatctagccttaacattccaggctacagcctaacccctctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatttatatagatgatatatgcaagcatgtgctgataaataatgttaaactgggcctacgatgttaccggtttttcagcctgtgcacatcttgttatgacatgatgctaattttgcaaaagcacagtaagaaaatttacagaacgtcagaaaatatcaatcatgttttagaagatgtgtaacagtatagtatgccttaagaaaagatgaattttgcctcttgcaaaaaaaaaaaaaaaaaagcggccaacttcagtaacgcagcttctcatggaggatgtgagctgttaccagcggtctttagatttctccccggcctgtatggaaaagaaagattcagcatcagaaacaaattcttaactagtcaactaccagcgaaagttgtccacaagtaatttgaggagcatggcgctcacaatggctagcgccctggacatccaggncattaacctatactggtcaggttcgttctttctgaggctttgaccacccggatcgtatatgacatgtgttttgcat

SEQ ID NO: 1067 - DNA, 1372 bp, Zea mays
ccggccgggatcttgtccagggactcaatagatcagtaggcgattacaagggtggaagaaacatctagccttaacgttccaggctactgcctaacccctctaatggatagcagcagtggtagccaggacaagaaattcagagacaatgatcgccctgaagcaaaaggttcaccattttcttgctttgctttgttttgctttacctttgctcgctgcctcttctgaagtctgaacttgtagctttttagttagtaccattgtgttcaagataatagctcatatgactttgttatttcaagagatctcacaccaacatatattctaatcctccgtgctttattttctctccgtcccaaaaagaatacaattctagcacagtgttatgtcatagtatcgtaaatttgatcaattatagataaaaaaagtaccaatatctatgataacaaataaatacgattagattattataagatgtgttttcataataaatttatttggagccataaatctaaatactattcactaaaaacgtgatcaaacatgaaccaatttagccggcatgtaacccatagttgcattctttttgggacagagtgaatacatgaaaactaaaacagatggtaaacagtgaccatttaggatacactataactgacaaaaactgtggggacaaacaggacgccatgtgatttaccatctgaccagcctaatgaagtgcagaggatttagccccttcgaaatagggggaaattattcctaggaaaattgcaaattctcttggcgaacataggattggcaaaccataatatatttctatatgggttggttaatggttttttttttcttactctcgtgatcaactatatcctttcacaattattgcagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatttatatagatgatatatgcaagcatgtgctgataaataatgttaaactgggcctacgatgttaccggtttttcagcctgtgcacatcttgttatgacatgatgctaattttgcaaaagcacagtaagaaaatttacagaacgtcagaaaatatcaatcatgttttagaagatgtgtaacagtatagtatgccttaagaaaagatgaattttgcctcttgcaacttcacttgtgtaccggcagaaaacttcagtaacgcagcttctcatggaggatgtgagctgttaccagcggtcttt

SEQ ID NO: 1068 - DNA, 620 bp, Glycine max
  misc_feature (496)..(496): n is a, c, g, or t
  misc_feature (606)..(606): n is a, c, g, or t
ttcattctttttgccttgacatgaatcaaaaccagcttcagccccttcctctccttagtagcttcttaggttcatctcctgaagaatctttgctacaaaaccaaaatgaaaatcctaatgcatgccatgctcaagttgaggatgttacagtggccttacacataggcctccctgaccattcaagtggctccaattccaccaataatcatggatttgtgaatgccacaactcaagttcctaacaattactggataccaactcaggagcagatcctcattgggtttagccatttctcttgtcctgtgtgccacaaaaccttcaaccgctacaacaaccttcagatgcatatgtggggacatgggtcacagtatcgcagaggcccagactcactgaaacgaacccatccacggcccttgttggaccttccatgctactgttgcgcaagagggtgcaagaacaacatcgagcacgcacgtgccaagcctctgaaggattntcgcacgcttcagacacactacaagaggaagcacggttccaagcccttcacgtgccgcaagtgtggcaagcctctggccgtgaaaggtgactggcgaacccacgagaaanactgtggcaaacga

SEQ ID NO: 1069 - DNA, 643 bp, Glycine max
agttcacaaattaactgagatttaattaagaataagataataattcacatgcagacattatatatataattaaaataaaaccagttcagttccattttcgatccttcagtcattatcttggtctacttctggggcgggctctgcgtcttcttcaaatccatcaatcccgtaagctgcatggccacttccaaaggctttgatgtgatccttaagggacctcttgtgcttgaaatcagatccacagatgcaataccaaagcttgccacagttcttctcatgtgttctccaatcacccctcacagcaaaggccttgccacattttctgcacatgaagggcttaatcccatgcttcctcttgtagtgtgtttggagggttctgaagtctttgaggggctttgctcttgggtgatcaatgttgttcctgcaacctggggaacagcaatagcatggaagccttagcatacctgttggttgggtacccctcagagattcaggcccttttctgtactgtgatccatgcccccacatatgcatctgcatgttgttggatctgttgaaaggtttgcaacaaacgggacaagggaactgagttgggaccatgaggatcttgagaaggggtagggaacccaggactggccctttg

SEQ ID NO: 1070 - DNA, 1224 bp, Glycine max
cgttaattagagatggtagtcatagtcaacaattcaattagttcaaaacacgagagaatcctcaattgtcttgtcttcatagttgaaattaaacacatcaactacgactggaaattaaaaagattcattattttcctgctcaatttcagagccggcttcatcatcttgatcaagacacgagtcgattccataagctttatgtccattcccaaatgccttgatatgatctttgagagatcttttgtgcttaaaatcggacccacaagagcaataccatagcttcccacagttcttctcgtgagtcctccaatcacccctcacagcaaatgctttgcaacattttctacacatgaaaggcttgattccatgctttctcttgtaatgggtttggagggtcctaaagtctttgagtggctttgctcttggatggtcaatgttgttcttgcatccttgtgcacagcaatagcaagggagcctaagcattgctgttggttgagttccccttagagactctggcccctttctatattgagatccgtgcccccacatatgcatctgcatgttgttgtatctgttgaacgtcttgcaacaaagggggcatgagaaccgtgttggaccgatcagaatttgagcaggggtagggatccaatactgacccttgttaattctggtcggagaatactcagaagcaaccgtggcttttttatcttctttgtctgagtacacgtttgaagttaaatcagctgatgaagtagcagtagtagtagtgcttggaagccctaagtgcaaagccaccgtcacagcagtttcatcatccaaagagttattattagctgacatgcttagttctttctccttctctttgttgactttcatggcactgaaggaagattcaagatcttcacctcttgcagggcttaggttaaggagaggaagttcttcttttggaaggggaaaggagctgggagaagattgaatatgctgcgtaaaagagatgtcattatttgtgcagttatgaaggtaattagtattactagtaggaaagtaaaatggtgggttattggagcaaggtgatgaagaagtggaaaaaaggcatggagaattgaggtcaaaccaagcattgaagtcattggagcagtagggatgagtcatgatgagagggtgggaaaaggaaggaaggggatatatgatcgcgtagaaaggattaggttattatagacacaa

SEQ ID NO: 1071 - DNA, 359 bp, Glycine max
  misc_feature (268)..(268): n is a, c, g, or t
  misc_feature (278)..(278): n is a, c, g, or t
  misc_feature (291)..(291): n is a, c, g, or t
  misc_feature (301)..(301): n is a, c, g, or t
  misc_feature (318)..(318): n is a, c, g, or t
ttttcttgtagtgagtttgaagggttctgaagtctttgagtggttttgctcttggatggtcgatgttgttcttgcaccccggtgcacagcaatagcaaggaagtcttagcatagccgtgggttgtgttccccttagagactctggtcccttcctatattgagatccatgcccccacatatgcatctgcatgttgttgtatctgttgaacgtcttgaaacaaagggggcatgggaactgtgttggaccaatcagaatctgagaagaagntagggatccnaatattgtcctcntgttaattcntatttgacagaagaagnccccgaagcatccaagtgaggtactactttttcttcctcga

SEQ ID NO: 1072 - DNA, 1515 bp, Glycine max
ctgataccgcaatctctttcgcattctctctctctctctctccaccgtccactcccttcagccatcttgtactctctctatctctctataaaagcaaacgcaactagccataaactgttcccactctctcctcaacacctttctttttcctttccacccatggctgacccctactccaatttcttctcttcctcttcacccttgttccgtttcaaccacaaccaatatttcccttcttcaaacccttctccacaacaccacaaccacaacttcatcaaccacacaaaaaccaacgacaccaccaccaccaccgcctttttccactaccaccaacaccaaactactactgctttttcttcttttccaccctcacctcctttgagagaagaactacccctcttgaagctgagtccaacaaagcaagatgaggaggaagtagaggacttggtgtctaattgcactggtggagccatggacgtggaagagaggatccaccttaaagaggaattagaagatgatgaagatggaagtactagtgtcactgttgcactccacatagggttgccaagccctagtgctgctgagatggcttctgtcctctcttcttcctctcatgagatcactgacaaagaccaacatggagatcatggtgctgctgaggattcttcttctgctggcttcagactcaacaagggccagtactggatccctaccccttcccagattctcattggccctacccagttctcttgccctgtttgctgcaaaactttcaacagatacaacaacatgcagatgcacatgtgggggcatggatcacagtacagaaaaggacctgaatctctgaggggaacccaaccaacaggaatgtgaggcttccttgctattgttgtgccccagggtgcagaaacaacattgaccccccaagagcgaagcctctcaaagactttagaacactccaaacgcattacaagaggaagcatgggatcaagcccttcatgtgcaggaaatgtggcaaggcttttgctgtgaggggagattggagaactcatgagaagaactgtggcaagctttggtactgtatttgtggctccgatttcaagcacaagaggtcccttaaagaccatattaaagcattcgggagtggccatgcagcttatggcatcgatggattcgaagaagaagatgagcctgcatctgaagtagagcaagataatgatgattccacccagtgattaatgagaattaatgcatgggttaatatatgtgaattatcctagttattttgtgaaatgattggggatgaatatatataaagcttaatttggcttcctagctatttcagcactatatataagcaccaagtttaaatggaaagccaatcttttttttttaaaaaaaaattatctttcttctgttggcaatgttagctaggactaggagagactggatactgaacacatagctggtaaagctagatatatatatccaacttctttgaatttgttctcgtgt

SEQ ID NO: 1073 - DNA, 524 bp, Oryza sativa
  misc_feature (459)..(459): n is a, c, g, or t
agttcttctcgtgggtgcgccagtcgccgcggacggcgaggggcttgccgcacttgcggcaggcgaagggcttggcgcagtgcttccgcttgtagtgggtctgcagcgtgcggaagtccttgagggggcgcgcccgcgggtggtccacgttgttccggcaccccgccgcgcagcagattcttttcagccgcagcatcgccgccggctgcgtcccccgcagcgactccggacccctcctgcactgcgacccatgcccccacatatgcatctgcaggttgttgtatctgctgaaggtcttgcagcaaacagggcaggcaaagtgtgtaggaccaatgaggatctgggttggggtagggatccaatacttgcccttggtgagctttcccatagagaagtagtccaagcagaggtcatcactagctgcttcttcttcctcctccctctccacctccaccttgngatcatcatcatcatcaccatcaagctcttgtgatgtcgacgcggacgcgccaagaggattgctc

SEQ ID NO: 1074 - protein, 322 aa, Oryza sativa
MEDYAQTNLISRGHGHHHQPELMKEFPFLSLISSTSSCISSSGQQQQQQQDDDGHGGHDRHQLLRYGCCSCNKQQEEEEEEVTVALRIGLPAVSSASASPSPAMANHGASASSTGVAGDDGGGGAMAGVGVEVESVRRSGGGGGGGQYWIPTAAQILAGATQFSCPVCRKTFNRYNNLQMHMWGHGSQYRRGGTAALRGAQPTAMLRLPCYCCAAGCRNHIDHPRARPLKDFRTLQTHYRRRHGARDFACRRCAKRFAVRGDWRTHEKNCGRLWRCACGAHFRHKRSLNDHARAFGAAHAHAGAGAGAEDDGRAAAAAAVWV

SEQ ID NO: 1075 - protein, 438 aa, Oryza sativa
MEDPYTSFFKNPYYYYCTSASSFPTAPAAAAAAAHLPPPLPPPYAALYPTAGGVGVGVGAHHHHQYPPAAFFHPPPVHQQHQAPPSPPLREALPLLSLSPTPARRGGVVDAAADSDSDDDDDGDCCYHHLQDQEGAAAGSTATPAAAAARAPLFADLNCIPTCCGDDNDGGDPMDVEVAGTTADIDAAVALRIGLPAGGTEADLLSGLTGAGVEHEEEEEDCKVDGGGSGGDDEVVPLGFSSTPIGKLNKGQYWIPTPSQILIGPTQFSCPVCFKTFNRYNNMQMHMWGHGSQYRKGPESLRGVQPTAMLRLPCYCCAAGCRNNIDHPRARPLKDFRTLQTHYKRKHGLKPFLCRKCGKAFAVKGDWRTHEKNCGKLWYCLCGSEFKHKRSLKDHARAFGHAHTALDADDDDGAVSDADAVVRPSSSMAASSLQPPPR

SEQ ID NO: 1076 - protein, 395 aa, Oryza sativa
MGDPYTNFLRGYHHHHRSHHPLHFPPPPPPPPPPYAASFSGLYSSYLHPPPPPSSPPIREALPLLSLTPSTTHDDDHHHRRHDQDHHHHHKQGQEKNSHGGGGAASCSNNDDKRESPSAAAAADDQAAEVTVALHIGLPSPSPSDAAAAAGNQAAAAAAAEASAAGGGSSRMQVEEEGGEEEDEDEAAAAAATATLPLGCASIGIGKLTKGQYWIPTPSQILIGPTQFSCPVCYKTFNRYNNMQMHMWGHGSQYRKGPESLRGTQPTAMLRLPCYCCAAGCRNNIDHPRARPLKDFRTLQTHYKRKHGIKPFMCRKCGKAFAVRGDWRTHEKNCGKLWYCACGSDFKHKRSLKDHIRAFGRGHAACGIDSFDDLDADDDPSSDLDHASASASRVG

SEQ ID NO: 1077 - protein, 438 aa, Oryza sativa
MEDPYTSFFKNPYYYYCTSASSFPTAPAAAAAAAHLPPPLPPPYAALYPTAGGVGVGVGAHHHHQYPPAAFFHPPPVHQQHQAPPSPPLREALPLLSLSPTPARRGGVVDAAADSDSDDDDDGDCCYHHLQDQEGAAAGSTVTPAAAAARAPLFADLNCIPTCCGGKSNGGDPMDVEVAGTTADIDAAVALRIGLPAGGTEADLLSGLTGAGVEHEEEEEDCKVDGGGSGGDDEVVPLGFSSTPIGKLNKGQYWIPTPSQILIGPTQFSCPVCFKTFNRYNNMQMHMWGHGSQYRKGPESLRGVQPTAMLRLPCYCCAAGCRNNIDHPRARPLKDFRTLQTHYKRKHGLKPFLCRKCGKAFAVKGDWRTHEKNCGKLWYCLCGSEFKHKRSLKDHARAFGHAHTALDADDDDGAVSDADAVVRPSSSMAASSLQPPPR

SEQ ID NO: 1078 - protein, 442 aa, Oryza sativa
MENPYYASFLKNHHRRYCFSTPPSPSPSPAGAYSSSSFPFFPTAGVTSTTAATPPTTTAPPSPPLREALPLLSLTPASRGGTTAAQERARQRGEEDCTDDDDGAEEEGADEEDVPGSTPGGGGGGGGDRHHQLRRRRAGRLFADLNTKAAAGDPMDVEGSGSGCCAAEAAAAGDDDADVTVALHIGLPSPTAAADLISGLSSAAGRRSSTARRDEEEDEAEEAGGASRDDGDGGDAADAAAPLGFASTPIGRLNKGQYWIPTPSQILIGPTQFSCPVCFKTFNRYNNMQMHMWGHGSQYRKGPESLRGIQPTAMLRLPCYCCAAGCRNNIDHPRAKPLKDFRTLQTHYKRKHGLKPFLCRKCGKAFAVKGDWRTHEKNCGKLWYCLCGSEFKHKRSLKDHARAFGHGHGALGGAAALDDDDDGAVSDLDHDSSSTAPAARSL

SEQ ID NO: 1079 - protein, 366 aa, Oryza sativa
MEGEVVAASPFFEWLKPPPRPASSSSWSSSFSSSSSMASRDQETVVPGEDGGGEIQEDHKSGMTCLPLLSMLEEGNSKRHEHPVKEEIMSSAHAAGVVEPGVELNIGLPVTGSSAQEVTMEEDDEEEDDDDVGEEEMDEWKPMHGGCKVEGDEEQYGEAVASVEGSSSITAVGDMFGGVGAESGVAMSSRYWIPTPAQILVGPVQFICHVCNKTFNRYNNMQMHMWGHGREYRKGPESLKGTQTLAMLKLPCYCCAAGCKNNVAHPRARPLKDFRTLQTHYKRKHGAKPFRCRRCAKPFAVKGDWRTHEKNCGKRWFCACGSDFKHKRSLNDHVRSFGAHHLPVAESAAAAATTPADKDRIISFQR

SEQ ID NO: 1080 - DNA, 592 bp, Zea mays
gccgttcctgtgccgcaagtgcggcaaggcgttcgccgtcaagggcgactggcgcacgcacgagaagaactgcggcaggctctggtactgcctgtgcggctccgagttcaagcacaagcgctcgctcaaggaccacgcgcgcgccttcggccacggccacggcgccttcggctgcaacaacctcgacggcgacggcgacggcgacggcggtgctggcggcggcgccaacggcctcgacgacgacgacgacgacggcgccgtctccgagatcgagcacgactactgcgccgccgcgcggtgatcgatcgtgcatcgatctgtacgtggtgggtgccagtgccacactagctagctagtagcttgcttgctctagtagtgctatatatacccggctgaccggcggtgttaatttcttgttctctcgcatgcattgttagtttgcggcggccgggctgtattacgtgttgcggccggcccggccccggcctgtcgttgtttgcttttgctctaattagggttgtggagggtcgtcctgatgatttatatccatctctaagctagctaccttgaaggtacgttattagtttgtgtc

SEQ ID NO: 1081 - DNA, 992 bp, Zea mays
ctttttttttttttttgttaaaaaaggccgaggataaatgccttagcccgctattttaaacactgagtaagacacggacagatggatgatatgcatggttatacacacacgcacacaagcatacgtttgcatttggctacagatcgactggttgctgtgtaggatgtatgtagtaggaccgtacgtactcacccttgtcgatctatagtagtcggtcgtcgccggagcctctgctcgacgacgacagtggcggcggcggcggcttccagctggtgtggtgatggtggtgagcattggcggcggcagcggtagtagtggtgctgttactagtagtgttggtggctgcgtggtcgacctcggatgacgacgggtcgtcgcggtcgtcgtcgtcgtcgaagcagtcgtcgacgccgcaggcggcgtggccgcggccgaacgcccggatgtggtccttgagggagcgcttgtgcttgaagtcggagccgcaggcgcagtaccagagcctgccgcagttcttctcgtgggtgcgccagtcgccgcgcacggcgaagggcttgccgcacttgcggcacatgaagggcttgatgccgtgcctgcggcggtagtgcgtctgcagcgtgcggaagtccttgagcgggcgcgcccgcgggtggtcgatgttgttccggcaccccgccgcgcagcagtagcacggcagccgcagcatcgccgtcggctgcgtgccccgcagcgactccgggcccttgcggtactgcgacccgtggccccacatgtgcatctgcatgttgttgtatcggttgaaggtcttgtagcagacggggcaggagaactgggtgggcccaatgaggatctgcgacggggtggggatccagtactgccctttcgtcagcctgccgatcccgacgatggacgcgcagcccaccggcatggcggcggcctcctcctcctcctcttctcctccttgctcctgcaggctcctcccggacgcgtgg

SEQ ID NO: 1082 - DNA, 1405 bp, Glycine max
ggtttgtttttttcttaattgttttatttagacccggaagctgaagttgtcgccttgtctccaaagactctcttggcaactaataggttcctttgtggcagctcccacaaaggatttcaaagagaccagaatctccaacttcacagaagaggacacaatttaccatggaagctgaagcagagatcaagcaaagacattataaggaagaaggtgtatgtgtgcccagaacctagttgcgtgcaccacgagccttcaagggccctgggggacctcactggcatcaagaagcacttctgcagaaaacacggcgagaagaagtggaaatgtgacaagtgctccaagaagtatgctgttcaatcagactggaaagctcactccaagacctgtggcactagagagtacagatgtgactgtggaaccctcttctcaaggagggacagtttcataacacacagagccttctgcgatgcattagcagaggagagtgcaagatcagtgacaggcatagtagccaactcaacaactcaaccaactgaagcagcaggagtagtgatctcttcatcctctcttcatcaagacatgatccatgctagtaataataatttcccattgaagaaagagcaacaaggttgcataccccattggcttgggcaaccatcaccctcttctgcttcatcatcattcttgttctctcatcaagatcatcatctccatgaaaaccctaaccctagaggtggtcccactcttcttcctcctccttaccaccaaacagctcctcacatgtcagccacagcattgctgcagaaagcagcccaaatgggtgcaacgatgagcaaaaccggctccatgattaggacccaccaacagcaggctcacgtgtctgccaatgctgctttgaatttgtcctcacgtgaccaccagatgaaccccactccccatgacttgctacctttcgggaataataaagctgttgataacggtgttggtgtttctccttcactccttcatcatgttatcaattctttctcttcttccccctttgaagggacttttgaggacacttttggtggtggcgatgccatgaccgccgatgaaggtggcggtggcggtgccggaggaaacaataacgaaggcttgacaagagatttcttgggtcttagacatctctctcacactgatatcctcaacattgctggcgtgggaaactgcatgaactcctcccaacacaaccaaacccgaaacccttggcaaggttaactccatatgtcttatacatatttggattctttttctttaatatattaatatacatttattttagcttatttttaaattttgcttttgtttatgatatatattgtcaatcttcccgaacctttcggaatcccaatattttctttcctta

SEQ ID NO: 1083 - DNA, 2092 bp, Glycine max
  misc_feature (2052)..(2052): n is a, c, g, or t
agccaagcaagaagtgtgtatttgaacaaaagtttaatttttttttagccaaaacactttttaactcttattttgaagcaaaagaaacacacaataaagagagaaatattgcagtgatatttttctgggggttgagaaagagaacagaagaaaagacagaaagctcaacgtcagagttagccgtataaggttcgcttattgtgtgtttgtggttttggactagctgaggtttgtcctttggatcccagaaacctttccagcatttgaaaaaccaagatctatggcctataccacaaccttaggtttctaaaacttgcaagttgcaagtatatatatggagatgaagggttttatgttctaccaacaacagcaacagcaacaaatagtggaggagaacatgtcaaatttgacttctgcatctggtgaagctagtgcttcctcaggtaacagaactgaaattggaaccagctacatggctccaccaccaactcagattcaaccaccaaagaaaaaaagaaacctccctggcaatccagaccctgatgctgaggttatagccttgtcccccaagagtcttcttgccacaaacaggttcatttgtgagatctgcaacaaaggatttcaaagagaccagaaccttcagcttcacagaagagggcacaatttgccatggaagctgaagcagagaacaagcaaagaggtgaggaagaaggtgtatgtgtgtccagagccaagttgtgtgcatcatgacccatcaagggccctgggggacctaactgggatcaagagcacttctgcagaaagcacggtgagaaagagtggaatgtgacagtgctcaagagtatgcagttcaatcagattggaaagctcactccaaaacctgtggcactagggagtacagatgtgactgtggaaccctcttctcaaggagggacagtttcataacccacagagctttctgtgatgcattggcagaggagagtgcaagagccatcgcaaacccacttcttcccccacaacaacaacaatcttcttcctctcacatgagtactctccaaacccaattcaaccctcaaaacctccatgccttcccattgaaaaaagaaatgcccccttggcttggcccaccagcaacagtagttgttgatcatcatctgtcttcatcctcatccataatgttctctcctccacaccttgaaaaccctaaccctagtcttggtcccactcttgctgcctaccaaacagtccctaatccacacatgtcagccactgcattgctgcagaaagcagctcagatgggtgcaaccatgagcagaagtggttccacaccagccatgactgggccccaccatcatgctcacgtgtctcattttggcttgaacttgtcctcacgtgaagacaccaccaccaccaccccttcaacaacaactactaatgctaacactgctacagtgttcagccatggcttattatcatcatcaccattggggaataaagctgctgctgctgctgctgtgtcttcttccgcaccatcccttcttcacgatgttatcaactctttctcttctccttctgcctttgaaggaaccccttttgaggatgcattcattcagagctcaaagaaactagatgatgatcataacttgtatttgcatgacacattctcaaaaacaagtggtgcagctgggaataatattaatgaagggttgaccagagatttcttgggtcttaggcccctctctcatgctgatattctcaccatcgctggcattggaaattgcatccatgatcagcagaaccagtctcaaaagccatggcaaggttagctatagctatgtagctccatatatatatgtggatcttctttttcatcctttaattaatcatctatatatataaattttttcccttttaaattagtgtaacttttgtttatgatcttttcgatcttcccaaagggaaggacctttctgaatcgatcccaatgtttttattccttatgtacttatctacgaatcgcaatattgtgttcattattacacagatgaattntatgttatatataagaaaagactagatagtagacgaaaaa

SEQ ID NO: 1084 - DNA, 2570 bp, Glycine max
gaaataataataagtattatcttagtttgggtgcttatatatataattgcatattaataattaatggtgagggagcaccagaactactgagagatgctatgcatagtttaattacttgttttggtactcacgttgtgtgcagatccaagtgctgaagttattgctttatcaccgaccacactaatggctacgaacaggttcatatgtgaaatctgcaacaaaggatttcaaagagaccaaaaccttcagttgcaccggcgaggccacaacttgccatggaagctcaagcagagaaccagcacagaaattcgaaagagggtttacgtgtgtccagaaccttcgtgcgtccaccacaacccagcaagagcactcggtgatctcactggtatcaaaaagcacttctgcagaaagcacggcgagaagaagtggaaatgtgataagtgctcaaagaaatacgctgttcagtctgactggaaagcccactcaaaaatatgtggtacaagggaatacaaatgtgactgtggtaccatcttttccaggttgatgcatacacacatgtatcaaatttctacgtcatatatatatatatatatatatatatgaaatttgactcatcaatattcatccatggtttcagtgcataagttgcatgcagcacttgtccttttataaataaaatgttacatgggatctttccttgaccacacacacccttgttgacttaaaaaatggaattacttactttccatctttgaatttattttcgtatacctttaagttagtttatctgttttgaaaatttttctctagttttgataaacctttctttatcatatacgaaaataagcaagggtatacgcagcccttgattaataatcaacacaattaagcaagtggcatctatataaaatatttttgcatatatacaacggaagtcattttggtctacaagcataagtcactataaatacatagatatatattaaatttatttgactcagtcaaagatttcaccactttttatttgataataataataaacatgcatgatcctcatgaacaactatatatatttatatatatctacttggcattatttatatgcagctcgcgaaactcatatctctttttttacttaatgcatgcatcattattgcttactgagtgcttcacattcatcgatctaactttgcagaagagacagcttcattacgcacagagcattctgtgacgcactagcggaggagaacaacaaagccaacgaaggacaattgccaaagataggtccaaacttgcaatgccaacaaatcccaaacctcgtttcatcatcattaccaatcaacaccaacattgttcccaaccccacaaatgggtggcacctcggagttcaaccatgctgatcacaagcacccactatcactcccacacgagctcatgccaatgcctgcacaaaaatccttcaacaacaacatggctgcaggaacaacagtgttcacgagaagcctctcatcaacctcctctccctctcttcaactaagctcaaacatgttcgatgaaaacgggctccaccttgctgcagggtcgccacacatgtcagccactgcgttgttgcaaaaagctgcgcaaatgggagcaacactgaccgaaaaaagtacttttgcaacaaacatggcaccaccatcgtttggtgtgctgcaacagcatcatcatcatcaacaaccaaatgggcaacccttcacgaaccagtacatgcacagtggccaccaccaccaacaacaagaggttaacatttctactcagtatagtttcggtagtgcaaatgggatgggtggagggagcgttgggatgaacggtgtggacatgttcaacgctattttggaccaaagcaaggctttgtcgaagatcatagagcaaaacaacaatagaagcagtagtggaggaacaacaaatggaggttcgagtagtgctattaataacgttgctggaagtaaaggaagtggggatgttatgactcttgactttttgggaataggaggtggaggaagtggtagtggtgggggtgcacatggaaatttctatggtggtgctcaacaaggggaaactggtgcaccggatgaggtttggagaaactggtctagtaagaacgcaggctttgaatcattttcaacaacgagcagcatttgaaaaagatcacccgacaaggaataaaagtcaacttttttagagggtggaattttcagctgatttggtcgttatgtgcttctttttctttaactaattaatcctccctttcggccacatatatagaatagaaatcgtgcgacaaacgactgaacgtgtctttctaaagaggaagacgcattgagtcgtcgacagtgtggtcgagtttcgcagcaccagccagtgcaacagtgtagacccatatccttagaggatctcataaatttgtgttcaaatgttaaaattaaggataatgtcaatttctgaaacacttttttatagttcatttttttaatctctcttttaatttagcgcattcctctcaatatatattgtctttttatctctcc

SEQ ID NO: 1085 - DNA, 954 bp, Oryza sativa
gctgctgctccctcttgaggcacagctcttgcatcagcccatgcccccccatcgccatcgccgcctggtgatcaagcacatccgccacctgcgagaagagcatcccgccgccatgctgctgctgccccgccaccgccgccgccgccgtgaccgccctcgcgctctcctccgccagcgcgtcgcagaacgccctgtgcgtgatgaagctgtcccgccgggagaagagggtgccgcaatcgcagcggtactcgcgggtgccgcagaccttggagtgggccttccagtcggagtggacggcgtagcgcttggagcacttgtcgcacttccacttcttctcgccatgcttgcggctgaagtgcttcttgatgccggtgaggtcgccgagggcgcgcgccgggtcgtggtggacgcagccgggctccgggcacacgtacaccttcttcctcaccacctccttggggttccgctgcttcagcttccatggcaggttgtgccctcgccggtgcagctgcaggttctggtctcgctggaaccctttcccgcagatctcgcacacgtacctgttcgtcgccatcagcgtcctcggcgacagcgcgatcacctccgcctcaggatctgggttgccggggaggccggcgcctcctccccgcgggagccgctgcggggtgggacgagacgctggcctggtcgccggacgccgacgtcaggttcgacatgttctcctcggcggcggcgagcagctgctgctgctgaatttcggccagatccttgagcatcatctggacgaacttctcttgaattctaccagctgctgctgattatgatatctgaacgtatgatcaatcgatcagcgatggatcaatatcaatcagatctcgctgcgccggtggcgatcgatcgcacttgcacccctgtaacttacaccgatcgatctctgacggcgaggcctcgtgc

SEQ ID NO: 1086 - protein, 487 aa, Oryza sativa
MMLKDLAEIQQQQLLAAAEENMSNLTSASGDQASVSSHPAPPPAKKKRSLPGNPDPEAEVIALSPRTLMATNRYVCEICGKGFQRDQNLQLHRRGHNLPWKLKQRNPKEVVRKKVYVCPEAGCVHHDPARALGDLTGIKKHFSRKHGEKKWKCDKCSKRYAVHSDWKAHSKVCGTREYRCDCGTLFSRRDSFITHRAFCDALAEESARAVTAAAAVAGQQQHGGGMLFSQVADVLDHQAAMAMGGHGLMQELCLKREQQQQQQQFAPSWLTAQQQQQQLEAMAGAGNPAAMYGSARLDQEFIGSSTPESGGAQQAGLSFGFSSTSSAPPHPAASSAHMSATALLQKAAQMGATLSRPSSHAHMAAAAAASTHNSSSSAATTNAPPPPPTSNVSSTCVGAGGYGLAFEASHFIAADESSRGARSDRDTGNGVAGAGNDGLTRDFLGLRAFSHGNIMSMAGFDPCMSTTSASSAAPYDHHHHSNKPWHS

SEQ ID NO: 1087 - protein, 216 aa, Oryza sativa
MATNRFVCEICGKGFQRDQNLQLHRRGHNLPWKLKQRGSKEAVRKKVYICPEASCVHHDPSRALGDLTGIKKHFFRKHGEKKWKCDKCSKKYAVHSDWKAHSKICGTREYKCDCGTIFSRRDSFITHRAFCDALTEESAKAIGGIPAAMAAPGHHHHHHHHHHQLLFSPPPVMAHHQELAALQEQQQQQHHQDVMQSPHQHQQQQQQRQQLVQQNC

SEQ ID NO: 1088 - DNA, 2593 bp, Zea mays
ttttttttaaaagatgatgaatgcatgcatgtattattactgtcacatatagctatggtttcccgccctgggctggagcttagcttacatgttggccgagctcttcgccaacccaaaaaaaaaaaattatacaactccctgcgtacctctgtatcaccaattctggcatcaccatccttggaccgggctagagtttgatcggaacggtttgatcgcttgcggggttaccacatgcatgagaggatatcctgaacagaagcaaaagatgagcaaagggcacggggccccgagcggccggccctagctagctttgcctctgcacagcgacggcagcgatgagatgcagcgatggcgacgtaccgatgacgcggctggcgagaggaagaagaaagtagcttttatcgacctagctttgatggctgcccatgctgtgccattgctcgttgctgctttgctgctgctgctgctctgcctgagcctgtgcacgctgctgtggctcgtcgtagcagctcatgctggcgctggcactgatgatggcgcccatgcacgaggagtccaagccggcgaggccgaggatgtcgcggtgggagaaggcgcgcaggcctaggaaatccctggtcatgccgtcgcctccgccgccgccgccgccttcctcgccgccgcggccgtgggaggctgtcctcgcgagcccggccatgatcccgccgtcctgatgctgctgctgctgggtattctgcaggtccgggaggccgaggccgaaggtggcgcttgtcgccgcccccgccatctgggtgtagcccgcgccggcgacggtggcgcccatctgcgccgccttctgcaacagcgcccgtgcccgataggggcgcgtaggcagcgggaagctgcgtcgtcgtcggcggcggcggcgtggacgtggccgagctctgcggtgcggcggcgttgcagagcggctgcagcagcgggtggtcgtaggtcatccccggccacggcggcatctccgtcttcatggcgtagttgcagtgctcctgctgcatgacctcctggtggtggtgctcctggaggagggcgacgtcctgctgcctgacgtgcgtggcgcggcggcgagaagagcatcgggtggtggtggtgctgcgccggcacgcccgccatggcgttgaggccgatggcctggcgctctcctcggtgagcgcgtcgcagaaggcgcggtgcgtgatgaagctgtcccgcctggagaagatggtgccgcagtcgcacttgtactccctggtgccgcagatcttggagtgcgccttccagtcggagtggacggcgtacttcttggagcacttgtcgcacttccacttcttctcgccgtgcttgcggaagaagtgcttcttgatgccggtgaggtcgcccagcgcgcgggcggggtcgtggtgcacgcacgacgcctcggggcacacgtacaccttcctccgctgcgcctccttgcccgtgccgcgctgcttcagcttccacggcaaggttgtggccgcgccggtgcagctgcaggttctggtcccgctggaaccccttcccgcagatctcgcacacgaaacggttcgtcgccatcagcgtcgccggggagagagccacgacctccgcctcggggtcggggttgcctgggaggctccgtttccgcttgttgttgccggaggccgcgggcgccggcggggcagcagcagcagcagcaggcgccgcgttggggccgccggacgtggaggaggtgaggttggacatgctgctctcccgatctgccgctgcagcttctgcctgcaagagctcctgctgatggtggaacatagtagctaggtgaggaggagaacccaaggacgacgacgaatggagtccaagactgcaagggcggctagtagctttcgcctgatcttgcacttgttgtgtgtgtctatatctataaatctatctatatatacacacactactggtacctagctagctaggggaagatagctagctgaagggaggtgtggcagacaataaatcgagagacgaactcgtgaaggatgaaggaggatggggcaagcagaagcaggcatcagacaagggggtatgtatgggagagggggagagagatgctaaggaggttgatgcatgagaaggcctccaagccgaagcagggagcaagcaggcagggaggagcagcaagcagctcaataatcaaggaggcgcaggggggacacaacgagagggaaagcaattccagattctttctatcatacgactcctcaccctctctctctccctactctcccctgacggcttcttggctttctctctccactctgctctgtggtgtgaactgtgaagacgtgcagtcgatcgagcagcgcgcggcagcaggtgaaggcaacagctgcctagctaggagtgtgtatctagagctggcagcacgccatgcagcgcgcaggcacggacgaaagaggccgcagcagtcatggccgccgaggtccggaggaggaggacatggggagagagcaggaggagggaagaggaacagtgtcagcgcctccctagcggcagagaagagaagcaaagggtaagaaggccctgtgtc

SEQ ID NO: 1089 - DNA, 1666 bp, Zea mays
gcggaccccggcggccggccagaactgcaagagagaagaccaagaaacagagagagacaagcgcaggggacagcagcgggtagctagctagctagcgatcgacgacagacgatgcagatgatgatgctctctgatctctcgtctgacgaccacgaggccactggatccagctcctatggcggggacatggccagctacgccctcagccctctcttcctcgcaccggcggcctcggccaccgcgccgctgccgccacctccgcagccgccggccgaggagctcaccaacaagcaggccgcgggcggcggcaagaggaagagaagccagccgggcaacccagaccccggcgcggaggtgatcgcgctgtcgccgcgcacgctggtggcgacgaaccggttcgtgtgcgagatctgcaacaaggggttccagcgggaccagaacctgcagctgcaccgccggggccacaacctcccctggaagctccgccagcgcagcagcctcgtcgtcccgtcgtcgtcggcggcggcaggctccggcggcaggcagcagcagcagcagggcgaggccgcgccgacgccgccgcgtaagcgcgtctacgtctgccccgagcccacgtgcgtgcaccacgacccggcgagagctctgggggacttgactgggatcaagaagcacttctcgcggaagcacggggagaagcggtggtgctgcgagcgctgcgggaagcgctacgccgtgcagtcggactggaaggcgcacgtcaaggggtgtggcacgcgcgagtaccgctgcgactgcggcatcctcttctccaggaaggacagcctgctcacgcacagggccttctgcgatgccctagcagaggagagcgcgaggcttcttgcagcagcagcaaacaacggcagcactatcaccaccacgaccagcagcagcaacaacaatgatcttctcaacgccagcaataatatcacgccattattcctcccgttcgccagctctcctcctcctgtcgtcgtagcggcggcacaaaaccctaataacaccctcttcttcctgcaccaagagctgtcccccttcctgcaaccgagggtgacgatgcaacaacaaccctcgccctatcttgacctccatatgcacgtcgacgccagcatcgtcaccaccaccggtggtctcgcggacggcacgccggtcagctttggcctcgctctggacggctcggtggccaccgtcggccaccggcgcctcactagggacttcctcggtgtcgatggtggcggtcgtcaggtcgaggagctgcagcttccactgtgcgccacagcagccgcagcaggtgccagccgcaccgccagctgcgccaccgacctgacaaggcagtgcctcggcggccggctgccgccggtcaacgagacctggagccacaacttctaggcccgctatatacttcaagctgcattgagactttgagagacgaatgaacggaacacccaaactgcatgcactctagcttgaagagcaaccaaaactggagtagcaagtatggtgcactactgttgttaatttaccttaatttattgatctctgttagttctattttcatttagggcaatgcgggctagctaattaattcgatgtgcacaacttttgatgaatggaccagaaagtttatctt

SEQ ID NO: 1090 - DNA, 761 bp, Glycine max
  misc_feature (26)..(26): n is a, c, g, or t
gttacatctgcatgaaaagaacatanttccaggaatatatagttgtacttgataaaggaagtaaagaaaatattcaatggagaaactagtaagttcttatatcccataaacatgagaaagaaagactacccctaccaaataatggatctaaggccttaggaacaaaaaccaattacccacttgtctgtacattgtcattgctttcatcatatggggataaagacaagacattttcagaactccagagacattcagctacctcaacagaagatgcttcaaaatgatgcaaaaaaaaaaaaccaggattttggcaccaacatttctttctccctattcatcaaccggtgctggtagattgagatcaatgaggcaaggaacagcagcaggaggagcacttggccttatcacaagtgtgttttcctcagaacccccaacaaaatgggaccttttgtgaccccccaaggcttggcctgacctgaaaatcttgttgcaaattggacactcatgtgccttgcttttctttgacttcaatttcttcttcttcttccccttctggacactgaggttgttcctgttgctgtgagcctttggagcaggataagaatcagtgtcagtgctgttctcatcactcccataagcagaatcatcagaacaaccattgtacatttcattagtccccttctgtcgtcttctcgcagtcgtacggacgcgtgggcgcacgcgtgggcgcacgcgtgggcgtacgcgtgggtcgaccaggg

SEQ ID NO: 1091 - DNA, 482 bp, Glycine max
  misc_feature (391)..(391): n is a, c, g, or t
atacgcgtccgcgctcactcactcactccttgggttgttcttttctcccttggcttcctcatccatcatcgctatcattagcaaattaacaaagacatggggtttctcttcttcttcttctccttatttttcttctctccaaccactttcaagatgtgatgctgatctggggtgttgctggttttcccttgtgatcgatttctcttgtgttggtggtgatcaagaaagtgtggttaattttgctttctttgctgatccgtgcgtgtgtgtgatcttgaaaaatcaatccaatggaagaagatcaagaagtgaaacacatgtgcaagttctgcagcaagagctttccttgtggaagatccttgggtggccacatgaggtcacatgtcaccgncaatgtttcaaccgaggcagagaagctttcatctttcaacaacaatggttgaggatgagattctgcatcaggagggactaacactggagga

SEQ ID NO: 1092 - protein, 423 aa, Oryza sativa
MDAGGVELSGVMHRCRVCGKGFSCGRSLGGHMRSHISFGEAAAELGANGGVVGYGLRENPKKTRRLSEFDGDGDGEEVEVEEGGDGGELRACRECGKLFSSWRSLFGHMRRHASGGGGRNHDDDDDDDVDVEDEFGGGEEEEIVAPAPAAVTVIAAPPRRRRRSMRVAAPAPAPAPPRPVLLGGFEKEQEDVALGLLMLSRDTGVWRSPVKAETFEKPEQKKKKATAKQPPPLPLPRNGYGYGYNSDEDSALLQYGGDVAKSRKRRASYHSPNSISSKKKQQPRAAAPAKRTRYECPGCGKVFASYQALGGHRASHKRINTSCSAPKVSPATAAAAAPAPEPSSETYASLSTLSPSASPGSAAAGIGDRKANNKSSAEEEKFGGACSSDELYAELELEQRSPAAAAGFLDLNFPPASSEVGVN

SEQ ID NO: 1093 - protein, 112 aa, Oryza sativa
MDAGGVELSGVMHRCRVCGKGFSCGRSLGGHMRSHISFGEAAAELGANGGVVGYGLRENPKKTRRLSEFDGDGDGEQVEVEEGGDGGELRACRECGKLFSSWRSLFGHMRRQ

SEQ ID NO: 1094 - DNA, 1514 bp, Glycine max
  misc_feature (55)..(55): n is a, c, g, or t
ctcgcgtccgctctctctctctaatttactacacacacacaaaaaaaaaaaaaangatgagtagtgttttttcagaacacaaattccaacttcaaccctcccaccaacttctctccctcaagaaatccctcggagacattgacatcccagtcccaccaaggaagctcctcacccgccgctccgccgccgtccacgacggctccggcgacacttatctgcctcacagtggctccactgactcctccaccgacgatgactccgatggcgacccctacgcctccgaccaattccgcatgttcgagttcaaggtccgacgatgtagtcgcagccggagccatgactggacagactgtccatttgtacatcccggcgagaaggcccgccgtcgggaccctcgccggtttcattactctgcaacagtctgtccagagtttcgccgcggtcagtgtgaccgtggcgatgcatgtgagttttctcatggggtgtttgagtgctggttacacccttctaggtatagaaccgaggcttgcaaggatggtaggaattgcaagcgaaaagtttgcttctttgctcacacccctcgccaactcagggtttttcattccaatgacaatagcaacaagaaaaagtgcaccgatataagccctcataataacaacaattgttgtttggtttgccattgctctaattctactcgttcaccaacttctaccttgttcggcatgtctcatttttctcctccattgtcaccaccttctccttcttccccttctaggtttgagaccaacaaccatcatcatggtgttgtgaaatataataaggatgttttctctgagcttgtgtgttccatggagggtttgaattttgatgaggcttcttcactgttgtctgctgcttctaagcctcatcatcacaacaatttgtcttcttggcttgatgtttctaaggatcacaatcaaaaacagttcagtactcttaattcgccaaccatcactgcttgtggaagcttttccaacaatggaaatgggggatttttgagagcagaaagtggggttgttgatgatgttatttccccagatctcgcatgggtgaatgaattactgatgtagattatatgcatttgaagatgatgatgacaaaaagtggttcgtggtgggaattgtgatgaggatttaccaagtgtaaatacatgttggagctagcaacatatattacatccttggcttcttttcttattattgttttaagaattttattgctttctgaatttgttttaagatttgtcaaattaaattctgtaatttttatgtccattaattagatttgatcttttattccgaggattctgtagaaagtgaaactgattcttggaatgggatgttgaatttttctctctgttttggatttttcgttggctttaattaattatcttcttgctccgttaagctcattatctgtgtcgtggaataaaggtttagatattttgtaaaaaaaaaaaaaaaaagggcggccgc

SEQ ID NO: 1095 - DNA, 680 bp, Glycine max
gaaacggcccgagctctaatttactacagaaaaaaaaaaaagatgagtagtgttttttcagaacacaaattccaacttcaaccctctcaccaacttctctccctcaagaaatccctgagggacatagacatcccagtcccaccaaggaagctcctcacccgccgctccgccgccgtccacgacgtctccggcgacatgttttccgatgacaccctccggcacaagtaccttccccacaatggctccaccgactcctccgacgatgactccggcgacccctacgcctccgatcaattccgcatgtttgagttcaaggtccggcgctgtactcgcagccggagccatgactggacagactgtccatttgtacatcccggcgagaaggcccgccgtcgggaccctcgccggtttcattactctgcaacagtctgtccagagtttcgccgcggtcagtgtgaccgtggcgatgcatgtgagttttctcatggggtgtttgagtgctggttacacccttctaggtatagaaccgaggcttgcaaggatggtaggaattgcaagcgaaaagtttgcttctttgctcacacccctcgccaactcagggttttgcattccaatgaaaatagcaacaagaagaagtgcaccaatatgagccctcataacaacaacaacaacaccaacaa

SEQ ID NO: 1096 - DNA, 1265 bp, Oryza sativa
gcgttcggtttcctcttttttttttcttcggtggtgttgggagtggacaaggtagtgtgagtgagtagtgagcaccatggcgagccgagagcacctcctgctcgacccggcggcgctggccgtctcttgggctgaccccgctgcggtggagatcccgcccgagctcctcgccgcgctgggtgagtacctgtccgccaggcgtagcgacggggaggccgaggccgacgccgaggcggaggctgatgatgagttcatgatgtacgagttcaaggtgcggcggtgcgcgcgggcgcggagccacgactggacggcgtgcccgtacgcgcaccctggcgaggccgcgaggcggcgtgacccgaggcgcgtggcgtacacgggcgagccgtgcccggacttccgccgccggccgggcgccgcgtgcccgaggggcagcacgtgcccgttcgcgcacggcacgttcgagctctggctccacccgtcgcgctaccgcacgcggccgtgccgcgcgggcgtcgcgtgccgccgccgcgtctgcttcttcgcgcacaccgccggcgagctccgcgccgggtccaaggaagactcgccgctgtcgctctcccccaagtcgaccctggcctccctctgggagtcgccgccggtgtccccggtggaggggcggaggtgggtggacggcatcgatgaatgcgacgcggacgcggagatggaagagttgatgttcgcaatgcgggagctcggcctccggaaggtgaggccgtcggcatcgtccgtaacgccggtgctaccgccggtgacggacgaggacgggccggatttcgggtgggtgtccgagcttgtgatgtagaagcacccgacaagctcaaagacatcatctctctcggcggcgacgattaagatgcagaggcgcctcgcagaacagcttcattaattaagttcacttcaattcgatgatcatttcgcaaattgcatcattcttctgtacataaacaaatatggtgcaagttaatctgaacacagcaatccgtaactgtaagtgtggcgtgcgtttgcctgcctttttttttcgaaaatcttggggagctagtagcacccttgcttttcgattattattattattatctaccagtgtagatatggagtgtaatatgctaatagcctctgcctgtttcgtgatattatcacatttgatgtacttaattatgctaaattcgatgcttttttttatctaaaaaaaaaaaaaaaaaaaaaaaaaaaaaaaaaaaaaa

SEQ ID NO: 1097 - DNA, 449 bp, Glycine max
taagtatattagtttctgagagagagagagtcttaattgattaatcctgctatgaattcagagaagcctgtgagtcctgagatttcaagtgaagaaaatgatcatgatcaagaagatgacactggtggaaccaaacgctcttatgagtgcacattctgcaaaagaggcttcacaaacgctcaggctttaggcggccatatgaacatccataggagagacagggccaaggccaagcaattcacacttgatgcttcaccttcagttaacaaattcaatagtaacaacaatgattccatggcccttccctttgtctcagaaattatgaaccaacccacaaggcctaattactcccctttggagtctcagatgaactttcatccaccacatgccttttattatgaggtttgtaactcaaggtctcagccttttagtttgaacaaccaagagct

SEQ ID NO: 1098 - DNA, 1258 bp, Glycine max
tggcgtttgtttagaaaaggctgatccacgaaccaatggaatcacatcagctgtgtcttcaattcatattgaataagctcatttccatcaattaatagttccgtggaatgtggcttcactagctattagtttttgctttttttcaatttcgggggaaaatgagtgtaagattgaaaataagctttaattgatatagttttttttatttttattttaaaaaaaaaaaaaaaaaactcgagttttttttttttttttttttactactaaaaccttgtctattaagcacatttagaatgagttgcttggctggctagtttttcatttatattcgaatttgttgatccaattgctacacattaatcaacaaccattcgtagatacaaaaaagaaaagaaaagcaaaggaaactaaactcaaatttgaaatccacacatttggattacacatacattacaatgcattggtatagctatcatcagctaggactcgccccatccttcctgcaattcgcggcggtgcgtgaagacacgtgcgaggttggcatgtgcgcccagaatcagctttgctggcactccagatattgcctccaacctcgccagattctgacacgtggcgaggcctctgtccccacaaaatctcagccccaaccaaaacgacgtcgcagcagccaccctgaacggaagcgacctccactttccgaggcacacactcagagcgttcgacgccacgcgatttccgttcacccctaaccctaaccctatctctctgctccatttctcaaacacctccgccaccgatccgccatttctccgccgcttcttcgccgccggagatgcgtcgtcggtcacggaggaactcgagaaactcctcctcctcctcctcctcttcttctccgccttaatctgattcgtagagcaagactcggaactggagacgcaggtagaagaggaagggagagaatcggagtcggcggaaggaatctccagggagcaagaggtgcaggtggaggagaggtggcgggatatagcaccggagatgtgaattgcggcgaaacggttgcatttggagcagaggaggcggcggaggtggcgagctacgaggaagttggcggcgtggacggcggcgtcgcagtggaagcagagaaatgcggaatcggagggacaatagagagaagctagttgatgacaaagctcgcaagtcttgggcttcatcttaataagtctctgaggtagagagagtggagtatgctgtgaccaaa

SEQ ID NO: 1099 - DNA, 1044 bp, Glycine max
tttttattcgaatttgttgatccaattggtaaacacattaatgaacaaggattggtagaagcgaaaagcaaaggaaacaaaagtaaaatttgaaatccaggcatttggtttggctaatgagacgattacacattggagctagctaggactcgccccatccttcctgcaattcgcggcggtgcgtgaagacacgtgccaggtcgccatgtgcggccagaatcagcttaactggcactccggatattgcctccaacctcgccagattctgacacgaggccagccctctgtccccacaaaatctcagccccaaccaaaacgacgtcgcagcagccaccctgaacggaagccacctccactttcccaggcacacactcagagcgttcgacgccacgcgatttccgtttacccctaaccctaaccctaaccctatctctctgctccatttctcaaacacctcctccgatcctccactcctctgccgcttcttcgccgccggagatgcgtcgtcggtcacggaggaacccgaccaactcctcttcttctccgccttaatctgcttcgtggagcaagactcggaactggagacgcaggtagaagaggaagggagagaatcggagtagtcagcggaaggattctccggggagcaagagctgcaggtggacgagaggtggcgggatatagcgccggaggagatgtgaaatccggcgaaacggttgcatttggagcagaggaggcgacggaggtgacgagctacgagaaagttggcggcgtgcacggcggcgtcgcagtcggagcagagaaatgcggaatcggagggacaatagagagaagcttgttgatcacaaagctcgcaagtcttacccttcatcttcgcctgaacgttaatttcaaaaattaaaaaaagaaaatgattcttctgatgttttgacttgctaaaaattgagggagtatgacaaaaactccaccctcttctgtctgggatcagaggtagagtgagtgcgttgtgttgtattgcgttattcttcccttgacctcgagccgaat

SEQ ID NO: 1100 - DNA, 1096 bp, Oryza sativa
  misc_feature (775)..(775): n is a, c, g, or t
  misc_feature (857)..(857): n is a, c, g, or t
gcacgaggcctcgtgccgaattcgggacggcgccagcgtctcgctcccaagccagacctcccccctcgccgtccgcgcgcgcgcccgcggtttcccccgctcgccgccggtttcccccgctcgccgccggtttccccgaagcgcgccgcgcccgcgcctgcgcccgccggtcgccatcgccatctcgccctcgcgcggagactggtgtccctgttttgctctgtagtataaagccacgcaaacccccgccaggtgttcgaccgagtgacacaagagtccagcctcttgcaacctgtaatggaggtcggcaacggcaagtgcggcggtggtggcgccgggtgcgagctgtgcgggggcgtggccgcggtgcactgcgccgctgactccgcgtttctttgcttggtatgtgacgacaaggtgcacggcgccaacttcctcgcgtccaggcaccgccgccgccggttgggggttgaggtggtggatgaggaggatgacgcccggtccacggcgtcgagctcgtgcgtgtcgacggcggactccgcgtcgtccacgccgccgccggccaccgcacgacgaatcttccggccgcctgagatagaaagtactaaaaatgcgaaacttgtgggcaatgatagtatgtatgcttcctccctaattaattaaattaatctcaaattcttgatcaccatcaaggaccccaaaatcttgtggtttaggaaggcctctcttgtggttaacatccaatcacaagtctaaatccaatggatgggactcnaatttttctgtgtagtattagtgagacatgatgatagtacaatttgatttgttattaattggttattaattaaaggtgattnggatcactgagactttatgtggtcaagaatgtctccctgtattgtatgagtgaccactaccactcgatatttttttccttccatcttggctgagtcctgtcttgtgtttgtttattggtatctcaatgtactgggcttaccacttgtatggacagtattgttacactaacacagtgtgtaccccccagtcgtgttagcttgaatgggaagaccatgatcaaaaaaaaaaaaaaaaaaaa

SEQ ID NO: 1101 - DNA, 1397 bp, Zea mays
cccacgcgtccgcccacgcgtccggaccagcccacggtcagtagccatcggccactaccagcctcgggcgctggctgtggcctgtgggctgggcggggcccctttaaatgccggccatacgcgcggcctaaagcctccagagccacgctgcttcccggccgaagcctccgtccgcgcccacggtttccattccatcccccaggcttgcgccgactcgccacttgcaccgccggccggtttcgccgaacgcctcgcgcccacccgcgcgcggagacctgcatataagccggccgcgtgtcgtccggcgctcccgggacaggcgatccgttcgtcatccgctgcaaaccaccaggcaccagctccgcgcgcagaggccggaggactacgaccgacgagggcgacgaacaccaaggctccgaagtccgaggaggcaggaagcgggagacgtcgggaatgggcgctgctcgtgactccacggcggcgggccagaagcgcggcaccggcacgcggtgcgagctctgcgggggcgcggcggccgtgcactgcgccgcggactcggcgttcctctgcctgcgctgcgacgccaaggtgcacggcgccaacttcctggcgtccaggcacgtgaggcggcgcctggtgccgcgccgggccgccgaccccgaggcgtcgtcggccgcgtccagcggctcctcctgcgtgtccacggccgactccgcggagtcggccgccacggcaccggctccgtgcccttcgaggacggcggggaggagggctccggctcgggcgcggcggccgcgcgcggaggcggtcctggaggggtgggccaagcggatggggttcgcggcggggccggcgcgccggcgcgccgcggcggcggccgccgcgctccgggcgctcggccggggcgtggccgctgcccgcgtgccgctccgcgtcgggatggccggcgcgctctggtcggaggtccccgccgggtgccgaggcaatggaggggaggaggcctcgctgctccagcggctggaggcccccgcgcacgtgccggcgcggctggtgctgacccccgcgtcgtggatggcgcgccggccggacgcccggcaggaggaccccgaggagggatgggccgagtgctcctgagttcctgatccagacgggcccacgtccgttgctgccgtgccgccgctgcacctgcactgtgtaccgagccggacctccgagatagactcgggagaaaaatgtaacaacgtgtggggctgtgggccacgtttgtttgtttgttctttttcttcttaatcatataaatatatcgtaggcgtacgagcgagggtccaagggattgatcgtgtggctggttggctgcctctcgtcaagccgattgtggtttgacttgtttccccccc

SEQ ID NO: 1102 - DNA, 856 bp, Zea mays
tccgcgccccggtttccttccacccccagccccagcttgcgccgactcgccacttgtaccgccggccggtttcgccgaaggacgaaacgcctcgcgcgcggagacctgcatataagccggccgcgtgtcgtccggcgctcccggtacaggcgatccgttcatcatccgctgcaaaccaccaggcaccagctccgcgcgcagaggccggaggactacgaccgacgagggcgacgaacaccaaggctccgaagtccgaggaggcaggaagcgggaggacgtcgggaatgggcgctgctcgtgactccgcggcggcgggccagaagcacggcaccggcacgcggtgcgagctctgcgggggcgcggcggccgtgcactgcgccgcggactcggcgttcctctgcctgcgctgcgacgccaaggtgcacggcgccaacttcctggcgtccaggcacgtgaggcggcgcctggtgccgcgccgggccgccgaccccgaggcgtcgtcggccgcgtccagcggctcctcctgcgtgtccacggccgactccgcggagtcggccgccacggcaccggctccgtgcccttcgaggacggcggggaggagggctccggctcgtgcgcggcggccgcgcgcggaggcggtcctggaggggtgggccaagcggatggggttcgcggcggggccggcgcgccggcgcgcacgtgccggcgcggctggtgctgaccgccgcgtcgtggatggcgcgccggccggacgcccggcaggaggaccactaggagggatgggccgagtgctcctgagttcctgatccagacgggcccacgtccgttgctgccgtgccgccgctgcacctgcact

SEQ ID NO: 1103 - DNA, 698 bp, Zea mays
  misc_feature (588)..(588): n is a, c, g, or t
gccgggttccgacgcttaatcgcttcgcttccgccctccatcgatcacctccaaagatcgagagcggctcgctcgtcaagcgctccatcgagccggcggtgcaggagccaaatcatatatatataggcggacaggaggaagacccgccgatgggtcaccaccgcggccgctgccgctgcgagcgctgcggcgcgcccgccgccgtgcactgcgcggcggacgcggccttcctctgcgccgcctgcgacgccaaggtgcacggcgccaacttcctcgcgtcgcgccaccgccgcacgcgcctcctcctcgcggcgccggacgagtgcgggtacgagtccggggcgagctcctgcgtgtccacggcggtcgactcggcggcgcgggcgctccgggcccacgcccacggcctcgcctccgcgcgcgtcgccatggccgccgcgctgtggcgggaggtggcggtgcgcggcgggaccggcggcggcggccacggtcacggcgaggcgctgcggcggctggaggcgtgcgcgcacgtgccggcggggctcgtggtggcggtggccaagtccatggcgcgcgcgcgcgggcggngggacgaggccgacacggacgccgcggcggagggctgggacgagtgcgcctgggccggtcccaagtccagcccgccacgtccttgatcttttctcgtgctcgctgatgaa

SEQ ID NO: 1104 - DNA, 552 bp, Zea mays
gccggccgggtcgggaacagcttccaccatcgaccatccatcacctcacctccaagctccaaggaatctaccctcgttcttctcacaaagcgctgcagcggacagcagcgcagcacgagagagccgagcgcgaggtgcaggaccgcaaaacagaggcgaagcgaaggacctaacctacgtagcaacgctccgctccgcggcgatgggccacgaggggtcgtgccgctgcgagctctgcggcgcgcccgcggccgtgcactgcgcggcggacgaggctttcctctgcgccgcctgcgacgccaaggtgcacggcgccaacttcctcgcgtcgcggcaccgccgcacgcgcctccgcctcgcggccgccgcccccccgccgccgcacgacgaggccgggtacgggtccgccgcgagctcctgcgtgtccacggccgactccgcgccgcggccgaggcgtggggcccgcgcgccggcccggagcgtgcgccccgagggcgtgctcgagggctggggccagcggatggggctcggggcgggggggcgcccgcgcgt

SEQ ID NO: 1105 - DNA, 522 bp, Glycine max
gatatctcatgctcctggagctggtaaaacttttctcatcattgcatttctcgttagctatttaaagctattcccagggaagaagcctcttatccttgctccaaaaggcacactttacacttggtgcaaagaattcaacaagtgggaaatttctatgccagtgtatctgattcatgggcgtggtggaactcagaaagatactgagcaaaattcaattgttcttcctggttttccaaatccaaataaagatgtcaagcatgttttggactgcttgcaaaagattaaacttgtggcaggagaaaccaagtgttttggtcatgagctatactgcatttttagcattaatgagagagggtccagagttttcacaccgaaaatatatggcttaagcattgagggaaggtcctgggatcttgatacttgatgaagggcacaatccaagaagcaccaagtcaaggttgaggaaagggttgatgaaactgaaaacagatctaagaatactactttccggtacattatttt

SEQ ID NO: 1106 - DNA, 694 bp, Glycine max
  misc_feature (546)..(546): n is a, c, g, or t
  misc_feature (571)..(571): n is a, c, g, or t
  misc_feature (642)..(642): n is a, c, g, or t
ccacgcgtccggagaaacctgtgtctcaagagagtctagagctggcaagagatcaatgtcatcgtcttcattagccttggtctttgaatcttcttcagggatctgcttctcctgagaaacctgtgtctcaagaaaatgataacgtttgggtgttaattcccgaacttaaagcaaagttgcacgcccaccagaagaaagcatttgagtttctttggcaaaacattgcagggtccatggacccgggattgatggaagcagcatccaaaagaagaggtggctgtgtggtatctcatactcctggagcgggaaaaacttttctcatcattgcttttcttgttagctacttgaagttattcccagggaagaggccattagtccttgctccaaagacaacactctatacttggtacaaggaatttatcaagtgggatattcctataccagtgtatctgattcatggtcgtagaacctaccgtgtattcaagcagaaatcctcgattgttattcctggagttcctaagcccactgatgatgtcaagcatgttntggattgccttgagaagatacaaanatggcattcgcacccgagtgttctgatcatgggttatacttcatttttaacattgatgcgagaggattcanagtttgcacataggaaatacatggcttaaggtattgagggaaagcccctggg

SEQ ID NO: 1107 - DNA, 611 bp, Oryza sativa
aatcggcacgagggttaatgagagcaccgattatttggaaaagttggaggaataccatgccatcatgaatgcatactggatgaggagcttggactagcatgcagattatgcaatgttgtatgcactgaggcaaaggatatatttccagaaatgttcaatggaaatgactacaaggacagaactggatgcagcaatatttgccttgatgatgatatacttgatccttctcttcttgcaaacttggcaccagagttgtcagaattgaagaactcagggagcgtgtggagtgcaatatctgatcttgatccaaagctgcttcctcaccagagaaaagcactagattttctgtggaaaaatttggcggggtcaatacaggttgaaggaatggataactcaaatgtcagtacaggtggctgtgtgatagcacacactcctggatctgggaaaacactgctgcttatctcatttctggtgagttacatgaaagctcacccaagaagccggccattggtccttactccaaaagctgcaattcatacatggaagagagaatctgagaaatggggcatttcacttcctttacatgtgtaccaccatgctaacagaagtgg

SEQ ID NO: 1108 - DNA, 1301 bp, Glycine max
attcggctcgagctccctttcattttccctcacactcatcattctcaaaaaacacgcccaaattctaatcaaattagggttagggttttcaactcccctcgaattatccctgtaatgcagtgcgattcccgggtcctaccatggagccatcagcaatgtacggaccctcccagcccctgaacatcccctcgcggatcggcgctggcgaaagagacgacggctccggcaacgagcccgccgtcgacggccaccaccaccacattcagtacgaaacgcacgcgctcgatgacggtgccgccggtggcgccgtggttgtcgaggatgttacgtcggacgcggtctatgtctccggcggtggaggccccgaggagtccagccagcttacgctgtcgtttcgtggccaagtttacgtcttcgatgccgttacgcctgataaggttcaagcggtgttgttacttttgggtggatgtgaactatcttcgggtggttcgccatgtgtggatcctggggctcaacagaatcaaaggggttcaatggaatttcctaaatgtagtctaccacaacgagctgcctcattagataggttcaggcagaagaggaaagagcgatgctttgataaaaaagtgagatatagcgtacggcaagaagttgcgctcaggatgcatcgtaacaagggtcagtttacttcatctaagaaacaagatggagctaatagttatggtactgaccaagattcaggacaggatgatagtcaatccgaaacctcatgtaaacattgtggcactagttcaaaatccaccccaatgatgcggcgagggccatctggtccaaggtcactttgcaacgcttgtgggcttttttgggcaaataggggtgctttgcgagacctttctaagagaaatcaggaacactctcttccaccagttgagcaggttgatgaaggtaatgactcggactgtcggactgccactgccgaccctgcacataacaatcttcctgctttctcagagcatgataatccagctttggtagctgatcataaagttttccagtctcagaaaatgttgaagtagtttactctggcataagtaggtctatagttcttccattcagattgaccaataggaatgtacagacataacaatactcccatcaatgcaagaactttgtttttatatggttggatctatggcattaaccattgatctctggatgtataacctgaaacttgaatgatgacttggtgatggtctcacccaataccttgaatttaattttacacgtagattttttgttcaagg

SEQ ID NO: 1109 - DNA, 1549 bp, Glycine max
atgcagcgtcaccggtgcgcgactccacgcgtccgggacactttaacagcattctctctctctcgagtctcttccccccgactcggcgccccgccgccccccgcaacacaacggacacattctgagactatttatagttatccccattctggttatgttctttctttcttactccctctcaatcaaaccgtgttagggttagaactaagattagggtttctttactttacccgcgtaatgtaatgcgtcgaaaacccccaattctaccctccttccaacaacaacaatgttcggctccatgaacaagatcgtctccgctgaagacaccgacggctccgtctccgaccaccacatccattacagttcccacaccatcgaagacgacggcgccgcctccgatcaccacatccattacagttcccacaccatcgaagaggacggcgccgtctccaaccaccacatccattacagttcccacaccatcgaagacgacggcggcgccactgtcgaagaggtttccgccgttccgccccttgaaatctctatcaacgattctagccagctcacgctctcgtttcgcggccaagtctatgtcttcgacgctgttacacctgataaggttcaagcagtgttgttgctgttgggaggaaatgaactaacttcgggttcgcaatgtgcggagctatcatctcaaaatcagactggtgaggaggaatatcctgcaaaatgtagtctaccacagcgagcagcgtcattgaataggtttcgtcagaagaggaaagagcggtgctttgataagaaagttagatatagtgtacgtcaagaagttgcactcaggatgcatcgaaataagggtcaatttacttcatcaaagaatcaggatggaactaatagttggggttcagatcaagagtcagggcaggatgctgttcaatctgaaaccttgtgccacacattgtggaataagttcaaaatccactccaatgatgcgtaaggggccatctggtccaaggtcactttgcaatgcttgtgggcttttttgggcaaataggggcactttgagggatctttctaagagaaaccaggaacactctcttgcaccacctgagcaggttgatgagggcagtaataataatgactttgactgtcggagtggcatccctgcacaacataacaatcttgttaatgataacaaagctttggtatctgatcgttgagttttccactcacaggaaatgcaagtccttgactgtgacattcgcaggtttttagtaattccattcagtttgacctatagaatgtacagtatatagcaaagctctcgtcaatacaagagcggtctatttctatactctctgatcagttgcattaaactgtttatctatgactgtacaaactggaatttggaatgacttgatcgcatacaagagatctattcctttactctcggacagttgcattaactgttttatctatgaatgtataaactggaatttgaaacgaacttgatcctcattccgtggtctggtggttttagtttagtctagtg

SEQ ID NO: 1110 - DNA, 1380 bp, Glycine max
  misc_feature (485)..(485): n is a, c, g, or t
  misc_feature (562)..(562): n is a, c, g, or t
tattatttgcagctgctatgtttgctgtagcggccattctatagtcaacaattccaatacagcattttcgggggtagtcactcgactcactcccagccatcttccttcattaactactttatttgtttcttactttgttactattgtgtgacaaattttgaccttttaatacatttaagatgaaattgacattagtgcttttatgtttttgcttccccttcccatatgacaaattgtgtacaacaagatttcaaatataaggcatgcttcaacagcatcctctgccagcaagttggatatatatgctcaagtgaatggctaattttggacattgagatttttgttgctatagccatgggtatgcgtgtgtgtgtgtgtgtattggtatgtacatggttgcattggtttaacaaattgctttggttttatcagcaagaacctttttgggcatttgttatttcatatgtaattaatgctatcaaagnaagaagttcatatcttcccacggactattgcacatcatctatgttccacattttattcttattgctcaccattttanggtgtttgatttaatttgcatcaatgtatatttcttatttgatttttaaatgtagcgtcaagaagttgcactcaggatgcatcgtaataagggtcaatttacttcatcaaagaatcagggtgggactaatagttgggggttcagaatcaagagtcagggcagggatgctgttcaatctgaaaaccttgggctgcacacattgtgggaataagttcaaaatccactcccatgatgcctagggggccatctggtccaaggtcactttgcaatgcttgtgggcttttttgggcaaataggggcactttgagggatctttctaagagaaaccaggaacactctcttgcaccacctgagcaggttgatgagggcagtaataataatgactttgactgtcggagtggcatccctgcacaacataacaatcttgttaatgccggcccagcttaacaatcttgttaatgataccaaagctttggtatctgatcgttgggtttcccccccccaggaaatgcaagcccttggctggcacattcgcaggtttttagtaattccattcagtttgccctatagaatgtccagtatataccaaagctctcgtcaatacaagagagctctatttctatactctctgatcagttgcattaaactgtttatctaggcctgtacaacctggaatttggaatgacttgatctcatacaagagatctattgctttactctcggacagtggcattaactgttttatctatgaatgtataaactggaatttgaaacgaacttgatcctccaaaaaaaaaaataaaaaaaaaaaacaaaaa

SEQ ID NO: 1111 - DNA, 499 bp, Glycine max
tgaacaaaaaatctacgtgtaaaattaaattcaaggtattgggtgagaccatcaccaagtcatcattcaagtttcaggttatacatccagagatcaatggttaatgccatagatccaaccatataaaaacaaagttcttgcattgatgggagtattgttatgtctgtacattcctattggtcaatctgaatggaagaactatagaaaaattatgccagaggaaactacttcaacattttctgagactggaaaactttatgatcagcttccaaaagctgattatcatgcttctaaaaagccagaaaaatggtattttccagggccggaagggcaatcccaccagtccaagtattaaccttattaaaccggctaacctgggggaaaaaagggttcctgatttctttaaaaaaggtctcgcaaagcacccctatttgcccaaaaaggcccacaagcgttgcaaagtgaccttggaccaaatggccctcgccgcatcattggg

SEQ ID NO: 1112 - protein, 784 aa, Oryza sativa
MAIDGFLLLSNSLAAAAAAFSSALSATCTPEMRRRLASGPQDRCPHTSAISEGTGYSTRWERGVGGGDAMMHMLVAPDGGGGGEMPPPYGGAAAAPPPPMEQELELHRDNADDGLDGHVRCLRCGISGNATPHMRRGPDGPRTLCNACGIAYRKGKMRRMIEAEPPIDEAALAKLVPEVGMEFESEDKAYEFYNKYAGHVGFSVRKSTSHKSSGNITKVRTFVCSREGYNRDKKSLEAKKPRLDTRIGCPARLIIKVTPESKYRVTDFKADHNHQLAPPSTMHMLRSQRILTELQSGEAELSDDSVMTPTTKATGDLVVRQIGFLRSISLLPADYKNYLRSKRMKAMQLGDGGAILKYLQTMQMENPAFFYTMQIDEDDKLTNFFWADPKSREDFNYFGDVLCLDTTYKINGYGRPLSLFLGVNHHKQTIVFGAAMLYDESFESYRWLFESFKIAMHGKQPAVALVDQSIPLASAMAAAWPNTTQRTCAWHVYQNSLKHLNHVFQGSKTFAKDFSRCVFGYEEEEEFLFAWRSMLEKYDLRHNEWLSKLFDERERWALAYERHIFCADIISALQAESFSSVLKKFLGPQLDLLSFFKHYERAVDEHRYAELQADFQASQSYPRIPPAKMLKQAAHTYTPVVFEIFRKEFELFMDSVLFSCGEAGATSEYKVAPSEKPKEHFVRFDSSDCSCICTCRKFEFMGIPCCHMLKVLDYRNIKELPQRYLLKRWRRTAKSANEENQGTLLFLICMRIHFAEAHDAGDLNLNIIPSARCLLHDTGVEAVR

SEQ ID NO: 1113 - DNA, 1309 bp, Zea mays
aacaaaaaatctacgcgtaaaattaaattcaaggtattgggtgagaccatcaccaagtcatcattcaagtttcaggtgatacatccagagatcaatggttaatgccactgatccaaccatataaacacaaagttcttgcattgatgggagtatcgctatgtctgtacattcctatcggtcaatctgaatggaagaactatagacctacttatgccagagtcaactactccaacattttctgagactggaaaaccttacgatcagctaccaaagctggattatcaggctctgagaaagcagcaagattgttttgtgcagggtcggcagcggcagtccgacagtccgggtcattacctccatcaacctgctcaactggcggaagagagtgttcctgatgtctcttagaaaggtctcgcaaagcacccctatttgcccaaaaaagcccacaagcgttgcaaagtgaccttggaccagatggccctcgccgcatcattggggtggattttgaactagtgccacaatgtttacatgaggtttcagattgactatcatcctgtcctgaatcttggtcagtaccataactattagctccatcttgtttcttagatgaagtaaactgacccttgttacgatgcatcctgagcgcaacttcttgccgtacgctatatctcacttttttatcaaagcatcgctctttcctcttctgcctgaacctatctaatgaggcagctcgttgtggtagactacatttaggaaattccattgaacccctttgattctgttgagccccaggatccacacatggcgaaccacccgaagatagttcacatccacccaaaagtaacaacaccgcttgaaccttatcaggcgtaacggcatcgaagacgtacacttggccacgaaacgacagcgtaagctggctggactcctcggggcctcctccgccggagacatagaccgcgtccgacgtaacatcctcgacgaccacggcgccaccggcggcaccgtcctcgagcgcgtgcgtttcgtactgaatgtggtggtggtggccgtcgacggcgggctcgttgccggagccgtcgtcgctttcgccgccgccgatccgcgagggcatgctcaggggctgggagggtccgtacattgctgatggctccatggtagtaggacccgggaatcgcactgcattacagggataattcgaggggagttggaacccctaaccctaatttgattcgaagttgggcgtgttttgtgagtatcatgtgtgcgtgggcgtgtgaggcgggggagaatgaaagggagtgaagag

SEQ ID NO: 1114 - DNA, 563 bp, Oryza sativa
  misc_feature (496)..(496): n is a, c, g, or t
atcttttcttggttcgacccagctcccagatgatttcatcctgaatcatcgtcgtcgtcgtcgtcgtcacaggcaagaagaggagaaggaattacacctgggattatcgattggttgttcggattttcttttggatctattcatgctcgctctgtgcgccggggattcgatcgttgggcagggcagtgatctctgcgtcgagggtttcgacgaattggactgcagattcgtcgccatctcttcgcagaggggattctgcctccgccatggggagggtcaagctcaagataaagaagctggagaacagcagcggccgacatgtcacgtactcgaaacggaggtccgggatcctcaagaaagccaaggagctctccattttgtgcgacatccctctcatcctgctgatgttttcacccaacgacatgcccacgatttgcgtggcgatcacagcagcatagaggatgtcataacatagtatgcacagcatactcctcangaaagggctaaaaggaagttggagagcttagaagccctaaagaagacattcaagaaactagatcatg

SEQ ID NO: 1115 - DNA, 412 bp, Zea mays
aggaaactggagagcttagaggctctaaagaagactttcaagaaactagaccacgatgtaaatattcaagactttctaggctcgcgggttcagacagtcgaggagctatcagcagagcttgtctcgttgcagggtcaggtggcggagcttcaaaagcgtgtcagtgattggagcgatcctgagaaagttgacaatatcgacaatataagagcaatggagcaatctctcaaagaaactattaatcatatccaaatccataaggggaacttcggaaagcaacatctaatcgggctacagtatgctgctacccagttccagaccgacatgcagttgcctctaggactgcccggcgagtcaggcccttcgtcgtggttccaaaacggcggcactgatgggcaacaagccatgatgc

SEQ ID NO: 1116 - DNA, 938 bp, Glycine max
accagcgatttcaggctgcgagaactgcatacactaaaggggcacgtagaatcagttttgaaattgaaggggattgatgtagacacaattcagcaggcatacacagtctgaatatgttttttttttttctggtgccgaattcggcaccagacagaatgaagtgctagaaagcgaggaaacattttttctcaagaaagaaccctcctcgaacacccaaagagaactgcttgtgaaagtggatgggaagagtactgatcaaaagccaaacacaccaagatcaaaacactctgcaacagaacagcggagaaggagcaaaattaatgacagattccaaatgctaagagagcttattccacacagtgaccaaaagagggacaaagcatcttttttattggaggtcattgaatatattcattttttgcaagagaaggtgcacaagtatgaaggttcatttcaagggtggagtaacgagccagaaagattgatgccatggagaaataatgacaagcccccggaaacttttcaacctcgtggcaccgataatggatcaagtccatctccaacactgctgtttgcttcaaaggttgacgagaaaaatattaccatctcccaaacaatccctgggagtacccagaatgtagaatctggcttgagctcagcaactacccccaagacaatggatcatcatgctggaatgatgaacaaggcttttccaattcctattccttcacagctaaattgcttcactccaacccaaataggtggtccaggtggagtagtatctcagctaacacatagatcagcatcagatgctgagaaaactaaatatcaaccttcagtggaatgtcagactatgactgctaccaatgaaaagctgaaagagaaagagctcactattgaaggtggtgccattagcatatcaagcgtttactcaaaag

SEQ ID NO: 1117 - DNA, 2054 bp, Glycine max
cccacgcgtccgagactactggtactaactaggttgcggctcgagattacattacacttctcttcatctggggaaacaaatggctaggtctgcgaaagggcatcaagatgaattcgacgacgatgatgaagaagaactcttaactgctaataacacctctttcaaagtgaaggtggatgaacccagcacggggaagagggtgaacccacagcgttcaaagcattcagaaaccgagcaacgtagaaggagcaagattaacgaaaggcaagctttaaagaaaagaagaagaaaaaattctttttgttgagttaattgtttgtgtgtaggttttgagtggaagtttgatgtaattctatattatttggcaatatatgctcgcttgaaaaaattgtgtttttgagccaggtttcaggttctgagagatctgatacctcaaaatgatcaaaaaagagataaggcatccttcttgttggaggtcattgagtatattcagttcctacaggaaaaattacaaatttatgaacagacttatgaaggatggaatcaggagcccacgaaattaactccatgggtaaagttatttggaatggtgcaatgcgaacattttttgtatctgtatactctggaccttgatttatgaaatgttaggcaatgcattatgcatggcaatgcaagtgtgcactatagcagctttcccgactgatagtggtgccacctcaacattgttagacttgtgattttctgattgtataaggattcattttgtatagactgcaaaagaaagagcatcaactaggaagccttattcccactaagtagggtcaccaacatggatttgggaacaccgatgtacttggtcatgtgccatgtactcatgatgccaactgcaaaaaattctcataaagagtttaagttcctttcatgtttaggatttcactactttatgctgtttctttgaattcatgtctgcttgttttctttttttatttatttacaatgtccttttcttccagagctagtagcccagtatgcatatttgaatgagttcaggatggcattgtggcaacttcagtgatctatttgtcacaatggttggttgtgacttagtgtcttgaaattgtaacaatggctttttatctgaagtttattgttctcatctgtttttttttcagagaaataatcacgggcctgcagaaaatactacagatccttctcaagctactcaaaatgggtctgttgatgagaaaaataacaatgtctctccattgttgcccaaaaatgtacagaacccgatagagtctgacttctcaatgacaactattcagaagggcaacatccctggttcaactacagaagcagttcccctgcccatgcaaatgcgattggacatgtttgatccagttgttagcagtagtatggcaacccaacatctgctggaacctgtatctaatgttaacatgctttcccatacccagcctcaattgtggcttgataaacgaaacaagggcaactatattcttccacataatgatacaatgaaggaacaggaggagctggtgaatgaaagtgggtcagatagcatctcaagtgcctattctcagggaattttagattctctcacacaagcactgcactcttcaggcgtagatatgtcccagactaatgtctcagtgcaaattgatgttggtagacaagaaaatgctgggctgatcccctctgcatctacttcaaagggtcatgaaaaccaatctgtgagcaatccagcaatagcacgttccggagttgattactgcaatattgattctgaacaaagttcaaagaggctcagacaagaagcaagctagagattcctctcatgttcattttgtcaggagtttctttttttgctgtttgtcttcagatgagagtaagaggaattgggtggatcggttcatttttgccatgctggttagggccagatcaaatgtaaattttcacgattctggttttgggactaagacattctgaaataaaatgttatatatgcttgcttcaaaaaaaaaaaaaaaaaaagg

SEQ ID NO: 1118 - DNA, 1716 bp, Glycine max
tcctctaaagcggccgcttttttttttttttttttttttttttttccctaagtatacatatatcataaaattgccatccaaaagctcaataatactgaataattataattataatatgtatcatacaagcgaaatagatgacatgctccctacagtagaagcctcaatatctccacaaatgatcgtgttcaaggtttaaatagttttaaaataaccattaaaagtcaaacaaatggggaaggatgtacagtaaccacaagttatatgctgcaccaagaataagtgagaaatctggatgcaagtggattctcatgaaaatgccacatatatatcacttatatgttttcattcttttttgtgcttgatcagagtcttctccactgcctgcatctctaaaatgtgcaattgtttgattgtttgaagaagggttgtcatgatgcttgagagaagaggtcccacaattcagtcctttgtttgcccgtttcccaagattaatctgaactgatatgctagcctgagacagatctaaaccagcactttgtagcgcttgagttagattattcaacaacccttgggagtatgcacttgagatgctaattgtccctccttcaaccgagagttcatcctgttgattctgtggttcactagttgttgggcattcagttgattgtgcattagaaacagttccctgaagaggatgtgcaagtacgccatcacttctgacaggaacagacatgtttgcatgcatagcaaggggaagaggtattcccttgcttactaaatcaggttgcctctcagccgttttgttgacaatatccctgctctgatcaggatctattgtattctgggagccattaagcatagttggagagatactaacattgctttcatcaaactttccaggaaaaggtgatactggacccaaaccattctttacagccgtgggttgaccggcaaagctctggacacgccaatgactatttctccatggcatcaacttcgagggttcttgaccccaaccttgatatgaaccttcatacttttgtaccttctcctgtaagtactgaacatactctatcacctctaataaaaatgatgccgtgtccctcttttgatcactatgaggtatgagatccctcaatatctggaatctctcatttatcttgctccttctccgctgctcagtcacagaatgtttcgatcttatcgcactagccttatcgatggcttttccatctcttattggtgttaggggcagaggaagtgccctgtttcttggaagaaccaaactcttcttcctcgtactcatcctcttcctgactccctttccccgctctcattgttctaagaaaagggtatcactgagcacttctgaatcacgaaaaagaagagaactttgagggaaacagggatacccagatggggaattgagaagagagaggagaaaggtgaattgggtcgggtgagattttgagaagggtgttcgccggcggcggcgttagaggtggcagtgggtgttttccggcgagtcaccaccaccggagagagaaggaggaggaggagggatagcatgtggctgaccccatgcgtgtctcgtgagccttcttcatttggcaataaaaccccttctttcgtattctcacttctttcttaatcattttcgagtctttacctgaatgttaatcattttggtccatgttaatgctcgagccgaat

SEQ ID NO: 1119 - DNA, 802 bp, Glycine max
agacatgtttgcatgcatagcaaggggaagaggcattcccttgtttactaaatcaggttgcctctcagccgtcttgttgacaatatccctgctctgataaggatctattgtattctgggtgccactaagcatagttggagagatactagcattgctttcgtcaaactttacaggaaaaggtgatactggacccaaaccattctttacagctgtaggttgaccagcaaagctctggacacgccaatgactatttctccatggcatcaacttcaggggctcttgaccccaaccttgatatgaaccttcatacttttgtaccttctcctgtaagtactgaacatactccatcacctctaataaaaatgatgccgtgtccctcttttgatcactatgaggtatgagatccctcaatatctggaatctctcatttatcttgctccttctccgctgctcggtcacagaatgtttcgatcttatcgcactagccttgtcgatggcttttccatctgctttgttggcgttaggggcagaggaagtaccctgtttcttggaagaaccaaactcttcttcctcgtactcatcctcttcctggctccctttccctgctctcattgttctaaacaaagggtatcactgagcacttcagcggcggcgttgaaggtggaagttggtgtcttccggcgagtcaccaccaccggagagagaagaagaaggaggagcgctagcatgtgactgatcccatgcgtatctcgtgagccttcttcatttggcaataaaccccttctttcgtattctcacactt

SEQ ID NO: 1120 - DNA, 336 bp, Glycine max
gaagtgtgagaatacgaaagaaggggtttattgccaaatgaagaaggctcacgagatacgcatgggatcagtgcacatgctagcgctcctccttcgtcttctctctccggtggtggtgactcgccggaagacaccaacttccaccttcaacgccgccgctgaagtgctcagtgataccctttgtttagaacaatgagagcagggaaagggagccaggaagaggatgagtacgaggaagaagagtttggttcttccaagatacaggatggaaaagccatcgacaaggctagtgcgataagatcgaaacattctgtgaccgagcagcggagaaggagc

SEQ ID NO: 1121 - DNA, 704 bp, Glycine max
  misc_feature (646)..(646): n is a, c, g, or t
cccgcgtccgcccacgcgtccgtacggctgcgaagacgacagaagggggagaatacgaaagaaggggttttattgccaaatgaagaaggctcacgagacacgcatggggtcagccacatgctatccctcctcctcctccttctctctccggtggtggtgactcgccggaaaacacccactgccacctctaacgccgccgccggcgaacacccttctcaaaatctcacccgacccaattcacctttctcctctctcttctcaattccccatctgggtatccctgtttccctcaaagttctcttctttttcgtgattcagaagtgctcagtgatacccttttcttagaacaatgagagcggggaaagggagtcaggaagaggatgagtacgaggaagaagagtttggttcttccaagaaacagggcacttcctctgcccctaacaccaataaagatggaaaagccatcgataaggctagtgcgataagatcgaaacattctgtgactgagcagcggagaaggagcaagataaatgagagattccagatattgagggatctcatacctcatagtgatcaaaagagggacacggcatcatttttattagaggtgatagagtatgttcagtacttacaggagaaggtacanaagtatgaaggttcatatcaagggtggggtcaagaaccctcgaagttgatgccatgga

SEQ ID NO: 1122 - DNA, 1618 bp, Oryza sativa
  misc_feature (15)..(15): n is a, c, g, or t
  misc_feature (17)..(17): n is a, c, g, or t
tggcggccgccacgncngttcaagcaggagccgcccttcgcgccgtggtgccagcccgtcgccgccgtagatccccgaggtcaccagtggtcgctccccttcgccgcgcgcgccgtcgccgtcgcctcctccaggccgcagcagcagcagcagcagccaccgccgccggagaggaagggtggcggtggattcatggacgccggctccagatccagtggcggcgcgggcttcgacgacgacgacggccatgccgcgcgccgcgaggtctcctcctcgctgaaagagctcacggtcagggtggaagggaaaggtgggagctgcagcggcagcgctggcacggatcagatgccgaacacgccgcgctcgaagcactccgccaccgagcagcgcaggcgcagcaaaatcaacgacagatttcaacttcttagagacttattgcctcataatgatcaaaagagagacaaagcatcatttctcttagaggttattgaatacatacggtttttacaagagaaagtacaaaagtatgaggtttcatacccggagtggaaccaagaaaatgcaaaggttgtgccatggacaaacatctatttccgttcttcctggaaaaatgcgcagaacaaaggccaagttcctgcagatcattcacctgaccctccagaacttctgaaaaatggttccccctatatgttcccttttacagggaactctgataataacaatgcagttgaaactgcagctgcttcaggtgcacaggatcaggcagaaactgatccaatgagtcgtgtgtcttacagatcagtggacactcccagtcccaataatgttgcagacaaagttacatctcagccacacgctcaactggtgagaccatcacctgcagagaatcacacagtaaactgcgacaagttaaataattctgaccttgccatcgatgagggaacaatcagtctatcaagccaatattcccaagagttgcttaacaagttgaatcatgccctggtaaaactcgggtatagatttgtcccaagccagcggtgctccgtgcaaataaatcttggcaagagggctatgaagagatctactcctgctgcaacctccacttctaaggagctcactgatccggcatctaatagtcaagcaatgggccgtcagcttaggttgggtgatggcgctgaagaacatcgacaagcctcaaagcgacacaaatcagataacagctgatggtttgctcctgaaaaccccagatattcaaccattttttgctcctaactgtgtacggggagccccaaggttttatgtatattaagtttacctgtgacgtctcgacaaaacaaggccttgatgtattctttcatttaatcacttcgccgttctagcccctagggaagaaaggaagcttccattgcagattgtgaagctgcttttgtccatatgcttccattcatatgagaagtttctcccaccctctgacagaatgtcttttgtaacataattcagaaatgagctatccaaagttccatcagttccccttgtgatgtgtaatgtgttatttgtccctgaagattgaagttacccaagaccaacctgtaatctgatgatggggtatttgcagtcc

SEQ ID NO: 1123 - DNA, 1556 bp, Oryza sativa
agagaagtgatgtgcaatgaagcactagagatccggtttacttcaacgaattactacttcacatagctaacaggtgcagctgagttatcatacaggttacaacgtaggactgactgtcttgtcaggggggagcttctcataggaatggaagcctgtgtacaagagcagcttcacaatccacaatgagaagcgcctttctttggtcttttttttttcttaaaacaggttggccaagtgattgaatgaaagaattacaccaaggtctgccttgttcaacgcgatgccgtcactgctaacataatgtacatccaattctggaatgtcctggctggttggtagggaggaaagaatgatcaatcggtctggatgatgcaacagagtgagaaccgccatcagctgttgcccgatttatggcgcttcgttgggtgtggaagttcttcagtaccaccccctaacatcgtcagctggtgacccatgttttcattgttcgctgatgtactggggagctccttagaactggaggatccatcagcaccaggtctcttaacagctcgcttgccaaggttgatctgcacagatatgctggcttgggacagatcaacacctgagctttcaagggcatgagtcaacgtaccaagtagctgttgggaatattggcttgacaagcttattgttccttcatcaattgccaactgttggttatttaacatttcgctgttcattgcacagtcatccacaccagccggactagcccactgggcttgggcttgggatgtaacattgttggtaatgtttgtcggagtttctgctgatctgtaggacacgctagctgcatggtcagtttccaccagttcttgtgcccctgaggcagctgctgatgtcaccatgttgtggttatcatcaggtttgccagtgaaattatacccagaagaggacccattccggatgaactgtgaaggatcaggcaaatcatctccagggttctgacctttactttgtgaatttttccagaacgatctaaaatatatgtttgaccatggaagtatctttgcattttcttggttccattcagggactgaagcttcaaacttctgcactttctcttgcaaaaagcgtatgtattcaataacctctaacagaaatgttgctttgtctctcttttggtcgctatgaggtaacagctccctaagtatctgaaacctgtcattgatcttgctgcgccgacgctgctcggtagcagagtgctttgaacgtggtgagctgggccgctgatcagtaccacttccactgcagctcccacccttcccatccaccctcactgtcaactctttgagcgaggacgagacctcacgccgcgcggccacgccatcgtcgtcgtcgaacccggcgccgccactagatctggagccagagtccatgaacccgcctcccccgattcgccccttcctctcctgctgctgcctcgccgcggtggcggccacctgcccgacgccggcgaaggggagcgtccactggtggtggtggtcggcggcccgcctcgtgccgaattcctgcag

SEQ ID NO: 1124 - DNA, 264 bp, Zea mays
cccacacgtccgcccacgcgtccgccagttataagctcgcaaataagttttggcccttgtatggattatgattctattttgctccacatcattctacaggtttcagatacttagggagctgttgccacacaatgatcaaaagagagacaaagcaacatttctcttggaggtcattccataaaaacgttttttgcaagagaaagcgcaaaaatacgaggcaacattcccagaatggaaccaagaaaatccaaagatgcttccatg

SEQ ID NO: 1125 - DNA, 1431 bp, Glycine max
ccacgcgtccgtatcagtctctggtttggtggaattgttgtcttctcctcacttttcacaatgaagaagcacattcacatagccctattcctccttctggtgtcaccgttaatccccatcgccgtcgcgcaggcccaatcccagcccaatgacttctccgacgcaaacctcaaccagttcagcccctccatagccataatcatagtcatacttgtcgccgcgcttttcctcatggcttttttctccatctacgtacgccactgcgccgattccccttccaccaccgttagccctctcactaccgcacgctcccggagggccgcgcgtgggcttgacccagctgtgatccaaacattcccaatcctcgaatactccgaggttaagatccacaaaatcggaaaagaagcgttggaatgcgcggtgtgtttgtgcgagttcgaggacaccgaaacgctgcgtttgatccccaagtgcgatcacgttttccaccccgagtgcatcgacgagtggttgggctcccacaccacgtgtcccgtgtgccgcgccaacctcgttcccaccgactccgaggatgctattgctaacggtaacgctaacggcgttgttccagttccggagacgtttacgcgagacattgaagcccaaaacgacgccgtggaagccgcgccagagcagcagaacgcggaggctgacccagtcttacctgaaccggaagtagtttccctggacaaaacactgaaccggaaccgcacgcgagggtctcggtcgaaccggcctcggaggtttccaaggtcgcactcgaccgggcactcgctggtccaaccgggagaaaacactgaccggttcactttgaggttgcctttggaggtgaggaagcaattaataaaccgccaattgcaacgtgcgagtagcttgatcgtgttacccagggaaggtagtttgcggcagggttaccgaaccggaggagaagggagtagtagggccaagatctcgaggcggctggaccggagtttgaaatcggaccggtggattttctcgatggctgcgcccttttttgcaagggcgttgtctattagatcgcctagggttcgaaacaatgatgttgaaggagccgcgtcctcgtcgtcgtctcccaccgcgcctatcatgccgccgacggccgttgactcggcaaggcctccggtttaaccggagtttcgccaacctccacataccttgtcatttttttatttattttttgctttatttgcgggacacgattttgttttgggtgaagaatttgtaaactgtgtataattaataaggtatcatgtttttttttgtaggccggttttagaagaactgggtcatgatttcatattctctttgaggttgttaagctagttagttgacctcggattttaacatacagcatgtgaagaaaaaaaatgc

SEQ ID NO: 1126 - DNA, 1437 bp, Glycine max
ccagtctctaatactactaactataggtaaagctcctgcacgtacaggtaccgaatcccagtttcgacccagtccctccccctcgctccccaatttgaataacccaaatggaggaatctgtttccttctctttctcttcctctttccttttgcggcggcgcaacctgccaccaaccaaaaccaatcctattacaacaagttcagcccttccatggccatcataatcgtcatcctcatcgccgccctctttctaatgggcttcttctccatctacatccgccactgctccgactccccctccgccagcatccgcaatctcgccgccgccactggacgctcacggcgcggcacccgcggcctcgagcaggcggtgatcgacaccttcccgacgctggagtactcggcggtgaagatccacaagctgggaaagggaactctggagtgcgctgtgtgcttgaacgagttcgaggacaccgaaacgctgcgtttaatccccaagtgtgaccacgtgttccaccccgagtgcatcgacgagtggctagcttcccacaccacttgccccgtttgccgcgccaacctcgtccctcagcccggcgagtccgtccacggaatcccaatcctcaacgctcctgaggacatcgaggcccaacacgaagcccaaaacgacctcgtcgagcccgaacagcaacagcaagaccccaagcctcccgttcccactgaacctcaagtgctgtcattaaaccagacgctgaaccggaaccgcaccagaggctcccggtcgggccggccgcggcgattcccgcggtctcactcgaccggtcattctttagtcctgccgggcgaagacactgaacggttcactttgcggcttcccgaggaagttagaaagcagatattgcagaacccgcaactgcatcgcgcgagaagcctcgttatcttaccgagagaaggtagttcgcggcgggggtatcgaaccggtgaaggaagtagcagagggagatcgtcgaggcggttggaccgggggtttaagtcggaccggtgggttttcaccatggcgccgccttttttggtgagagcgtcgtcgattaggtcgcccagggtggccaataacggtggcgaaggaacttccgctgctgcgtctttgcctccgccgcctgctgtggagtctgtttgagttttgattcccccttctgcaagatttcaatattttattgtatttaccaattattttttgctgccacgatttttttacgctagaatttgtaagatgtgtataatatttggcacacttgttttgcgtttgaagataaataactgaaatcctgaatcacgatagattcttaaatcataatcttggtcatcagttcagatatgaatccaacggaaatggagatatatatatatataaaaaaaaaggacgacgggcggccagtgagc

SEQ ID NO: 1127 - DNA, 530 bp, Glycine max
tattagtctttggtttgcgggaattgttgttttcacaatgaagacagtcctattcctccttctggtgtcagcgttaatccccatcgccgtcgcgcagcccaatgacttctccgacgcaaacctcaacgagttcaactcctccgtagccataatcataatcatattagtagtcgcgtttttcctcatggcctttttctccatctacgtgcgccactgcgctgattccccttccaacaccgtcaggcctctcaccaccgcacgctccaggagggccgcgcgtggccttgaccccgctctgattcaaacattccctatcctcgaatactccgttgttaagatccacaaaatcggaaaagaagctttggaatgcgctgtgtgtttgtgcgagttcgaggacaccgaaacgctgcgtttgctccccaagtgcgaccacgttttccaccccgagtgcatcgacgagtggttgagctcccacaccacgtgccccgtgtgccgcgccaacctccttcccaccgagtccgaggatgcta

SEQ ID NO: 1128 - DNA, 1557 bp, Glycine max
acaaagtccgacaaaaccaagtgcccttaaattcatatagtcaagatgataagaaaataattagactaacaatactaggtatattataaatgaataaataacacaatgtgcaaatgagccactgatcccacacactctcaccccaaaaaataagcaaaaaaaaggaaagaaagaaaacgagttgactcataagccaatagggttgaaacataacgagttgactcgatcattgagaactctactcttcttccatttcagtcctctgcttcatctctgtaacaccaaactctcacaatctcttgcaagaattgacaacgaccctttatagaaggcgcaacgcagaacgcagaccaattgttcgacgaaattcttcaaccatgttgcgccacaaatggcggcgtgcagatcacccacctcttctccaccctcttccccacgtaactctcttcgctgtcactccaacacccccctttaacactcgcggaacgttgaacacttcttccatggttcactagaatgtacctcctcacatcttcgggcaacctcaacgtgtacctctccacacccttcccttgctcctccacaagggaatgccccgtcgagttcgacctcgaaaggtttctctccgacgcaacaaccccatcaccaatattagtgatagtagaattcctaacattcgtctttgaacctaactcaacctcacaagctagctcactagacgaatgttgttcctcgcttatatatattattttggtagtatcactagttgatgtgggatctccaacacaatcctggttgatgtcattgcttggcctttgctcaacttgggtggcttctgttgttgttgtcgtcgtcgtcatgtttcccaaacttccctcctcgccatgaggagggacggttatggaaacatggcatgatgattcctggctgagattcgcgcgacaaacgggacatgtcacgtgagatgtcagccaggaatcaatgcaatgagggtggaacacgtgattgcatttgggcagcagcctaagcgagtctttgtgagtgaaatccgttagacagacggcgcattcgagcgtttggttggccttattgaggtccttgatgttggagtaaaagagcgttgggaacgtgttgaggaggtccttgttgatcccctgggagcaggagcagggtaaggtggtggtggtgatgatgatgtgagactgggcgcaacggcggaggtagactgagatgatagccatgaggaggagggcgaagatgatggcggcgacggtgatggcgacggaaggctcccagctgtggtgggtgatgtaggcgggaactggctccatggaggattgtgctttagaaaggttgaaaatgagggagaaaatgatgtgagtgaggtgaaagtggaatgcattaaattcaagcattttgcggtcgcgtgggtgtgagaagaatgagaggggttatatatatatattgggagaatagagaaatggtttgttttttttattgtgatgaggatttgttggcattggaggaaagtgaatggagtcaaaaagagaagtgagc

SEQ ID NO: 1129 - DNA, 599 bp, Glycine max
  misc_feature (10)..(10): n is a, c, g, or t
caaaaggctngaattgagtgaaccccaccccaaaaacaggcactttgccctcactcacatcatacggtacggcacatgaaccagacgaccaaaagcacaatgctgcatggagccaggacccacctacagcacccaccacagcggggagccttgcgtcgccatcaccggcggcgccatcatcatcgccctactctgaaggggaagcatctcaagctaccttcgccgctgcgccgagtgtcacatcatcatcaccacgacccaaaccaccaccaccctaccgtgctccagcgcgcaggggatcaacagggagctcctcaacacgaccccaacgctctactactccaacatcaaggatctcaagaaggggaacgaaacgctcgaatgcgcggccagctcaacagagatgactgacaaagacgcgctgaggctgctccccaaatgcaaacacgagaaccaccctcactgcattgatgcccggctcgcgtgccacgtgacatgcccaggtagacgcgcgaatcagagccaggaatcctcccatgttgccataaccgtccctcctcataacgaggaagagggttccagaaacacaacaaccaacg

SEQ ID NO: 1130 - DNA, 835 bp, Oryza sativa
cgggctgcaggaattcggcacgagggtatactctacttcaactacctgtacgtgcggtggagcggccgcgacggcgtcaccggacttcgggcggcgtgcggcggcggagggcgtggagcggcggcgaggaagaggggcggcggcggcgtgcctcgacaaggcggcgctggcggccatcccggtgttcaggttcaaggcgtcggcgtcggcggcggcgctcggcggcggcgaggcggagtgcgcggtgtgcctgagcggcatgcaggacggcgacgcggtgcgcgcgctgcccgggtgcagccacgccttccacgccggctgcgtcgacgcctggctccgcgcccacggcacctgccccgtctgccgcgcgcgccccgccgtgccgcctcctccgccggcgaaaccaccctgcctgaaggcgccggagcccgccgccgccgccgccggccggcagccggtcgacctggagagccaagtatagcactaagctaatcaagacggttagttaattttagccatgtataaaatctagttagctcctactcctactactacatgttccttaattagttttttttttttttttttgcgttcttgaaatccaacgccattttcgtcaataatccagcaacgccattgttcccattgagatgaacaatgcctatgtccaatgtcttggcactctgtaaatcactttttgttattttgctgtaatttttttcccctggtttttgccaactttgaagcacaacgactgtgcaaaaaaaaaaaaaaaaaaaaaaaaaaaaaaaaaaaaaaaagggggggggcctcgtccgaattcctgcagcccggg

SEQ ID NO: 1131 - protein, 413 aa, Oryza sativa
MGSPRGRRRGDNGRLLLLAAAAVVIASLVGGGAAQPTTSGPGPNYFNPKSFNPSMAVVIVVLVTAFFFLGFFSIYIRRCAGGPLGGPGGYGVGGGGGGRVGGGFTFAAARSRRVRGLDPAVLGAFPTMAYADVKAHKAGKGALECAVCLSEFDDDETLRLLPRCSHAFHADCIDAWLASHVTCPVCRANLAFDAGVPPPPLAPPHALTTGQDVAAAPPQPAAPEQVTVDVVVADAEETEERIRREEAAELMRIGSVKRALRSKSGRRPPQFPRSHTTGHSLAAAAAVPATADDAAERYTLRLPDHVLREIVTSARLRRTTSLQSFRTTAAAGGGARAGRSVRLGQSGRWSNVSSLMRTFSARLPAWGSARRGAEADSPGKDGAKVAGDCTASVEQHCDGGGGGACPRPLGDHV

SEQ ID NO: 1132 - protein, 430 aa, Oryza sativa
MHAHQHQHALLAALLACALAASSSTAGAQPAGQQGYAYGDVSGQQVHVSTTMIVLLAAVVGVFLFIAISTIYLRHCTGYDPATEGGGVGGSRSMILPANSFVSRRQRRPRGLDSSVVRMFPTMKYAEAKALRVGKVAGAALECAVCLSEFEDDEMLRFLPKCSHAFHPDCIGQWLASHVTCPVCRRNLDPNKDTTEEVIIPAAAAADPNSTSSEIVVIRQEDGAHPAAVVIDVVTEEDDEERRKEELELQAIGTQLRAMRSRSGLRPKTSAAKLPRSHSTGHSLAVRLDGDLERYTLRLPEHVHREMVAAGEQSVRRGRRLGEGVGMGARCSPRFSRSGRWSSFLSNSLSGKLSFLSPSSRRTPDSTQVEVSSSSSSSVTKVKGKRVAAVDVADDGSAHGTAQYPGCTVASSAAAAAVDVEKAATRQVRT

SEQ ID NO: 1133 - protein, 387 aa, Oryza sativa
MGTRELLVVLAVVVMAAVGAGAQSSSASPAPATSQAPTVRQQTPFGRTMSTVITVSISVFFFLLFFCAYINQCRLAEAGDARAAAAAAAGGGAGGGPSRRGKRGLDPAVVATFPIVPYREVVKHKIGKSVLECAVCLTSFDDGDDLRLLPHCSHAFHPECIDPWLESRVTCPLCRANLEKPPPPPPPLPAAAAASPSPERSPRCQPSPPPPPPPHALVIPVEDEEDDSDEDDRKEEAVELEMLRSERRAARLPRSHSTGHSLVASAAAAAESGDHERFTLRLPQHVRDEVLRSLRLRHAASLVNLSDMSSEGSSRGGRRALGLAFGNGGGSSHGGRRWQAFLARTVSWARGGGDGSVRRGWDGSTRRGKDDAESSRKGATSPAAGRP

SEQ ID NO: 1134 - protein, 442 aa, Oryza sativa
MPTPRPRHRHHALPLALALAAPLLLLAAADGQPNESRDKNNGGGGGGFMAPSGGGGGMGSQSPSFSAPMVVLLVALIAAFFFIGFFSIYIRRCGGEASTGPTIPAAALAALSRQEQRSRRQRGLDPAVVESFPTMKYAEARELRDGGKDAVLECAVCLSEFDDDEELRLLPKCSHAFHPDCIGEWLAGHVTCPVCRCNLAPDAAAAEANVVSGEVDGEQQEEEVVVAIDVDREGEEEDEERRREAMELERIGSQRRAVRSRSGRPLPLPRSHSTGHSLATTRLGDAGDLERFTLRLPEHVRREMVAAAGEESLRRTAVREGRVGGGARSARIGRSDRWPSFIARTFSSRIPFWSASRRVLDAAEAGADAAATTTTTTPTSTARTKRDKTAAAADGSVSSAKGSVRFDCLGGGGGGGGPSNRVVAFANDDEEDDDEKPIARQV

SEQ ID NO: 1135 - DNA, 759 bp, Zea mays
  misc_feature (621)..(621): n is a, c, g, or t
  misc_feature (752)..(752): n is a, c, g, or t
actccatagggcgaatgggatcctcgaggccggccgggggctgcccgtatcctccaaattggttcgcgaaacactcatcactagtaccaatggaaacaacactccccatggtccggggcaatggccgcctcctgcccttgtcccttctcttgctcgctgccgccgatttcacaacggtgcatggccaggggcagcagcctgaagggccgtactactcgcgaagcttcaacccatccatggccatcgtcatcgtcgtgctcatcgccgccttcttcttcctcggcttcttctccgtctacgtccgccactgctacggcgacggctctagcggctactccgcgagcccggcccccggcggtgccgccgcgcgatcgcggcgccagcagcgcgggctcgactcggcggtgctggagtccttcccgaccatggcgtacgccgacgtgaaggcgcacaaggccggcaagggcgcgctcgagtgcgccgtctgcctcagcgagttcgacgacgacgagacgctgcgcctgctgcccaagtgctcccacgtcttccacccggactgcatcgacacgtggctcgcctcgcacgtcacctgccccgtctgccgcgaggcttcccgcctgnggatcgcggtcgacgcggaggagcgtccagactgacgggtcgagcaagggcggtaggacagttggcgacgccggcgcaggcgccaagtctttctgacatgacgacccagcgtgcgcgcctggacagcgtgnttgactg

SEQ ID NO: 1136 - DNA, 824 bp, Zea mays
  misc_feature (812)..(812): n is a, c, g, or t
cctcgaggccccccccggggcggcctgccctccgtcccacggatcaccccaccaccacacccatgggcccgatcaatggccgccgccgccgccgtctcctgctcctcgccgcggttgctctcgccggcgccgccgtggacgcgcagcccgactacttcaaccccaagaatttcaacccgtccatggcgattgtcatggtcgtgctggtcacggccttcttcctgctcggcttcttctccatctacctccgccgatgcgcggggcccccgctgggcgggcccgacgaccactaccatgtgaggcagctgggtctggggctcggcaacaacagctacgcgccgccgcccagcaggaggatgcgcggcctcgaccgggccgtgctcgactccttcccgaccatggcctacgccgacgtcagggcgcacaagggcgcgctcgagtgcgccgtctgcctcagcgagttcgacgacggcgacacgctccggctgctgcccaggtgcgcccacgcgttccacaccgactgcatcgacgcctggctcgcgtcgcacgtcacctgccccgtctgccgcgccatcctcctcgtccccgacgctgccgagcccaccgcgttggctgctgcccctgtcactgcagcgccggatgatgaccatgccgtggtggtcgacgccgcagccgctgccggggagaccgaggaccagaggctcagggagggaggaggccgccgagctgctgcggatcgccagcgccaagcgcgcgctgcgaagcaacaagtcgcagttcccgcgctcgcacaccacgggccactcgctcgncgcgccgtcgcc

SEQ ID NO: 1137 - DNA, 3151 bp, Glycine max
ggctcgagtttcatttggcatttacatttgcatttgatttccgcgttcgcaagttgtaatcaaaatcaagccatagcgaccgaggaaggcggtgatcggcaatgagcagcggcggcggaggcgaaggagaaggagaaggcgcgtgtgagtcgaacgtcgctgattctgtggcacgcgcaccaaaacgacgccgcggcggtgcggaagcttctggaggaggatccgtccctggtgaaggcgagggattacgatagccgcacgccgctgcacgtgaagtcactccacggatgggtcgaagtgtcgaagtgcttgatcgaattcgatgctgacgtcaacgctcaggatcgctggaaaaacactcctctggctgatgcagaaggagctaaaagaactgccatgattgagcttttgaagtcacatggtggcttgtcgtatctggtcaggacttcaggcatgaggttaatttactagtgaagctttcgacaccctaatgtcgttcaatttctcggagctgttactgacaagaagccccttatgttaattactgagtatctgagaggaggtgatctttataagtacctcaaggacaaaggtgcacttagtccttcaacagccatcaactttggcttggatattgctagagggatggcctatcttcacaatgaaccaaatgttatcattcattgagacctaaagccaaggaatgttcttttagtcctctggtgctgaccatttaaaagttggtgaatttggacttagtaagctcattaaggtccaaagtgctcatgacgggtgaaactggaagctactgccacatggctcctgaagttttgaaataccggagatatgataagaaggttgatgtgttctcctttgcaatgagtgagatgcttgaaggtgaacccccgttttcaatttaagaaccttatgatggagccaaatatgtggcagaaggacaaaggccttcttttagggcaaagggttatatcctgaactgcaagactgttgttgttgttggcggctggggttagtctctgtggaggtttgggtgttttttgaggcagagcttattctcattttgctccaatggagatgcaggaccaaatagaaagcacaagatcaaccatatttggctcagctagtaacatccattccaatgctgaaaagcaggccgaaaatgttgctcccaaggtgaggaaaccatataccattactaaacaaagggagaagtggacagaggaagagcatcaaaagttccttgaagctttgaaattgtatggtcgtggctggcgccaaattgaagagcatataggtaccaaaactgctgttcagattcgaagccatgctcaaaagtttttctctaaggttgtgagggaatctgaggtcagtgatgagggttctatacaaccaattaacatacctcctcctcggcctaagaggaaacccctgcatccatatccccgtaaatcagttaattctttcaggggtccccccacgcgtcaaatgaaacagaaatatctccatctacaaacctgttagttgcagagaaagacaccccatctccaacctcggtgctatctacggttggttcggaagcatttgggtctcaattttcagagcagactaacagatgcctttcaccaaactcttgcaccactgatattcactcagtcagcttatcacctgctgaaaaggaaaatgattgcatgacatccaaagcatccgaggaggaagagaaagcatcaccagcttcacgtcctttatccactgtttctaacccaaacatgtgcatgaagcctgagtttagttccaaggacactttcatagaagatgctgccgatatgccacaaaccactagtattaagctttttggaagaacagtctctatggtaggtaatcagaagtcactgaagatagatgatgatggtaagccgataactgtgaagtccgatgaagtagatgatgttgagaatgagaagcttggccaatcaggagaatccaagcaagtagatacacaattatcactcggcgtggttagtggtaactggcctataacacccgatgctgatggagctaatgtgaccagcatagagcccccaaaggagaacctatgcttcagtgaatctgcacctgatgcattttttccgcagtggagtttgtcccaaggccttccacctttctacctgaggccatgcaatcaggtcctaaatcccttgcctcttaggccctcctctttgaaagtaagaacaagagaggaggaaagttgttgcactggttccaacactgaatcagtctgtgacatggaaaaccaaggcaagaactcagatgctgttgattctaagtttcaaaaatatcacgaggaaggagctgcaccccagaagaagcctgcaaggggatttgtaccatataaaagatgtttagctgaaagagatggacattcttttattgttgccatggaagagagggaggggcaacgagcacgtgtgtgctcatagccttacattctatttttacatgattcataatcatggtgttaatcagagaaaaaaaaaactgagagaaataaggacctgatttaggtagctgtgatctaattgtctaattgacaagcatctgatttccaattcttttttccaatatcttctttctttctcctgaaaacacttcatgtccaataattcaagcgggggcttgtggcattgtttgttctggctcgtatcatgttacagttactttaaccaaatagagacatatagcagcaagtctgtcattactgttttatttctactcttggcttctgtgtgtctttttagttgtatgattgcatcagtgatgggggtgttctagggaagcgaggacaagcacagcatgtcactagacatcatatatgtcataacaattggctctggaaaacaaatgatgtcaatgaattaaagcttaaagagtgccatgtggtgatgactaccttaccaatttgtatatctggattttctttctgtatcatatttttaataatagattttaaacattgttgaaaaaaaaaaatcttcattgttgaattttcagtgtttgtgcaattgtgcttgttccctatcctttaagctgattatgggagtggaatcttaagcattttttgctcaaaaaaaaaaaa

SEQ ID NO: 1138 - DNA, 1668 bp, Glycine max
tattcggctcgagcacaccttcttccgttgttctcttccaattgccttgattttctcggaaaattcttattttccgagaaagttcgtgtttttactgttgaatcgagaattcccaaatcggggtgtctgaaattcaaagctgttgttgttgttggcggctggggttagtctctgtggaggtttgggtgttttttgaggcagagcttattctcattttgctccaatggagatgcaggaccaaatagaaagcacaagatcaaccatatttggctcagctagtaacatccattccaatgctgaaaagcaggccgaaaatgttgctcccaaggtgaggaaaccatataccattactaaacaaagggagaagtggacagaggaagagcatcaaaagttccttgaagctttgaaattgtatggtcgtggctggcgccaaattgaagagcttataggttccaaaactgctgttcagatttcgaagccatgctcaatagttttcctctaaggttgtgagggaatctgaggtcagtgatgagggttctatacaaccaattaacatacctcctcctcggcctaagaggaaacccctgcatccatatccccgtaaatcagttaattctttcagaggacccaccataccaaatgaacagaaatatctccatctacaaacttgttggttgcagagaagacaccccatctccaacctcggtgctatctacagttggttcggaagcatttgggtctcaattttcagagcagactaacagatgcctttcaccaaactcttgcaccactgatattcactcagtcagcttatcacctgttgaaaaggaaaatgattgcatgacatccaaagaatctgaggaggaagagaaagcatcaccagcttcacgtcctttatccactgtttctaacccaaaaatgtgcatgaaacctgagtttagttccaaggagatagaagatgctactgatatgccacaaaccactagtattaagctttttggaagaacagtctctatggtaggtaatcagaagtcactgaagatagatgatgatggtaagccgataactgtgaagtccgatgaagtagatgatgttgagaatgagaagcttggccaatcaggagaatccaagcaagtagatacacaattatcactcggcgtggttagtggtaactggcctataacacccgatgctgatggagctaatgtgaccagcatagagcccccaaaggagaaccaatgcttcagtgaatctgcacctgatgcattttttccgcagtggagtttgtcccaaggccttccacctttctacctgaggccatgcaatcaggtcctaatcccttgcctcttaggccctcctctttgaaagtaagaacaagagaggaggaaagttgttgcactggttccaacactgaatcagtctgtgacatggaaaaccaaggcaagaactcagatgctgttgattctaagtttcaaaaatatcacgaggaaggagctgcaccccagaagaagcctgcaaggggatttgtaccatataaaagatgtttagctgaaagagatggacattcttttattgttgccatggaagagagggaggggcaacgagcacgtgtgtgctcatagccttacattctatttttacatgattcataatcatggtgttaatcag

SEQ ID NO: 1139 - DNA, 1346 bp, Glycine max
attttgtccggatgggaccgaacaagggacgatgaaatcagtgtggtggaaagaagttgtgtttgtgtttgtgtttggtgttgggacaattgatatcggtggctctcaaattgtgaaccgcacatatacccaccctgcttcccacgccacatcgttctccctctccctccctctctctctctctctctctctctctctctctctaagctctttcttgttgaaactgtgagtctatgttatttgtggcggagcatgaactccaccaccaacacttcgaattctcagtcaatggctgcagcagcaccgagtgatggttctgggaagaaggtaagaaagccttacaccataaccaagtccagagagagttggactgaggaagaacatgataagtttctcgaagctctccaactatttgacagggactggaagaaaattgaagattttgtaggttcaaaaacagttattcagattcgaagccatgcccagaaatacttcttgaaagttcaaaagaatgggactgtggcacatgtgcctcctccccgtccaaagcgcaaagctgctcatccttacccgcaaaaggcatcaaaaaatgttttggtgccactaccagcttccattggttatgcttcatcgagaaatacgcttgcacctgggtttgcctcatgggatgaaacttccctgctgatgaatgctggagccgataaacccatgacctgtcaggatgaactcaacaatgttcatcatggaaatgaagctgatattggatcaaaggggataacacagattaccaacagcagtctcagtggtgttggaaattctactagaacactactgacttctgagataccaaagcaagggaaacaagctccagtgcttcatggtttgccagattttgctgaagtttacggtttcattggaagtgtatttgatccagaaacaaatgaccatgtccagaagctgaaggaaatggatcctataaattttgaaactgttttgttgctaatgagaaacctcactgtcaacttgtctagccctgacttcgaacccatttgatagaatggggagacaccccaatactactgggcaaggcgccaatgacccacccaaaagattactgcacaagcttaaaccacaagtaatttgacaactactcaattagtccctagacgtcaagggatctctctgagaaggccccagagtgttctctttttctaattacatgtgaatgacgtgataggatttccatgtaataaatataggctcttgtattaatttgtgattagccccggattacttgaaaaattaaagtatttattagattagtaagtgtatataaattttaatat

SEQ ID NO: 1140 - DNA, 1489 bp, Glycine max
agcgccctccaagcataaaatttgcaggattagacatttccagcaacacttgaagttgtcaatcaatggccatgaagccctcaacttccacaagtgggtctggcaagaagattagaaagccttatactattaccaaatctagggagagctggtctgaggaagagcacgacaagtttctcgaagctcttcaactatttgacagagattggaagaaaattgaagattttgttggttcaaaatcagttattcagattagaagtcatgcccagaagtacttcttgaaagttcaaaagagcgggacagtagcacatgtgcctcctcctcggcctaagcgcaaagcttctcatccttatccacaaaaggcatccaaaaatgttttgttgccaatgccagcttccatggtttatgtttcttccactagtacccttccaccagggtatgtcacatgggatgaaaattccttgctcatgaattctggatccaacaaatcagtgccttgtaaggatgagctcgccaatcttcttggaaatgaaggcacgcacacttcttttagttcttatatttgttggttcaattgcttgtttgatatgaagagtctgtgatggctgtactaaatggaacttttccaccacttaattatgttatatctccttgctgatgcagctgatattggatcaaaggggataacacgaattgaccacagcagtcttagtggtgttgggaactctactagaaatctgcctgctactgagatgccaaaacaagggaaacaggctcaggttattcatggtttgccagattttgctgatgtttacagcttcattggaagtgtttttgatccagacacagaaggccatgtccagaagctgaaggaaatggatcctataaattttgaaactgttttgttgttaatgaaaaacctcactgtcaatttgtctagtcctgactttgagcccgttagggaggtcatgtcatcatacgatgtccatacaaaaacagtaggagttaccgcaggaattgacgtcaagaagcagacaaatgatctatcatgtcaaacagcttgacaaccattaattgaacttattatcaaatttggatggaagaccgaggttttgcccaaccagcagcattagcaatgcattcacattaactcgttgtgaaacttgaaaatgcaaccaaaccatcagcctatgtaaccacaaccaggagagtttgttttaatggaagtgctagcaaagccaaaaatatattcatcgggtaattctaaggtgcacaaggttttgtagtattgcagtgattctagtacttatttatggaatgtggttttcaagtagacacatgggtctaactgtaagataagtttgatggctcaggtgtattaattggagaggtggggggctagtcatagtagcttatatcaatgtggcctaactttcaatgtaaatcataaagagcatcataacaggaagtggtcccaatttctaattct

SEQ ID NO: 1141 - DNA, 592 bp, Glycine max
gtcgacccacgcgttcgcacggctgcgagacctctgaagggggagcctaaggtgtatgaaataagacgacaatattttgttccgatgggaccggacaagggacgatgaaatcagtgtagtggaagaagttgtgtttttgttgggacaattggtggctctcaaattgtgaaccgcacatatacccaccctgcttcccacgccacatcgatctcacgttctctctctttcttttttcttgttgaaactgtgagtctatgttatttgtggcggagcatgaactcctccaccaacacctcgaattctcagtcaatggctgcagcagccagtgatgggtctgggaagaaggtaagaaaaccttacaccataaccaagtccagggagagttggactgaggaagagcacgacaagtttctcgaagctcttcaattatttgacagggactggaagaaaattgaagattttgtaggttcaaaaacagttattcagattcgaagccatgctcagaagtacttcttgaaaagtcaaaagaatgggacagtggcacatgtgccttctccccgttcaaagcgcaaagctgctcattcttacccac

SEQ ID NO: 1142 - DNA, 526 bp, Glycine max
ccacgcgtccggagcggacgacacgaagcggccatagccgcacgttgggatcccctccgctacgcctctcgatggtctccgccagcgcgccgccgccgcaggcccagtccgacgcggccgggtcgggggaggaagtgagcaagaaggtgcggaagccgtacacaatcaccaagtcccgggagagctggacggagcaggagcacgacaagttcctcgaggccctgcagctctttgatcgtgactggaagaagatagaggcttttgttggctccaagactgtcatccagattaggagccatgcacagaagtaccttttgaaggttcagaaaaatggaaccagcgaacatgtcccacctccacgaccaaagcgaaaagctgcccatccatatcctcagaaggcttccaagaatggacacattttcgtcatttccgaagagaagatgtctcaagacaagaaggcagttgctgagacgaagctaactgaagaggaaaagcttcttgaggagaagattgctgggtttggtga

SEQ ID NO: 1143 - DNA, 724 bp, Glycine max
gcggccgccctttttttttttttttttttttgatcaattatctgttataccttgtgtttttttatttattgagaaacaacaacaaaactacatttaaaatgataattgatacctaagtttttaagaagaattacttaaaaaacctcaaagggagatctatgtcaatacaagaaaaagggggggggggagagaaaggaatgaaagaagtgaaggcttaacaaggttgacgttgaccacctgagctcatcctccgtcttttagatggaaaaagctgccggaaatcaccatgagccacggcggcaacatgccattcatccaaagccaacctctcctcctgaccaaactgcggtttgacctttcgcctgccagctcctactggcacgttgcgaagggccccaccagccgtccagtatctctggcatcccttgcagaaatgtctgggctgattaacgttgtagttattgaagtagcaaaacttggtttccatgctcttgcatcttgggcatggtatgatcttatcaggtctctttatctcctctgtcccatcttcactatcatttctatcttcttttctttctcttccatgcaacgtaatcgttgttccaaacagtttaatcccttcactagcttggccactttgtgcttcagccattaattttagagagaggaacaaagagagaatattattattcttattgaagaaggtttagctcgagccgaattc

SEQ ID NO: 1144 - DNA, 862 bp, Glycine max
tttcaatcctcttatctctttgtccatggactaatatttcatctatatctgcataccatcaatttcggggatcccaatcttatgtcacagctataatgtgtaacccccttaaccaattatccgcagtctatattcatgccttaaaattaaccttgcttatggacaatggacatgagcttcgaggaaaaaaaaccaatctcagcatctcacgtctcctcatagttgaacatcatcatttttttaggtgtgttcacatcttaattctcaagacacgctttggtcccttcgctgctgaagtccttaatttcttgttcataataattccaagttgtgttttcgtacatgatttcattgaccttgatgctgagctcctgaggtgattctctggcgcttggcctgaaaaatctggcggaaatgagtgttgggcatggcaacgtgtccctgattcatctcaaacctgttttcatcttcagaagtttcataggcacgcccatccatgaagtcaccggctccatggcacggtgacttagccttccggcgcccggcgccgaccgcgacgtttcggagggccccaccagccgtccagtacctctggcagctcttgcaaaaatgcctcggctgattaacgttgtagttgttgaagtaacagaatttagtttccatgctcttgcatctcgggcagggtattatcttctctgctctcttctccaccctctcatattcgcttcctttttctcctttctttacttccccacccttcaatgtaatcagcgcaccaaacagcttaatcccttgagattcctcgcccatttcagagagagagagagagagttattcttaacggagaaggttttggttggcg

SEQ ID NO: 1145 - protein, 205 aa, Oryza sativa
MAPAAGGFKLFGKVIMQCGVSEGTQDKAQGFVVAREKVEPEEEEEEEQRVPAAATSGQRASIKREAADRDEEQRQGGGDAAGQPTQRRLQDSAEARAAAAAPLPCPRCRSRDTKFCYFNNYNVNQPRHFCKACHRYWTAGGALRNVPVGAGRRKNRPLGPLAVAHHNHHHRAAAGFVLGFPNPSSPTSPSPVYTDRWPVTPDRPF

SEQ ID NO: 1146 - DNA, 446 bp, Glycine max
gctccactctccagccaaaagaaagtagttcagaacaagatgctaacaagactttgaagagacataatgcatccatgatgacctattctgattgtgaggaagaggatgccattccaatgagtaatgttgtcaataaacccccagagaagagacagagaacaccatcagcttataactgcttcatcaaagaagagattaaaaggctaaaggctgagaaccctgacatggcccacagggaagcttttagtacagcagcaaaaaactgggccaatttccccccaactcagtgcaaagaagatgaagagagctgtagcagccagacagatcaacatgtggatcttgactcccaagtggaccctaatgctgtggtcaatgaagaagaaggtcaagggttacgtggaagaaaggtcccaaagaaatccatattggaaaggacaccgtttgaa

SEQ ID NO: 1147 - DNA, 1037 bp, Glycine max
  misc_feature (1013)..(1015): n is a, c, g, or t
  misc_feature (1031)..(1032): n is a, c, g, or t
  misc_feature (1034)..(1035): n is a, c, g, or t
acgagaagggttttaagagagagagagagagagcgaataattaaaaggcccttgccttcacctttggtgtccaaagatattgctagagagaagaactagttgttcaattagcttcttcttcttcttcttcttcttccacccttcttgtttgagtaaattaagaagcttgagatcagacatgtcgagctgcagcatcgatgttgcgcctgagcaactctgctacatcccctgcaacttctgcaatattgttcttgcggtgagtgttccatgcagtagcctgtttgacattgtgaccgttcgatgtgggcactgcaccaatctatggtccgtgaacatggccgccgcgtttcagtcactgtcatggcaagatgttcagggatctgggcactgcaatccagagtacaggattgacactggctccacgtccaaatgcaacaataggattgcaatgcgtgcgcccaccactcatgtaactgaggaaagggttgtgaacaggcctcccgagaagaggcagcgcgtaccttctgcttataaccagtttataaaggaagagattcagaggatcaaagccaataatcctgatatcagtcacagagaagctttcagtacagctgcaaagaactgggctcattttccccatattcatttcgggctgatgttggagagcaacaaccaagttaagatggagaatgtttctgagaagcatttaatgtcaagggctgcgctattgaataaatgaatgctatcttcatcatatcacaggacttgggtttcatttgaatctgtcaagtaaacaatgtcctgacctaaaaggagttttaaggacaatcatctctttttcttcgttagtgtacttgtcactacttactacttgttcaatggatgcttttcacttaatttgaagcaagaatgctagttttcccttgtcatctttcaataagttctatcttctagctgattcagatgaaagatgaaatatgtatgctactgttttaagctcgatggcgagaacnnntatcatcatatttttnngnnat

SEQ ID NO: 1148 - DNA, 940 bp, Oryza sativa
atatatatatatatatatatagcatacgtacgtatatcgtacggtagcagcagctggtcttatagggggtacatactccatgcaacaacaaattaacaagatcaaacataattaactaataaacaccaaacgagcacagatatatgctaaaggggaacgatgagcatgcatgcatgagctgagctgacgacggtgataataagggggatctgaaatttggtactctccccagtggccggcctgcaggctagctagcttcatacgagcttcaccgccgatatagatcgccgccggctccggccgccgccgccgccctagccgctgcgctccatctgcttgaagatgtcgaagctctcgaccacctgctcgttggccctctcctgatgaggaatgggagcagctactactctgggctcggggttgctgttggaggtggaaaccgtcgatgagcagcgggggtcgcacttcgcccagttcttggcagccatgctgaaggcctccctgtgagggatatctggcttggcagctttgatacgctgtatttcctccctcatgaagcggttgtaagcagatgggaggcggtgtttcttctctgggggcttcacaacgaagggtgctcttgggctaccctcatttgatgtcggcgagaccagcggcagcggctggttcctcctgcagtcagtcctcgggccctgaaacgggcccaaggggtgatcagttggggagagcggctgcaccatcggcggccgcgggctgaggaaggagaggttgttgcagtggccacatttcacggtcacggtgtccatcagcctcttgcatgggactccaacctgcagcgcgagcacggtgttgcagtaggtgcagcgcacgtagcacaggtgctcggacggcgacacgagatccattgcggcggcgacgacggcggcgacggccctcgtgc

SEQ ID NO: 1149 - DNA, 1261 bp, Oryza sativa
caccaatctctctctctctctaagatctctatctatctaaagatctgagctacaattaattaaaacctgataagaagaagaccctgagctcaatcccttcttattatactatatatatacttctgtatttgtgcacagccggccggcaggtatctgcagacagccatatctatctttctagctaattggcaatatgcctgaagtccacggctcgtcctaagatttacttctccacccccccccccccctctcctttgcttcttcttcttcatcatcatcttcttcctcctcctgttaattaagttcttgatttctaagctagcaattgagcacacatcgatcgcgagagacgcagcggcgcccgtctaccgcggggctagaggaatgtcggcacagatcgtgccggcgccggagcatgtgtgctacgtgcactgcaacttctgcaacacaattttcgcggtcagtgttccaagcaatagcatgctaaacatcgtgaccgtccgttgtggccattgcactagcctgttgtcagtgaacttgcgaggattggtccaagcactcccagcagaagatcatttacaggacaatttgaagatgcacaatatgagcttccgcgaaaactactctgaatatggctcatcttccagatatggccgagtgccaatgatgttctcaaaaaatgacacagagcatatgctgcacgtgcgacctccagagaagaggcagcgggttccttcagcttataacagatttatcaaggaagagatccggaggataaaagcaaacaatcctgacataagccacagagaagccttcagtactgcagcaaagaattgggcgcatttcccgaacatccatttcgggttaggctcccatgagagcagcaagaagctcgatgaggccattggagctcctagtccccaaaaggttcaaaggctgtattgatcgagtacacatgatgatcgatggatcctacgtgcttgttgatctcatgttgtaagtaacttaaaaaaaaaaaaaaatctacgcttatttatttcttaagtatcatcagttaaatttgtgagcgagtatatagatgagttgtcatgatcagtgagtgatcgtatgcatgcagtgctgagaattaaaggtgtatatgcatgagtaacgttacatgcagctagtgtcgacgcacgtatgacagactgaataaactcttcaccatgttgtttttttatgtttgaaatgaattaattaattgtccaaaaaaaaaaaaaaa

SEQ ID NO: 1150 - protein, 158 aa, Oryza sativa
MAQASPGKELAKLSKGRHTWEKVNVPNNCSYNIVTVRCGHCTMVLSMDLAPFHQARTVQDHQVQNRGFQAPEKRQRVPSAYNRFINSTIRDEYTYIFKGRRKPQLRMGLVEEIQRIKTSNPEISHREAFSAAAKNWAHLPRLHFGLSVADGGGGGGSN

SEQ ID NO: 1151 - protein, 77 aa, Oryza sativa
EEIQRIKAAKPDIPHREAFSMAAKNWAKCDPRCSSTVSTSNSNPEPRVVAAPIPHQERANEQVVESFDIFKQMERSG

SEQ ID NO: 1152 - protein, 194 aa, Oryza sativa
MDLVSPSEHLCYVRCTYCNTVLAVGVPCKRLMDTVTVKCGHCNNLSFLSPRPPMVQPLSPTDHPLGPFQGPCTDCRRNQPLPLVSPTSNEGSPRAPFVVKPPEKKHRLPSAYNRFMREEIQRIKAAKPDIPHREAFSMAAKNWAKCDPRCSSTVSTSNSNPEPRVVAAPIPHQERANEQVVESFDIFKQMERSG

SEQ ID NO: 1153 - DNA, 1261 bp, Zea mays
gccgggaccccaacaaataaaagcactgctgcttgccagtattgctttgctttgccttgcttgcccccacacgccctctctctcctctctctctctcaaaccgaaaagaaaagaggaaagtgggatagctcaatctcttcttccttcgtcattcctctcccgtaggttctctctccctccctccctccctccctccctcagcacacataaactcgagatacacatatatatcagtaggagaggatggatgtgcaaacctagcctgctgcctttgtagctgcaaattaaattgagctgtacctgttggtcttcctcctcgctcttcttggttctcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgatgcactcactcccagaacaagatcatcagctccaggagaacatcaaggtccatggcatcaacggcactttgcacgatgatcatcagtactgcggccatttggatcagctcggttcttcttcgtcgtcaaggttccggcggctttcagtgatgtgttcgccacagaacgagcagcacctgctgcaggagcaaacacttaacaacaatgctcgtcctccagagaagaggcagcgggttccgtcggcgtataacagattcatcaaggaagagatacgcaggatcaaagcgaacaaccccgacattaaccacagggaagccttcagcacggcagccaagaattgggcacattatccaaacatccatttcggtttagacgactccgggcgagagggcaagaagaagctcgtggatcatgaggcggcggcgtctgtcgtcgcagtcgcagcagcaccgactgctgctaaaaagatccagggtttctactgatggtagcagatagatgtgtagattgattgatacatcatcgaccgggtggaagaattgataccacaaaaactgctttatatatatgtactgtgagtaaacagttaaaattaaacttgtgagatgtaccgtacatatgaagagctagctagtagtgagtcataaagtgggaaagtgaagcatatatagtcgtaaaaaaaa

SEQ ID NO: 1154 - DNA, 872 bp, Zea mays
cattgggaccctcgaggccggccaccaagcaagcatggatatggtttcgcagtccgagcacctgtgctacgtccgctgcacctactgcaacaccgtgctcgcgctgcaggttggggttccatgcaagaggctgatggacacggtgactgtcaagtgcggccactgcaacaacctctcctacctcagtccacggccccccatggtgcagccgctctcgccgactgatcaccctttggggccattccagtgtcagggaccctgcaacgactgcaggaggaaccaaccggctgccgctggcttcgccgtcatcgactgagctcagcccgagaatgccgttcgtagtcaagcccccggagaagaaacaccgcctcccatctgcttataatcgcttcatgagggaggagattcagcgcatcaaagctgcgaagccagatatccctcacagggaggccttcagcatggctgccaagaattgggcaaagtgctgacccgcgctgctcgacggctgcctctaccgaaacttctaacagcgctcctgagcctagagttgtgcccactcctcagttaactgagccacgctttgacctggaggatagggccaaggggcaagtcattgagagcttcgacatcttcaagcatattgagcgcagcatctaggtcgttcgatgccgctgttgtagcccagtatcgatcgagtaccatcagctatatgtataacctatcccgtatcgccgtcgtcgcctcgcaatcatgcatccccatcctgtacttttacccccgtacgtgttactgttgctgttattctcgttatggttggattgtacgcaccatttaattatgaacagctgctaccctatatatataatatttgc

SEQ ID NO: 1155 - DNA, 965 bp, Zea mays
acgtcgtcgtcggcccctccgagaaataccaccgcgcccgccgccgcgcgcgccaccacgtccacgtacgccggccggccaccaagaagcagcatggatacggtttcacagtccgagcacctgtgctacgtccgctgcacctactgcaacaccgtgctcgcgctgcaggttggggttccatgcaagaggctcatggacacggtgactgtcaagtgcggccactgcaacaacctctcctacctcagtccacggccccccatggtgcagccgctctcgccgactgatcatcccttggggccattccagtgtcagggaccctgcagtgagtgcaggaggaaccaaccgctgccgctggcctcgccgacatcgactgacctcaccccgagaatgcccttcgttgtcaagcccccggagaagaaacatcgcctcccatctgcttacaatcgcttcatgagggaggagattcagcgcatcaaagctgcgaagccagatatccctcacagggaggccttcagcatggctgccaagaattgggcgaagtgtgacccgcgctgctcgacgactgcctctactgccacttctaacagcgctcctgagcctgctagtagagtcgtcgtgcccactcctcatgtaactgagccacgctttgatctggaggatagggccaaggagcatgtcattgagagcttcgacatcttcaagcagattgagcgcaccatctagatgtctccatgtcgaaatggtgcggtagccccaggatcgagtaccatcagctctatatataacctatgcatgcatatgcatcgtcccggcccatcctgtactttttaccccccatgttactgttgctattattcttgctcttgttggattgtacgcaccctttaattatggacagctgctaccctatataatgtttgccctccttatatattgtcgtcgttccttatatagggttatgatcc

SEQ ID NO: 1156 - DNA, 1147 bp, Zea mays
gtgcggcgctcgaggcggccgggttgcgctctatctgtctgcccgtggcgtgctccactgattcttcttcttcttctacctcccggcctcctcccccttcttctttgcctgccttattagtatctcgcctcacaccacacagctagcagacagccagacacgcgctgctttctgatctctccccggatcggaggctcctcccaacataccaccctgccagccgcgccgccacgtccacgccggccggccaccaagcaagcatggatatggtttcgcagtccgagcacctgtgctagcgtccgctgcacctactgcaacaccgtgctcgcgctgcaggttggggttccatgcaagaggctgatggacacggtgactgtcaagtgcggccactgcaacaacctctcctacctcagtccacggccccccatggtgcagccgctctcgccgactgatcaccctttggggccattccagtgtcagggaccctgcaacgactgcaggaggaaccaaccgctgccgctggcttcgccgtcatcaactgagctaagcccgagaatgcccttcgtagtcaagcccccggagaagaaacaccgcctcccatctgcttataatcgcttcatgagggaggagattcagcgcatcaaagctgcgaagcccagatatccctcacagggaggccttcagcatggctgccaagaattgggcaaagtgtgacccgcgctgctcgacggctgcctctaccgaaacttctaacagcgctcctgctgagcctagagttgtgcccactccccagttaactgagccacgctttgacctggaggatagggccaaggggcaagtcattgagagcttcgacatcttcaagcatattgagcgcagcatctagaggtcgttcgatgccgctgttgtagcccagtatcgatcgagtaccatcagctatatgtataacctatcccgctatcggccgtcgtcgcctcgcaatcatgcatccccatcctgtacttttacccccgtacgtgttactgttgctgttattctcgttatggttggattgtacgcaccatttaattatgaacagctgctacctatatatataatatttgccttcttttttgttcctaaaaaaaaaaaaaaaaactcgagagta

SEQ ID NO: 1157 - DNA, 966 bp, Zea mays
aagcatggatatggtttcgcagtccgagcacctgtgctacgtccgctgcacctactgcaacaccgtgctcgcgctgcaggttggggttccatgcaagaggctgatggacacggtgactgtcaagtgcggccactgcaacaacctctcctacctcagtccacggccccccatggtgcagccgctctcgccgactgatcaccctttggggccattccagtgtcagggaccctgcaacgactgcaggaggaaccaaccgctgccgctggcttcgccgtcatcaactgagctaagcccgagaatgcccttcgtagtcaagcccccggagaagaaacaccgcctcccatctgcttataatcgcttcatgagggaggagattcagcgcatcaaagctgcgaagccagatatccctcacagggaggccttcagcatggctgccaagaattgggcaaagtgtgacccgcgctgctcgacggctgcctctaccgaaacttctaacagcgctcctgctgagcctagagttgtgcccactccccagttaactgagccacgctttgacctggaggtactgcaaagccttctcccttcactcttctctgtagacaaataagcaagatttgaatatgctatgctatttcctatacgcacatgcatgcatgctgctcttgcaggatagggccaaggggcaagtcattgagagcttcgacatcttcaagcatattgagcgcagcatctagaggtcgttcgatgccgctgttgtagcccagtatcgatcgagtaccatcagctatatgtataacctatcccgtatcgccgtcgtcgcctcgcaatcatgcatccccatcctgtacttttacccccgtacgtgttactgttgctgttattctcgttatggttggattgtacgcaccatttaattatgaacagctgctacctatatatataatatttgccttcttttttgttcct

SEQ ID NO: 1158 - DNA, 678 bp, Oryza sativa
ggatttggcagtcaagccggagggaacagaaacacgcagaaacgaccgacgaaacaagaagaagcaacaaacagaacaagaaaagctacccagaccggaccggcagagcaagcgcgctaagcgcactgcaacccctgcaacacgatgcccacggcgagggccccaggaaacagcggaggggacaccgtgaccggccggcgtgggcaccgcacgaatctgctgtcagcgaactggagaggactgatgcactcagccccagcactacaagatcatcaccatcatcacctccaggagagggggctgagcggatgctgccgggatcaaaggggctagccggagtttggtgctgccgcagcctcgccgacgtccaagctcaggctgcctcctgctgctgctgccatggactcctactcgcagcaaaaccagcagctcgagcaagctctccatgctcgccctccagagaagaggcaaagggtaccctcagcctataacagattcattaaggaagagatacgacagatcaaagcaaacaaccccgacattagccacagggaagcctgcagcacagcagccaagaactgggcacattacccaaacatccattctggcctaagccctggcccatgaggtggcaagaagctcgttcgacgtcgaccccatcccaactgctccatcttc

SEQ ID NO: 1159 - DNA, 282 bp, Oryza sativa
  misc_feature (30)..(30): n is a, c, g, or t
  misc_feature (37)..(37): n is a, c, g, or t
  misc_feature (49)..(49): n is a, c, g, or t
  misc_feature (52)..(52): n is a, c, g, or t
  misc_feature (69)..(69): n is a, c, g, or t
cggacgcgtgggtctagatcgcgagcgganactattnttgatatggttnatnttacaaatatggacgantgccaatgatgttctcataaaaatgacacagagcatatgctgcacgtgcaacctacatagaagaggtatcgggtaacttcagtttataacatatttatcaaggaagatatccggaggataaaatcatacaatcctggaataaggcacaaaaaaatcctttaatactggatgtaaaaattgggcgcatttcccaaacatccatttttgggttta

SEQ ID NO: 1160 - DNA, 1574 bp, Zea mays
gcactctctctctctctctatatatctctctctctctacgcgaaaagaaaagaggaaagtgggatagctcaatctctccttccaccgtctctcagttctcactctagcgctctctctctccacatatatatcagtataggatggatgtgcaaacctagcttgctgctgcctttctagctgagaactgagctgtagctgttggtacggttttcctcctcgctcttcttctcctccttcttgctgctggttgccgggagctgagatcgatcgagagcactgctgttgttcgtgcggccggcggcggcggcgcgcggcagtgggcggagacgacgaccgatcggtcagaaggaatgtcgtcggcccaaatcgtgccggcggaccatgtgtgctatgtgcactgcaacttctgcaacacagttctcgcggtgagtgtcccggggaacagcatgctcagcatggtgacagttcggtgtgggcacctgcacaaatctactgtcagtgaatctgagagcactcatgcactcagtcccagaacaagatcagctccagcagcaggagaacatcagggtccatggcacgttgcgtgagcatcatcagtgcggcggcggccaccatctggagctgggctcttcgtcgtcctcaaggttccggctgccgatgatgatgtcgtacgcgccgcagaacgagcacttgctgcaggaacagacactgaacaacgctcgtccggctcctgagaagaggcagcgggttccgtcggcgtataacagattcatcaaggaagagattcgcaggatcaaggcgaacaaccccgacattagccacagggaagccttcagcacagcagccaagaactgggcacattatccgaacatccatttcggcttaaactccggccgagagggtggcaagaataagctcgtggacgaggctgtcgcggcggtggcggtggctccgaagaagatccaaggtttctactgatcgatgccggtcgatcgagggatcagcgctcgtcgtcatcaactggccggccgggtgtggaagaattaataataccacacaaattataaatgtactgtgatgagtaaattaaagagttatagtggggaatgaagggagagagagatatatagcaatacgtatattaccttaccttattaatgagtgcaaaaaaaacacttgtgaaggtttctactgatgcatgagtgggaagtgaaaaaaaaaaaaaaaaaaaaaaaaaaaaaaaaaaaaaaaaaaaaaaaaaaaaaaaaaaaaaaaaaaaaaaaaacccccgcgaccacccccccgttcttttggttttttttttcgccttttcaatcgaagaattcgggggccatgggcgggggaaacggccaaaagtcaaaaatggcccccaaaaggaaccccgaaaaaaacaagggcggaaaaggcagccagttggaggccaacaaaaaggccatgaacatccagggaaaaatttgaatgcaaactttaatttgcaccacttccgaggccaagtgcaaaaaacatgcggaggcgaggaatccaaagaacaacctttacaagtgtttccccaa

SEQ ID NO: 1161 - DNA, 1429 bp, Glycine max
tgtttatcatacaatcaataattgcatttttttttcaattgacactatggtacttgacaaacaatggattgaaatattacaactaatgaagtcttctaatcaagtgaaaaacataacaaacaatcttaaatcgatcagtatcaaaatatatgtcctttttaaaatggttagagcctttgtaattatctccaaccttgaatgcacttaatttgtttataaatttcactataataaagggaaattaatcattgttttccataggcccagaagtccatctctcccctcaatgaaagttgattgatctggtggacagactgtggatttgcctcttcaaacctgacccctttggatgagtcctcatttccagcaagatgagaggtcactagcctatcaagaacaccccattcgtttattccttcacctcttccggttcccatttcttgatttggttcacacgacccaacttccatacctgactccgaaacttgatatcttaggccatcactgccgctctcacagtctctagggtttgtcatgagttgctttgccatgataggggtgtctgatgtatatgaataatcataaaccataggcttttgggtctgaagaagaggctcggattggaagagtgagtatggagggttttgcaagtgtggcggcgggtaatggagagccagctcaggcttatcaagctcaagccctgatgagttcctaggattttgctgttgatgtagtaagtagtgattttctctataggaccgtgcattagtgtttgaagaattgttgatttggtgatctggtttatgtgtagacccaccttcattttcaatcttgaataaattcttcttcttgaacactctgcacaccacccagccatcttcattggcacttccttgaggatcattgccatcttctaggcggtactcatgcatgatccaatcagtcttttgtccatgaggagctcttcctttgtaaaacacaagggtttttctcattccaatcttcttgaagctattcctaatgcacttgtctcttcctgttgctttccaaaaccctgcgttcgttgctctattagtccttgaacctgtagggtactttctatccttgtgactgaagaaataccactcgttttgtggagtagatccaattctacatctttcttgcaagtcccaaggctccatcttgttcaagtcgacctctctaatgacatccatgtcaaacttctgaaaggacaccttcttcttcaagtagtaatgaagcagctcttcatccgttggatgaaatctaaaccctggcggcacaccaccattagtcgacgaacccatcttattatctacaaattcaaactctcaatcacttaccaaatagatatttcaattcgctctatgaacttaatcgatttgaagctcgagccgattcggctcgagag

SEQ ID NO: 1162 - DNA, 802 bp, Zea mays
  misc_feature (758)..(758): n is a, c, g, or t
aattgaagctctagctagctagctactttgcaaagtttgcgtgcttcgatcgtctcgatggctgacttctcgtccagcaacggcgtcccgccggggttccggttccaccctaccgacgaggagctgctgctctactacctcaagaagaagatcggcttcgagaagttcgacctcgaggtcatcagggaggtcgacctcaacaagatcgagccatgggacctccaagagagatgccggatcgggtctgcgccgcagaacgaatggtacttcttcagccacaaggaccgcaagtacccgacggggtcgcggacgaaccgcgcgacgacggccgggttctggaaggcgacggggagggacaagtgcatccgcaccagctaccgcaagatcgggatgcgcaagacgctcgtcttctaccgcggtcgcgccccccacggccagaagtccgactggatcatgcacgagtaccgcctcgaggaaatcgacgaagcccagggcggcaccagcgaggatggatgggtggtgtgccgcgtgttcaagaagaagtgtttcttcaagatcgccggaggcggcgaagggagctcaagccagagcgcggacgccggcgccggccacatggccgtgtcgtcaccactgggtggccacgaccacgctgacagggccgccatggcatctcactacatgcacgggatgcacccgcagtaccacccccagcacgcctcttccttctactactcccagatgcaaccaccggaggcggnctactcgcaccacgtgcaggtccaggacctcctcacaaccaccg

SEQ ID NO: 1163 - DNA, 1687 bp, Glycine max
ccacgcgtccgcccacgcgtccgcccacgcgtccgcccacgcgtccgcccacgcgtccggaaaaacatggatgatctcccaccaggttttcgattctacccaacagaagaagaattagttttcttctatctacacaaccagctagaaggccaaatacacgacacaagcagagtcattccagtcattgacatcaatggcgtagagccatggaaccttccatgtactactacatgcataccactttaattctttaattttgttagttgttaccactcattctttagtatgtttcaaacccaaatgagttttgctaaaatggtttggtttgttttgttgtaatcagcacttgcaggggagctttgtcgtggagacacggagcaatggtttttcttttcaccgagacaagagagagaggccagaggaggcagacccaacagaaccacagcaagtggttattggaaggccactggttcccccggccatgtttactcttctgacaacaaagtcattgggatgaagaaaaccatggtcttttacaaagggaaagctcccaccggaaggaaaaccaaatggaagatgcatgagtataaagccattgaacactctgatcaatccaacactgcccctccaaaggtatactcatcattattatagtaaaacttcattccattttttcttttcaatttcgcgaatttggtcctttcatgttatttttgtcaatttgaacttcactattttaattacgtaattttagcctacgtgttaagttaatatttgatattttgacaggaaatgctgacatgacgatctaacaatactgtcacgttagcaatacaatgtgacattatgctatattatcacgtcaacgtttttgttgtatattatatgttaagttagctgatagactaaaatggagagtagaggtttgcaaaattgagaattatgaaagtaataagattaaaaaaaaaatgcatatccaacgtgccaatctggtagtatagtggtagttgctgctgttggttgcatatttcacacaaattctggtgctaatatagtttgtgtttttgttatgtataacagttgaggcacgaattcagcttgtgtcgtgtttatgtgatatcgggaagctttcgatcgtttgatcgacgcccactggatatgccaagagttgagctacgagttgttgatggggacagaggtgctgcttcaacaagtgctcaagctcaacagagaagttcttctcatacttcccactctggtggtgatgctcatgtcacagatgctggagcagggtcaagtggaacaaattggaatgcaagtaatagggttgaggaaccactttgggaatgggaacaacttgattggccatgacccaaaagtcaagaacatgctcaaacctagcaagactttcttaattgaataacgtcgtttcaattaaattaatcatataagttgtaggcgtagtttggttcgatttccttcacctcgaagggccatgtaatgtaacataatcattagtatttgttgtttaacataggattggttttccccgggaaaataagttgggaataagatccaagcataaaaaggaaggtggtgtggatcttgtaattttgtttttgtgacttgttgtcttgtaacgataatcaatctccttttcaaccctagaaaaaaaaaaaaaaaaaag

SEQ ID NO: 1164 - DNA, 1152 bp, Glycine max
cttagcctagaattcggctcgggctcgagccgtgatctcccaccaggttttcgattctacccaacagaagaagaattagttttcttctatctacacaaccagctagaaggccaaatacacgacacaagcagagtcattccagtcattgacatcaatggcgtagagccatggaaccttccatcacttgcaggggagctttgtcgtggagacacggagcaatggtttttcttttcaccgagacaagagagagaggccagaggaggcagacccaacagaaccacagcaggtggttattggaaggccactggttcccctggccatgtttactcttctgacaacaaagtcattgggatgaagaaaaccatggtcttttacaaagggaaagctcccaccggaaggaaaaccaaatggaagatgcatgagtataaagccattgaacactctgatcaatccaacactgcccctccaaagttgaggcacgaattcagcttgtgtcgtgtttatgtgatatcgggaagctttcgatcgtttgatcgacgcccactggatatgccaagagttgagctacgagttgttgatggggacagaggtgctgcttcaacaagtgctcaagctcaacagagaagttcttctcatacttcccactctggtggtgatgctcatgtcacagatgctggagcagggtcaagtggaacaaattggaatgcaagtaatagggttgaggaaccactttgggaatgggaacaacttgattggccatgacccaaaagtcaagaacatgctcaaacctagcaagactttcttaattgaataacgtcgtttcaattaaattaatcatataagttgtaggcgtagtttggttcgatttccttcacctcgaagggccatgtaatgtaacataatcattagtatttgttgtttaacataggattggttttccccgggaaaataagttgggaataagatccaagcataaaaaggaaggtggtgtggatcttgtaattttgtttttgtgacttgttgtcttgtaacgataatcaatctccttttcaaccctagaaattttctttcttgtttaggaattcaaatgaaattaatcaatctactatttgcttatgaaaaaaaaaaaaaaaaaaaagggcggccgccgac

SEQ ID NO: 1165 - DNA, 1237 bp, Glycine max
ccacgcgtccgtaacttagccaacatggagtttctcccacctggttttcgattctacccaacagaggaagaattagttgtcttctatctacacaaccagctagaaggccaaatacacgacacaagcagagtcattccagtcactgacatcaatggcgtagagccatggaaccttccaagtactaccaccactttaattttgttactattcattctttgctgctaaaatatatagtttggtttgtgttgttgtaatcagcacttgcaggggagttttgtcgtggagacacggagcaatggtttttcttttcacctagacaagagagagaggccagaggaggcagacccaacagaaccacggcaagtgggtattggaaggccacgggttcccctggccatgtttactcttctgacaacaaagtcattgggatgaagaaaaccatggtgttttacaaagggaaaagctccccccggagggaaaaccaaatggaagatgcatcaatacaaagccattgaacactctcaccaatccaacactgcccctcccaagttgaggcacgaattcagcttgtgtcgtgtgtacgtgatatcgggaagctttcgatcgtttgatcgacgcccactggagatgccaagaattgagctacgagttgatggggacagaggtgctgcttcaacaagtactcaacagagagcagcagtggtggatggattaagttcttctgatacttcttcccactctggaggaggaagagggggttctcatatctcagaggctggagcagggtcaagtggaaccaattggaatgcaagtaatagtagggttgaggaaccactttgggaatgggaacaacttaattggccatgacccaaaagtcaagaacatgcttcaacctagcaagactttattaattgagaaacatatcgtttacatcaatttaatctaagttggaaaaagcagggcgagaaattgattaattaatcatctaaattgtaggcgtagttgggtataacttccttcacctttaaggggcaagcaatgtaatgtaacataatctttactatttgttgtttagcataggattgatttttcccaggaaaataagttgggaataagatccaaacataaaaaggaaggtggcgtggatcttgtaattttgttttagtgacttgttgtcttgtaacgataatcaatcaatctccttttcaccccttgaaaaaaaaaaaaaaaaaaaaag

SEQ ID NO: 1166 - DNA, 2087 bp, Glycine max
tcgaattcggctcgaggaaaaatttctccttgtttgtacggcacacaagtgagatcaaagatggaaaatatgccaccaggttatcgtttctaccccacagaagaggagctgatttcgttctatcttcacaacaagcttgaaggagaaagggaagacatgaatcgagttattccagtcgttgatatatacgactacaacccatctgaactcccacgtaaaaatcttatatatatatatatatatacatatatatttccctcatctccctctttctcttttcatttttctaatttttttttcctttcaatcaaaatcgagcttgacttgaaagctatggtacaagttgatttattgcatatatatagaagcaaagcacattctggataatttaagggtacatacttttcttttaatttttcttaatgactgtaataccgtaaatgctgttgatatattattattctgtgatcaagattggagaaaaggatatacagtccttttggcttcatgaagattgctcataaaattaatattgatagatatatagatatacactagttttgcgtaactgactggtatatttgatattaaacatgatttactgaaacaaagatatagatgcattgatatatttttatttggtgttgaattgcagaaatttcaggagaggcaagtatgagagacacggagcaatggttttttttcattccgaggcaagagagtgaagcgagaggagggagaccaaagcgtctcacaactacagggtactggaaggcaacagggtctcctaatcatgtttattcttcggataatcgcatcatcggaattaaaaggactatggttttctatagtggaagagctccaaacggaaccaaaaccgattggaagatgaatgagtacactgccatcaaaacatcatcctctagtcccacggtaccttatatttactatacgtgtgtctaagaattagggttggctacattttaattagttgcctattaatttaatttgttaaatcttcaaggtttatcttctctactctccatattctcttcttccttcttctcaaatatcagaatttgagcacccttctgaacaaaaaaataaaataaaaattgagcatttttatttcttacgaatgcattgacacagaggcatttcactgaattttatcaactaataaaataataaaaaccaaaataaattgtgctcgatcgtgatatttcataagtatttcgtacgaaactaactcgtacattaaaaaaattgatcatagtactcaatattattctcagtcgataattaacttacaattaatcaaccattcagtcagaacaattaggtttgaattatatagtatatactatatatatagcatggaatttcatggatgcagtgcaattttaaatatttgttacgtgacagtgcagttttatatatatatattgtatacagatcatatatagttgcacttcttaatataactaaccttctgattctactatatattaattgcagctaaggaaggaattcaatttatgcagagtgtacaaaaaatcaaagtgtttgacagcatttgatagacgaccccccgccaaggagggacacagaaagctattcgggtgctcaaaatgtagaagagcaacaaaagggttcaacatcatatgatgattatcatcataaaatggtggagagaagtgcaacgtgttcaccagcagagagctcttcctccggagaccatgaccaaccccctcttcacggtgaggaagctactcaaatggatgttgacaacaacgatgacccttttttggattgggagaaagtggatatgttcttgggatcagaaccatgaacacatccaatccaatctatctgtgctttgttggtatgctacaacaaagttgactctcaagtctcagctacaccgatgactgaataagtagtaggttatgttaattaattgtgtatgtcgcaccgcatgcagaacaactactttaaatatttgttagatttcttgctagctttataaagttgtgtatagtggctaatttgtctgataaattatcacaaaaaaaaaaaaaaaaagg

SEQ ID NO: 1167 - DNA, 744 bp, Glycine max
aattcggctcgagaaagaacataaatagtatatacgagtcctagtttcatataatagttccatataacaaacattatggaagaagattatccacccgggtttcgtttcttcccaacagaagaagagcttgttggcttctacctacacaacaagctagaaggccaaagaaatgccatagccatagccatagacagagttatcccagttattgacatcaatggagttgagccttggaaccttccaacacttgctggggagctttgtcgtggggacacggagcaatggtttttcttttcgcccggtcaagagagggaaaccaggggaggcagacccagcagaaccacagcttgtgggtattggaaggctacaggttctccttgctatgtttactcttctcacaacaaagtcattggggtgaagaaatccatggtcttctacaaaggaaaagcacctatgggaacaaaaaccaaatggaagatgaatgaatacagagccatccatgtcccttcccaatccacccctgccacccttcatttgacatgtgaattcagcttgtgtcgggtatatgtcatatcggggagctttcgagcatttgatcgacgaccattagagaaagaaggagcagagtcgcgggttcatagaattgagaatattttgggtggggcacgtgctcaccaaacttgccctcactctcagatgctagaagctggagaatcaagtagcacaaagtgggatgtgaataat

SEQ ID NO: 1168 - DNA, 959 bp, Oryza sativa
  misc_feature (703)..(703): n is a, c, g, or t
caaccaagcgcgggtaaacggcgggagccgtggttctacttctgcccgcggcaggagcgggaggcgcggggcggccggccgagccggaccacgccgtccgggtactggaaggcggcgggcaccccgggggtcgtctactccgccgaccgccggcccatcgggatgaagaagaccatggtgttctaccgcggccgcgcgccgtcgggaaccaagaccgcgtggaagatgaatgagtacagagcattccactaccccgacgcctcctccgcctccgcctccagcgccggcgccgccgcgccaccaaaccatcttcctccgcaggtcgttcccttttatcggcggcgggtaaatatccaaacttgtatattctgagtggttcttgccaaactgccaatgaaccgggtgctccatcataaagcatttgaaccacacgcgttgatccatacgcaccagtgtataactatacagtacatgcaagtatgcaactgggcgaatgcatgattcgtgactccgtccgtatgcaactttttaaatggttgcatggttgacgcactggttatgatttactcatctgaggagcgagttcagcctgtgttgactgtacaccaaatcgggaggcatccgggcattcgatcgggggccgctcgcgggtggtggtgatgagaaccccgggcctttcatggctgccggggcgggttacccngggaaaagactgatcaggaattccttgcacaactggagctgttgataaggtggcgccgtgatccgttgggaccaggggacacttggccactttacgactttgttttgcctaaattgggatccattgttaattatttcttcttgttattgtaaggtgttaccgttaacaacaatgagtattgtttttttttcctccacttccttttaattgaaaaattgacccaccttttttgtttcagaaaaaaaatataataaaa

SEQ ID NO: 1169 - DNA, 952 bp, Oryza sativa
caaccaagcgcgggtaaacggcgggagccgtggttctacttctgcccgcggcaggagcgggaggcgcggggcggccggccgagccggaccacgccgtccgggtactggaaggcggcgggcaccccgggggtcgtctactccgccgaccgccggcccatcgggatgaagaagaccatggtgttctaccgcggccgcgcgccgtcgggaaccaagaccgcgtggaagatgaatgagtacagagcattccactaccccgacgcctcctccgcctccgcctccagcgccggcgccgccgcgccaccaaaccatcttcctccgcaggtcgttcccttttatcggcggcgggtaaatatccaaacttgtatattctgagtggttcttgccaaactgccaatgaaccgggtgctccatcataaagcatttgaaccacacgcgttgatccatacgcaccagtgtataactatacagtacatgcaagtatgcaactgggcgaatgcatgattcgtgactccgtacgtatgcaactttttaaatggtttcatggttgacgcactgtttatgatttacttatctgaggagcaagtttcagcctttgtggtactggcaccatattgggtggcatgtggtattttatctgcttcctatattagctgggtgtgatttgtatcttttgcgtcttttgttgttattgttgatttgtttgaagtgtctgttagtaatgatttattttgtttttattttttttatccctttttagttgtgattacggtttttgtttttgggttctgtttctttttttttgagatttttttttttttggactttgtacatttttgatattgtaccttatatttatattttgtcttatttttttcttgttggctgtttttgtttcttattatatttcctttttttctttgtattttttattactgggtgtttgttatttttt

SEQ ID NO: 1170 - protein, 256 aa, Oryza sativa
MADGGGRRAPGFRFYPTEEELICFYLRNKLDGLRDDIERVIPVFDVYSVDPLQLSEIHHEMLGGGGEEGEPWFYFCPRQEREARGGRPSRTTPSGYWKAAGTPGVVYSADRRPIGMKKTMVFYRGRAPSGTKTAWKMNEYRAFHYPDASSASASSAGAAAPPNHLPPQLRSEFSLCRLYTRSGGIRQFDRRPLAGGGDENPGPSMAAAAASPEENDGSGSSMQQLELMDQGGAVDPDWDQWDDLATLTALLYWPRD

SEQ ID NO: 1171 - protein, 285 aa, Oryza sativa
MVMSGGGGGARIVSDPAATPGFRFYPTEEELIGFYLRHRLAGTRADDVARVIPVVDVYGYHPSQLAAMAGVATAGDREQWFFFCPRAERELHGGRPARTTPSGYWKATGSPSFVFSSSAAAAARVIGVKRTMVFYQGRAPSGTKTRWKMNEYKAVAAAAADDDHNAAGVAVQLPPMAPPPSSSACVRLRNELSVCRVHHQPQLQQQQRQLPSSAAAAATNGNLIALAGGYECSHDSSGGSSEDAAIDWSSLITAATDSATAAVDFSFNDDIDFSPAAVGPWAPQL

SEQ ID NO: 1172 - DNA, 746 bp, Zea mays
cgaggccggccggggatccgctaccaagatactcctgcaccgattaataaattcatgcagctctataatttatttgcataaagcagcgagagctcgatcatcatcaggaactatctacccccttcaatttgcagccgcaattaatctatcggtcgtcgtcagcttgcgagcgacaaggcgcgacagatcgagatgatggaaagcagtggtggtagtggcagcagtgatccgttgctgctggcgccgggattcaggttctacccgacggaggaggagctgctgaccttctacctccggcaccgcctcgccggcaccaagcccgtcgtcgagcacctgatccccgtcatggacatctacggctaccacccctccgagctccaggcgatggccggcgcggcgaacgtgtgcgacacggagcagtggttcttcttctgcccccgcgcggagcgggagctgcacggtgggcggcccgcgcgcaccacgccgtcgggctactggaaggcccactgggtcgccgtcctacgtctactcctcctcgcccaacaaccgggtcatcggggagaagcgcaccatggtcttctaccagggccgcgcgcccaccggcaacaggacccgctggaagatgaacgagtacaaggccgtcgccgacgtgtgccccgccgccgcccggggcgcccgtcatgctgcgggacgacttcagcgtctgccgggtgtacatcagcacgggcacgctgaggtccttcgac

SEQ ID NO: 1173 - DNA, 1971 bp, Glycine max
gccctaatgtcggcttgtgtcccaaatttaaagggaacttcatctcttaaagatgatgaggccagcttacaaagggaattgagaaatgctgagtgcatggcatctttagcttcttctggtggctttcacaaaagggatggtttgtataatccacaacacccctcaatgtgccttggtgaaggccaaagtcatggatcacaaggctcgagcaacaatgtcttgaactcacaatacctcaaggcagcacaggagttgcttgatgaaatagtaaatgtccgaaaggctttgaagcaaactggtttggaaaagcaacagagtttccgtgacactggtttagatggctccaaagattctgatggaaaatctaccagccaatctgtgcagatgtcttcaggccccaatggttccgctgctaacgcttcttgtgagctatcacctgcagaacggcagaacttgttggacaagaagacaaagcttttgtccatgctggatgaggtggataaaagatacagacagtactgccatcagatgcagattgtggtgtcatcttttgacatggttgctggctgtggagcagcagaaccatataccacacttgccttaagaacaatttctcgccactttcggtgtttgcgtgatgccatcagtggccaaattcaggtgacccaaagaagccttggggagcaagagggaataccccgtctccgctatgtggatcagcaacttagacaacaaaaggcccttcagcaacttggtgtaatgagacaagcttggaggcctcagaggggacttcctgaaacctctgtttcagtactccgtgcttggctctttgagcatttccttcatccttatcctaaggattcagagaaaattatgctagcaaggcaaactggcttaacaagaaaccaggtggcaaactggttcattaatgcaagggtgcgtctatggaagccaatggttgaggaaatgtacaaagaagaatttggtgattctgagatgagcagcaatctattatcatcagagaaaacactcaaagctccaagagatgatgttcaagcttctgacaataaaagggaagagtcccaggacaacttaataaacgttgatgatagtgttcagcatcatgggttgaagttagatcatgcctcggaattggacagagggatccaaagcagtgatcatggagaaaatgccatggatcctagaattggaaaattgcaaggtgaccaaaggttcaacatgaacaacagcaataacaatagtccttattatggtgatggctgcataatggcttctactcctgccacatatgatttaccagagttaggtaacattgccgtcgatggccacgtgtcgcttgcattggaattgaggaactgtgaaagtcaaggatttggtgtgtcaaatgatgacatgcataaacgacataagaaaacattggcttcttccccagagactgatttgctagattaccatttcacagacccaggaaagcaacaaaacaagtttggcaatcctcacctattgcacgagtttgttgtgtgaagaagggttggagaaaattctaaagttttcaagggaactaaggaaatgtgtaccaccaaagtagtagatagatagacaaaagcctatgttgttgttgttaacttggttgctcattcttgttgtccacagatcataaaaagcgatgtaaatcatgaaccgtacaaaaaatatacacgtaggtatgtgtagatatattctcttgtaatatcgtggatggatgattggttgtatcatgtgcaggcaatttttgtaaggacaaggaacttatcttgtgcatcatgatgtataagggaatcttgtcaaaaacgtaaaaggagtacgaccatctatctgaaaaaaaaaaaaaaaaaaaaaaaaaaaaaaaaaaaaaaaaaaaaaaaaaaaaaaaaaaaaaaaaaaaaaaaaaaaaaaaaaaaaaaggggggg

SEQ ID NO: 1174 - DNA, 2458 bp, Glycine max
aggtcgcgggggcgcacgcctcggaaaactcaacctcaatttatggattcttgtctatcacttctgctctgaaacccactcttattgaattttagtcccttgttactgcttctatctcttactttcagaatagcaggggatttttgttataaaagcgatgtgcagctgattccattgtgaagaagagagcagaaagaaatcagcttataataatgtatcccaaccaagccttttctttagggtcctatgcggagatgatgtctgggacttctctttttcctcatgactacagtgaaactgtaggaggaggacaaaacgaggttaagtttatcacagcaatgggtgagacagtgactatgcactctattaatggccattccaatgctgcaagtggtgatccagcatgcaactcttttgctggggattcccatgttgtttcaaggacacaaatgggaatggtagatagtgagcaaaacatcaattgccagggcctatctctcagtctcgggacactcatgccttctaatgcatccgtctctccatttcaataccaatatcacgacacgggtctcttaccactaatgaatgattttccaaatccaaagggagccatgtctctcaaagatgatgaggccaataacctacatggggagtttagaagtgctgaatgcatggcatctgtgtcttctggaggctttcttgacatggtaaaaaaggagtgtttttacaacccccatgacccctcaatgtgtcttaaagaagtcccctctgatctaccacgttactcaaacagtattttgaactctcaatacctgaaggcggcacaagatttgcttgatgaaataggtagtggccgaaaggctttgaagcaatctggaatggaaaaacaagagaacactggattagatggctctaaagattctgatggaaaatctaccagtcaatctatgcaaatgtcttcaggccctaatggttccactgctaatgcttctagtgaactatcatccgcagagcggcagaacttgttggacaagaaaacaaagcttttgtccatgttggatgaggtagataaaagatacagacagtactgccatcagatgcagattgtggtgtcatcttttgacatggttgctggctgtggagcagcagaaccatataccacacttgccttaagaacaatttctcgccactttcggtgtttgcgtgatgccatcagtggccaaattcaggtgacccaaagaagccttggggagcaaggaataccccgtctccgctatgtggatcagcaacttagacaacaaaaggcacttcagcaacttggtgtaatgagacaagcttggaggcctcagaggggtcttcctgaaagctctgtttcaatactccgtgcttggctctttgaacattttcttcatccttaccccaaggattctgagaaaattatgctggctaggcaaacaggcttgaccagaaaccaggtggccaattggttcatcaatgcaagggtgcgtctctggaagccaatggttgaggaaatgtacaaagaggagtttggagactccgagatgaactgcaacctttcatctgagaacaacacggtcaaatgtaaaaaagatgatcttgttcaagagtctgataacattaacaacaataataaatgggaagagacacaggacaatttagtaactgttgacagtgtccaagtccaacctcaagcagaactggatagaggggtcaatgtagaaaatgtggtgatggattctggaactgggaaattgcagggtgatcaaaaccaacaaaggcttggcatgaacaacaacaacaacttttattctatctcaaccaaccagaatgatggaggcctaatgggttgttctactcatgccacatatgatttatcagagttgggtaactttactgtgggtagccacgtttcccttgcattggagttgaggaactgtgaaagtgatgggtttgccatgtctgatgatgccatacgcaaacgacgtaatcaagcattggcctcttccccggagactgatttgctagattatcatttcacggattcaggaaagcaacaacacaggtttggcaatccccatttgctgcatgagtttgtcgtatgaaatctagcaaaaaaatatttgatgattttaatggatctctggagaggtgtacctcaacaaagctgaaagagaaaaaagcctatgctgtgctgctgctgctgctgctgattttgctactttttttcttcctcattcttgttgcccattgttcgtaaaaaagtgatgtaaatcacaaaaccgtacaaaatatacaggtagatatgtgtagatatattcgcttgtaatattttacagatgattggttgtatgtatgtgcaggcaatttttgtaaggataaataaagaaaatttctcgtgcaaaaaaaaaaaaaaaaaaaaaaaaaaaaaaaaaaaagg

SEQ ID NO: 1175 - DNA, 422 bp, Oryza sativa
tgtattttatcaatgatcagatcaatgttatcagggggtttctttgaaaggaagagaacttatctggcaaggagggaaaattaacccgtctccggtacattgatcagtagctaaggcaacaacgtgctttccaacagtacggtatgatttcacaaaacgcctggagaccacagaggggactgcctgaaaacttctgttacaattctccgcgctaggctgtttgaacacttacttcatccgtacccaaaagattcccagaagtctatgcttgctaggcagactggcctgactaggattcaagattttgaattgttttataaatgcccgtgtacgtctttggaaaccaatgaatgaaggacatgtacatagaagagattggtgatttagagcaagactccaactttttctttgacaatgtacca

SEQ ID NO: 1176 - DNA, 979 bp, Glycine max
  misc_feature (760)..(761): n is a, c, g, or t
ccccccagccgctttctccctcctctttttctcatccaccaacaccaattcacttttcttcttcttcttcttcttcttccttcattttcttctctgcatctcacactgatcataccccaaacaacccttttgagatatgtttatggttatggattcagcagaaaggtgcttagattctcaactatggcatgcctgtgccggtgccatggttcagatgccacccctcaacacaaaagtcttctactttccccagggccacgctgaacacgctcatgggaaggtggaatatttcgggaaaaaccatcaaacccgtgttccaccactcatcccttgcagactctctgccatgaaatacatggcagaccctgacaccgacgaggtttatgtcaaaatgagactcacccctttgagggaacatgaattattggattcacaagatgattgtttcttgggaaacacaaacagtggaggagttgagaatcaagagaagcctccaacttcttttgctaagactctcacacaatctgatgcaaacaatggtggaggcttctcagtgcctcgttactgtgctgaaaccattttcccaaggttggattattcggctgagcctcctgttcagaccatcattgccaaggatatgcatggacagctgctggaagttcaggcacatctatagagggactccaaggaggcatcttttgaccactggatggagcaattttcgtgaaccagacgaggcttgtcgctggcgactctattnngtgcttctgagggcagagaatggggatctctgctgctgggataacgcgggctaagatggggattgacggagggactgagtgaccttacggtggatggtataaccctctgtttggtggtggctccttgtgtgagagtgagaacaatgtgatgagcggcgctgatcatgagatgttcgagggaagagtggctgctgaatatgatgtcgaggctgagacta

SEQ ID NO: 1177 - DNA, 2639 bp, Glycine max
ccacgcgtccgcctttctttcactcacagagacctaaaagcacaaaaaacaaaaaccagctcgtgcttgtactttgcgcgatgaatctcctttgaagaaaacagaaacttcaaaaagcacattattttctcttttgaacacactctgttttttttgttgtttccatgaaggaaggtgaaaaggtattggatccgcagctatggcacgcgtgtgcaggtggcatggttcagatgccgcaaatgaactccaaagtcttctacttcccacagggtcacgccgaacacgcccacaccaacattcatctgaggcttccaccattcattttatgcaacgttgaagcagttaagttcatggcgaacccagaaaccgacgaagtgttcgcgaagctgagtttgcttcctctcagaaactcggaactcggtgctgactcggacggtgctggtggtgatgacgtggcagaaccttcttgttgtgaaaagcctgcgtctttcgctaagactctgactcagagcgacgccaacaatggtggggggttttcggttccgcggtactgcgcggagacaattttcccgcgtctggactacacggcggagccgccggtgcagacggtggtggcgaaagacgtgcacggcgagacctggaggttccggcacatctaccgagggacgccacgtaggcacttgctgaccacagggtggagcagtttcgtgaaccagaagaaactcgtggctggggattccgttgtgtttctgagggctgagaatggtgatttgtgtgttgggattcggagggcaaaaaagggaattagcgagggttcaggttcaggttcatcatctgtgtggagttcagcttctgggtctggaaatggaaattgtgggattgggccttatgggcctttttcttttttcttgaaagaagaaaacaaaatgttaaggaatggttgtggtgttggtgggaatttgagtggaagagtaaaagtgagggctgaggatgttgttgaagctgtgactcttgctgctagtaacaaggcttttgaggttgtgtattacccaagagccagtactcctgagttttgtgttaaggcttcttctgtgggggctgctatgaggattcagtggtgttccgggatgaggttcaagatggcctttgagactgaggatgctacaaggataagttggttcatgggaaccattgcttctgttcaggttgttgaccccatccgctggcctaattccccttggaggcttcttcaggttacttgggatgagccagatttactacaaaatgtgaagcgtgttagcccgtggctggttgagttggtatctaacattccactcattaatttcacacccttctctccaccaagaaagaagctgcggccacaacacccagacttcccccttgatgttcaatttccaataccaatgttttcaggcaaccagcttgggcctaacagccccttgtgtggtttttcggataatgctcctgcagggatacagggagccaggcatgctcaatttggaaaatctctatcagatctccaccttaacaataataaactgcagttggggatgcttccaactaatatccatcaacttggaggagtgtatactgggatttcaagtggtaacatgatgaccaaacatgataagagcaaagaaagcttatcgtgctttctgaccatggggaaatctagtaagagtttggagaaatctgatgatgttaagaaacaccagtttttgctttttggtcaaccaattctcactgagcaacaaatttctagctgttctggagatgtgttgtctcaccgaaaaagatcggtaagtgatgataaggacaaagcgaagtgccttatggatgactcgcaatctacactctcacagcagttttcaccaggaaaagcatcttctgctgagttctcttggcaacttggcttggatactggtcattgcaaagttttcttggagtcggaagatgtaggaaggaccctagacctatcgctgtttggttcttatgaagatctgtataggagacttgccatcatgtttgggattgaaaggtctgagattttgaaccatgtgctctaccatgatgcagctggtgctgctaagaaaaccggagaagaacccttcagtgacttcatgaagacagcaaaaagattgacaattctgacggattcaagcagcaaaaacattaaaagggcctttattacaggaactcgtaatggtgaacatggactagatgcatcaaacaaaacaggccctctgagcatatttgcttaaaatatgctatagatagcatctgagacattgttgagatctgagtagttgaaggacagtcctaactctatttacctctgcaaagactgaacatgagctgaatcttttatcatggttgttactattgtgtactaaaaacaatatctatcaaggttggcttagttgtttattagtgtacaaataatgatgccattatcatggtcaactgttattgtaatattaaccaagatttggaccccatttggcaacttgcttcttttcttttccttattttttcgctccctctgctctcacactcacatgctgctgcctacgtgtctccacgtcaccagtgctcaataaattgtgcaaagttggtat

SEQ ID NO: 1178 - DNA, 757 bp, Glycine max
ccacgcgtccgctttctttcactcactcactgagatctgaaataacccacgcctccgccagctcgtgctggtactttgcgtgatgaagctcgtttgaagaaaagagaaacttcaaacttcaaacttcaaaagccacattattttctccttgaacacactctgttttttttgttgttgttccaatgaaggaaggtgagaaggtattggatccgcagctatggcacgcgtgtgcaggtggcatggttcagatgccacaagtgcactcaaaagtcttctacttcccacagggtcacgccgaacacgctcacacaaccattgatctgagagttccaccgttcatcttatgcaacgtcgaagccgttaagttcatggcggacccagaaaccgaccaagtgttcgccaagctgagtttggttcctctaagaaactcggaactcggtcctgactcggactctgctgctggtgatgacgcggcggaaccttcttcttgtgaaaagcctgcgtctttcgccaagactctgactcagagcgacgccaataatggtggggggttttcggttccgcggtactgcgcggagacgattttcccgaggctcgactgcacggcggagccgccggtgcagacggttgtggcggaagacgttcacggcgagacgtggcggttccggcacatttaccgggggacgccacgtagacacttgctgacaacaggggggagcagtttcggtgaaccagaagaaactcgttgctgggggat

SEQ ID NO: 1179 - DNA, 915 bp, Glycine max
gcagtagttctagttctctttctttcactcactcactgagatggggggtaacaaaaaacagaagggggtggtgctggtactttgcgtgatgaagctcgtttgaagaaaagagaaacttcaaacttcaaacttcaaaagccacattattttctccttgaacacactctgttttttttgttggtgttccaatgaaggaaggtgagaaggtattggatccgcagctatggcacgcgtgtgcaggtggcatggttcaaatgccacaagtgcactcaaaagtcttctacttcccacagggtcacgccgaacacgctcacacaaccattgatctgcgaggattccgattccgccgctcatcctgtgctgcgtcgcagccgtgaagttcctcgccgaccccgaaaccgaccaggtcttcgccaggctgcggatggttcctctaagaaactccgagctcgactacgaagacagcgacgctaacggcgaggcggagggttcggagaagccggcgtcgttcgcgaagacgttaacccagtcagacgcgaacaacggcggcggattctccgttccgcgatactgcgcggagacgatattcccgcggctggattactcggcggagccgccggtgcagacggtgatcgcgagggacgtgcacggcgaggtgtggaagttccggcacatttaccgagggacgccacgtcggcacttgctgaccaccgggtggagcagtttcgtgaaccagaagaaactcgtggcgggggattccatcgtgtttctgcgggccgagaatggggatctttgcgtggggattcgtagggccaagagagggggagttggtgggccaaaggggccgtgcgggtggagcagttatggttctggagggcttgtgcttgagccatacggggccttttcgggtttatg

SEQ ID NO: 1180 - DNA, 2277 bp, Glycine max
ccacgcgtccgtttggcttgttcctttgaccagaaacgagggtgattttgaggatgatgcctgctggaggcatcaacggatctgaaaataaagataaatccccttcttttgccaaaaccttgacacagtctgatgccaacaatggtgggggcttatctgttcccagatattgtgctgagacaatttttcctcggttggactattccgcggaccctcccgttcagaacatccttgccaaggatgttcatggtgagacatggaaatttaggcacatttataggggcacgccgcgccggcacttgttaactaccgggtggagtagctttgtgaatcacaagaagcttgtggcgggggattcaattgtgtttttgagggcagaaaaggatgatctgcgtgttggaattcggcgggctaagagggggattggaattggtggaggacctgaggctcctgcagggtggaattcaggtggggggattcgtcctatgccttatggagggttttcagcttttttgagagaggaagatagccagctcttgagaaatgggttgagtccaaatgcaaaggggaaagtgaggcctgaagcagttattgaggctgcaactcttgctgccaatatgcagccatttgaggttgtttactatccccgggcaagtgccccagagttttgtgtgaaggccaatttagttagagccgcattgcaggttaggtggtgtcctggaatgaggttcaagatgccctttgaaacagaggactcctcgcggataagctggtttatgggaaccatctcttctgttaactttgctgatccaagatggcccaactctccttggagacttctccaggttacatgggatgaaccagagttacttcaaaatgtaaaaagggtgagcccgtggctggttgaaattgtatcaaacatgcctaccattcatctttcccattactcaacacaacaaaagaagccaagattccctcaacacccggatttttcttttgatggtcagatttcattgccagcatttcccagcaactttctaggtccaagcaatccgtttggttgtctagctgaaagtactcctgctggcatacagggagccaggcatgctaattatggtatatccctatcaaatctccacttcaataaactgcagtcaggcctatttcaagctggtttccctccacttgatcacactgcttccccagtattgagagtctcctccaacaatgcagcaacaatgcaaaaggtcggcacgggtgacaacgtctcttgcttactgtccatgtcaactgctactcaaccttcaaagaaagtggatgatgtgaaggcaccccaattggtgctttttggccaaacaattctcaccgaacagcaaatttctttgaacacctctgctaagacagatcctactcgaaataattcatttgatggaaatgctgataaaatgtgcaagttttcagatggttttggttatgctcttcacccacaaggctcttctcttgagaggttacagtggtacaaggatcaacaaaaagaaaccatggctagtttggagacaggtcactgtaaagtttttatggaatctgaagacattggtcggactatggatctcacaatgcttggatcttatgatgaattgtatagaaagctggcagacatgtttggcatagaaaaatctgtggtgctaagtcacatgctttaccgtgatacaactggggcagtcaagcacattggagatgaagcattcagcgaatttaccaaaactgcaaggaggttgaccattctaatggattccaacagcgatggtagaggaatctagaggaagaaataaacaattatcatttcaattgtacagctggttgatcaatttctctggagagtctcatctaatttatggatattaatgtttttctcgaagggcctatttggatttgttttttttcttttagtgatgatagctcgtggttttccttctctttttggatcataacatggtttacttgaggcttttgtttaataattctgatgtgaaaaaaggtgggggagagaagagaaagggtagtgatcatatatccctatgaatacgattggttcataggagtttcctgtatacaatggtttttaagtgtaaaaaaagctacctaggcttaatggttattgagacagtagttacctatttttttgttctgtgtttttaccactgtagttacctatttcattttcttgtgactttcgtatgcaaaaggaaagaaggggaaaggggggggggggtaggt

SEQ ID NO: 1181 - DNA, 3040 bp, Glycine max
attcggctcgaggaaaaaaacagaataggctctgtaactaacgtggtgaggccaggacgtaggacgtgtgtgtttgtttgttttactcaaaacgcgcgttcggagtcccgttcaacgcaatttctgttacaaaaagctttggtgttgaacgtcgtggtttgcttcaaagccaaaccaatctgtagcagctcaattatccctccacgatccgacgaaaaaagccgacacacactcataacttgtttttctggcttctcaagatacggcgtttactttttcagatccgacgaaaaaggcgagaacgaattcacaaggatcagttgtggagacagcaatttattgacaacaatttagagagatatttcaagtttgaattgatccgtcagcaaaattcgaaatcagaaactatgagcaactaggattctctttctctttcccagcggaaatataacctacaaccactctgtgaggttgctttgaattgttgtggatacatgtgatcaaatatatgatttttaatgtaagaaagaggctcataaaaatacaactaagtgaaagttgttgagtgagatgattacattcatggacacaagggagaatcaaagaggtggagagttgtttggatcctcagctatggcatgcatgtgcaggtggtattgtacaaatgccagcagtgaactctaaggtttattacttccctcagggtcatgctgagcatgcatgtggaccagttaacttcaggacttgtcctaaggttccaccttttgttccatgtagagtgactgctgtcaaatacagggctgatcctgagaccgatgaagtctatgccaaactcaagctcattcctctgaatgccaatgatgttgattatgatcgtgatgttgttggtggggctgaaactcaggacaagcctgcttcatttgcaaaaaccttgacccaatctgatgccaacaatggtgggggattttctgttcctaggtattgtgcagagacgggtttccctcgtttggactactcagttgaccctcccgttcaaaacatccttgccaaggatgttcatggagaaacatggaaattcagacacatttataggggcacgccaaggcgacatttgttgactactgggtggagtacttttgtgaatcacaagaagcttgttgctggggactcaattgtgtttttgagggcagaaaatggggatttgtgtgttgggattcgacgagcgaagaagggaatttgtggtggacttgagacttcctcagggtggaatcctgcaggaggaaattgtcatattccttatggtggattttcgcccttttttagggaggatgataatagaatctcgagaaatggcaatagcaatgggttaaaccctagtgtgagtatgatgggaaagggaaaagtcaggccagaagcagtttctgaagcttcaaatcttgcagccaataagaaacccttcgaggttgtttactaccctcgagcaagtactcccgagttttgtgtaaaggcctccctagttgaagcagcactacagattaggtggtgttctggaataaggttcaagatggcctttgaaacagaagactcctcacggataagttggtttatgggaactatatcttcggctcaggttgctgatccccttaactggcctaactcaccttggaggcttctccaggttacatgggatgaaccggatttacttcaaaacgtgagaagggtgagcccgtggctggttgaattggtgtcaaacatgcctgccattcatttttcccctttctcaccaccacggaagaaattgagattgcctcaacaaccagatttcccccttgatggccagattcctttgtcgacatttcccagcaaccttctaggtcctagtaacaccaaccaatttggttgtctacttgaaagttctcgagccgaatcggctcgagccaggcatgctcattatggtctatccttatcggatctccacctcagtaaattgcagtcaggtctatcttcggctggtttcccgcctcttgatcacgctgctacgccaatgagggtctcaaatagcatgacattgcaaaagcccagcctcagtgagaacgtctcttgcttactgtctatggcaaattctacccggtcttcaaagaaattggatgctgggaagacaccttcgctcgtgctttttggccaaaaaattctcactgagcagcagatctctcccaagtagctctggtgatacactctccccagttcttaccagaaattgttcatcagatggaaatgtcgataaagtgactaatttttctgatggttctggatcagctcttcatcaggaaggtttacgcgaacactcctcttgtgagaggttccaatggtgtaaggataaccaccaagaaactgaggctggtttggagattggtcactgtaaagtttttatggagtctgaagatgtgggtcggactatggacctctcgttgcttcggtcttatgatgaattacatagaaagttggcagacatgtttggcatagaaaaatctgaaatgttaagtcacgtgctctatcgtgattcaactggggctgtcaaacgcattagtgatgaatcattcagtgacttcacaagaacagccaaaaggttgactattctaatggattctggcagtaacaacgtaggagtgtagtgaggcaaaataaactattcttttaattgtataaatggttcatgaagtctcattttctaacctttccccctcctggtgcaatggaaggaggcagcctgatttagtttttgaatatcaaactctacataaatgtttctattccatctcaaaggggatgtttggatttttgaattttggttagagtgatcataatttgtgttttcattttttttttgtcactatctctttatttttgcctacttgagttttcttttcaaattttgttggggaaaaaggtggaggataaagagagaagtttgagatcctataaatatgattggtttgtatgcagtaaaaaaatatacagtattcaatctaaatattagttg

SEQ ID NO: 1182 - DNA, 1191 bp, Oryza sativa
cggacgcgtgggcggacgcgtgggcggacgcgtgggcggacgcgtgggcggacgcgcacgctccatttggtatatctttatcagatctccaccttaacaaactgcagtcgagtctatcgccccacggccttcaccagcttgatcacggcatgcagccgaggatcgccgctggtctaattatcggtcatccggctgctcgggatgatatctcatgcttgttgaccattggtagcccccagaacaacaagaaatcagatggcaagaaggcgccagcccagctgatgcttttcggaaaacccatactcacagagcagcagatatccttgggtgatgctgcttcggtggatgttaagaagagctcttctgatggtaatgctgaaaatacggtgaataagagtaactccgatgtttcaagcccgagaagtaatcagaatggcaccacagataatttgtcatgtggaggagttccattgtgccaagacaacaaggtacttgatgttgggctggaaacagggcactgcaaggtattcatgcagtcggaggatgtcgggcgcacacttgatctctctgttgttggttcatatgaggaattataccggcggcttgctgacatgttcggcatcgagaaagctgagctgatgagtcatgttttctaccgtgatgcggctggggcactcaagcacactggagatgaacctttcagcgagttcacgaagacggcgcgtaggctgaatatactaacagatacaagcggcgataacttagcgaggtagggtaaattaaagctattctcaattgtacagctggtggagcacggtggcaattttgaaggcaaaaattgccggtttcctagtactggtgcaatttcaaggaggcaattcagttttctttaattagagctcccagaatgggattgactgtaatccggtacccatatttatcggcagatttaccagactggatctatcctactgtcatgtaaaccgatcatattgcatttgatcgttggtgtgtactcggccatgaaccgttactaaacgaatgcgattacgggaatttttgcgcgcccatgcgttgaattgtctgaaaaaaaaaactacatctgcatgctctgtttgtagtccacaaaaaaaaaaaaaaaaaaaaaaaaaaaaaaactcgagactagttctctctctctctccctcgtgc

SEQ ID NO: 1183 - DNA, 642 bp, Oryza sativa
ggacgcagtggttcgccggcatgaggttcaagatggcattcgagacggaggactcatcaaggatcagctggttcatgggcactgtatcggccgtgcaggttgctgaccccattagatggcctaattcaccatggaggcttcttcaggtttcatgggatgaaccggacttgttacagaatgtgaagagggtgagcccatggttggttgagcttgtgtcaaacatgccggccatccaccttgctccattctcgcctccacggaagaagctttgcgtgccgttgtaccccgagcttcccatcgacggccaatttccgacaccgatgttccatggaaacccgctcgcccgtggggttggtcctatgtgctatttcccggatggcactcctgcaggcatacagggagccaggcatgctcaatttggtatatctttatcagatctccaccttaacaaactgcagtcgagtctatcgccccacgggcttcaccagcttgatcacggcatgcagccgaggatcgccgctggtctaattatcggtcatccggctgctcgggatgatatctcatgcttgttgaccattggtagcccccagaacaacaagaaatcagatgccaagaaggcgccagcccagctgatgcttttcg

SEQ ID NO: 1184 - protein, 781 aa, Oryza sativa
MITFVDSAAKERERESDKCLDPQLWHACAGGMVQMPPVSSKVYYFPQGHAEHAQGHGPVEFPGGRVPALVLCRVAGVRFMADPDTDEVFAKIRLVPVRANEQGYAGDADDGIGAAAAAAAQEEKPASFAKTLTQSDANNGGGFSVPRYCAETIFPRLDYSADPPVQTVLAKDVHGVVWKFRHIYRGTPRRHLLTTGWSTFVNQKKLVAGDSIVFMRTENGDLCVGIRRAKKGGVGGPEFLPPPPPPPPTPAAGGNYGGFSMFLRGDDDGNKMAAAARGKVRARVRPEEVVEAANLAVSGQPFEVVYYPRASTPEFCVKAGAVRAAMRTQWFAGMRFKMAFETEDSSRISWFMGTVSAVQVADPIRCLIHHGGFFRYNPVLNSLSQSALSYEGLLQLQTKCSSSIIGIQDRVHGLLLALMFWEWLLQVSWDEPDLLQNVKRVSPWLVELVSNMPAIHLAPFSPPRKKLCVPLYPELPIDGQFPTPMFHGNPLARGVGPMCYFPDGTPAGIQGARHAQFGISLSDLHLNKLQSSLSPHGLHQLDHGMQPRIAAGLIIGHPAARDDISCLLTIGSPQNNKKSDGKKAPAQLMLFGKPILTEQQISLGDAASVDVKKSSSDGNAENTVNKSNSDVSSPRSNQNGTTDNLSCGGVPLCQDNKVLDVGLETGHCKVFMQSEDVGRTLDLSVVGSYEELYRRLADMFGIEKAELMSHVFYRDAAGALKHTGDEPFSEFTKTARRLNILTDTSGDNLASWWSTVAILKAKIAGFLVLVQFQGGNSVFFN

SEQ ID NO: 1185 - protein, 730 aa, Oryza sativa
MITFVDSAAKERERESDKCLDPQLWHACAGGMVQMPPVSSKVYYFPQGHAEHAQGHGPVEFPGGRVPALVLCRVAGVRFMADPDTDEVFAKIRLVPVRANEQGYAGDADDGIGAAAAAAAQEEKPASFAKTLTQSDANNGGGFSVPRYCAETIFPRLDYSADPPVQTVLAKDVHGVVWKFRHIYRGTPRRHLLTTGWSTFVNQKKLVAGDSIVFMRTENGDLCVGIRRAKKGGVGGPEFLPPPPPPPPTPAAGGNYGGFSMFLRGDDDGNKMAAAARGKVRARVRPEEVVEAANLAVSGQPFEVVYYPRASTPEFCVKAGAVRAAMRTQWFAGMRFKMAFETEDSSRISWFMGTVSAVQVADPIRWPNSPWRLLQVSWDEPDLLQNVKRVSPWLVELVSNMPAIHLAPFSPPRKKLCVPLYPELPIDGQFPTPMFHGNPLARGVGPMCYFPDGTPAGIQGARHAQFGISLSDLHLNKLQSSLSPHGLHQLDHGMQPRIAAGLIIGHPAARDDISCLLTIGSPQNNKKSDGKKAPAQLMLFGKPILTEQQISLGDAASVDVKKSSSDGNAENTVNKSNSDVSSPRSNQNGTTDNLSCGGVPLCQDNKVLDVGLETGHCKVFMQSEDVGRTLDLSVVGSYEELYRRLADMFGIEKAELMSHVFYRDAAGALKHTGDEPFSEFTKTARRLNILTDTSGDNLASWWSTVAILKAKIAGFLVLVQFQGGNSVFFN

SEQ ID NO: 1186 - protein, 729 aa, Oryza sativa
MVISRTLVVRGFDELWETIRPVLVSSDGPASMSKNGLLLVVSEEFWIGKVWWVSGDRIWGLEMKEVGEVEEVRCLDPQLWHACAGGMVQMPAPRSRVYYFAQGHAEHADGGGGAAAAAAELGPRALPPLVLCRVEGVQFLADRDSDEVYAKIRLAPVAPGEAEFREPDELCPLGAAGDAAEPSPEKPTSFAKTLTQSDANNGGGFSVPRYCAETIFPKLDYRADPPVQTVLAKDVHGVVWKFRHIYRGTPRRHLLTTGWSTFVNQKKLVAGDSIVFLRTRHGELCVGIRRAKRMACGGMECMSGWNAPGYGGGGFSAFLKEEESKLMKGHGGGGYMKGKGKVRMADVVEAASLASSGQPFEVAYYPRASTPDFVVKAASVQAAMRIQWCSGMRFKMAFETEDSSRISWFMGTISSVQVADPNRWPNSPWRLLQVTWDEPDLLQNVKCVSPWLVELVSSIPPIHLGPFSSPRKKLRVPPHPDFPFEGHLLNPIFHGNPLGPSNSPLCCYPDTAPAGIQGARHAQFGLPLTDHQLNKLHLGLLHSGSFNRLDAITPPSRISKGFVVSSAPAHDNISCLLSISTPQVAEKSDDRKTTPHIMLFGKAIFTEQQITSSGSTETLSPGVTGNSSPNGNAHKTGNASDGSGSSICIGFSSQGHEASDLGLEAGHCKVFMESEDVGRTIDLSVFGSYEELYGRLADMFGIEKEEIINHLHFRDAAGVVKHPGEVPFR

SEQ ID NO: 1187 - DNA, 1689 bp, Zea mays
  misc_feature (1666)..(1666): n is a, c, g, or t
tttttttttgttcccaaactggcgatagataaccggccacaagtatgctgatgaaatgaataagtgttgtcaaactgtaataacagatacacgcattttaactaaatcgacagtgacaactgaattgccatgttgccatggcacttaccataacacaacaactcgaactttattccaagctaattcgtcaaagaggttattcatcaacttcgaccaagcaaaacacaactgaccacgacagagttctaacgaccaagtcacgaagcgtacaccaaggttttccacacgaccagacaagcatcgcgattctgcttcggcggcagacaaacacaaatgaaaacacacagcagttacttcgctctaagctcagtcttgcacaagtttcagattgccttgtccgaaccaccatgcaatcaagcccgctcgaccatgtattccacgagaggtttctgcagtctcccctccgtgccctctataatggtgagcctccgtgctactttcatgaagtcattgaacggctcttcaccagtatgcctgacagcaccagcagcatcacggtagcaaaggtgcctcattatttccgccttctcaattccaaacatgtccgctaactggccgtacagctcttcgtacgaaccaaagacagataggtcaatggtgcggccaacatcctctgattccataaacaccttgcagtgcccgtcttctagcccaagctcagaagccttgcggtcttgggataggccttccctcgatcctccagaatccatctgctgctcagtaaggataggctttccgaacagcattatgtggggtctctttatgtcatcagatttctctgtggcctgtggtgtgccgattgtcagcaagcaagagacactctcactggctggtgcgctgctgatcacaaaacccttggatatacggggcgtcggagtcatagcaccaagccggttgaaaccgaggtgcagctggttaagctggtagtctgttaggggtaaaccaaattgagcatgcctggctccctgtatgcctgcaggagcgatgtccgagaaacagcgaagtgggctgttgcttggaccaagtgggttgccatggaaaattggattcaacagctgaccctcaaatggaaagtctggatgttgggccacccgcaacttctttctaggtggagaaaatgtccctaggtgaatcggtggaatgcttgatacaatctccacaagccatggattgacacatttcacattctgcagcaagtctggttcatcccatgacacctgaagaagcctccacggtgaatttggccatctgattgggtcagcaacctgagcagaagctatcgtccccataaaccagctgatccttgacgaatcctctgtctcaaacgccatcttgaacctcatcccagggcaccactggttcctcatcgcgttctgtaccgatgcagccttcacaacaaactctggagtgctagctctcgggtagtacaccacctcaaatggctgcccgctcgcggctaagcttgcggcctcaacaacgtccgtgatctccaccttccccctgcctctcatgtacccaccaggacccttagtgatctccccggccgcgcccctcgggtaccccgacaaggccccgtacaccggggcgttccagccagagatgcacnccggacgctgggcggacgctggg

SEQ ID NO: 1188 - DNA, 1744 bp, Zea mays
acgagggggaaggccgccagggtgtgggtgcggccagaggaggtcgtcgaggcgcgctaacctggccgtgagcgggcagccgttcgaggtggtgtactacccgagggcgagcacgccagagttctgcgtcaaggcggggggggtgcgcgccgccatgcgcacccagtggtgccccgggatgaggttcaagatggccttcgagacggaggactcgtcccggatcagctggttcatgggcactgtctccgccgtgcacgtcgctgaccccatccgatggcccaattcaccctggaggcttctccaggtcgcctgggatgagccggacctgttacagaacgtgaagagggtgagcccatggctggttgagctggtgtcgaacatgccggtcatccatcacctcacagccacgcccttctcgccgcccaggaagaagctgtgcgtcccactgtacccggagcttccgctggagggccagttcccggcgccgatgttccacggaagccccctcctcggccgtggcggcgccggtggcccgatgtgctacttcccggacggcactcctgcaggcatacagggagccaggcatgctcaattcggcatatccttatcagatctccacctgaacaagctgcagccgggcctgtcaccgcacgggctccaccgccagctcgaccacggcgtgcaggtgcaggtgcagcagccgaggatcgccgccgggctcatcgtcggcggccacccggcggcccgagacgacgtctcgtgtctgctcaccatcggcaccccaaagagcaagaagccaccgtcagacgtcaagaaggcggcggcggcggcggcggcggcaccgcagctgatgctcttcgggaaagcgatcctcaccgagcagcagatatcgctaggcggcggcaatgtcgtgccggcgctgctggcgaagaagagcccctccgacgacgacgacgacgtggccgagaggacggtgagcaactcggacgtgtcgagccctgggaggagcaaccaggacggcacgtccagtggcggaggcccggcgggcgcgggcgtgctggcaggaggaggagtgcaacaacagggcggcaggttctgaggacgacctcctcgggcactgcaaggtgttcatgcagtcggaggacgtcgggcgcacgctggacctctccgccgtcgcgtcgtacgaggagctctaccagaggctcgccgacatgttcggcgtcgacaaggccgagctgaccagccacgtgttctaccgcgacgacgcttccggagcgctcaagcaccctggcgacgagccctttcagtgagttcaccaagaccgccccggaggctgaccatactgacggacgagagcagcgacagcttagcgaggtagagtccagtctcaaggagacggcggttcggcagtttcggttgggagtgggaggcgccccggaacgggagcgcgtgcgtgcgtctgatccaggaccaaagatttgtcggactagtagctctacagtagtggagtacgtacgtacaccttgatgctgctgcttctgctgtcagttcaagtggccataaccataatgcagctgcctttggtcacagtgactgatcggatgtgttgtgtacatcggaccgttgatttgcgaacgcgattactgaaagattattattatttttttgtatttttgatataactaaggtgctttggttagttggttggtttgtctgggatgctcaagtattctctgttctcgcg

SEQ ID NO: 1189 - DNA, 1744 bp, Zea mays; identical to SEQ ID NO: 1188

SEQ ID NO: 1190 - DNA, 1144 bp, Zea mays
aaggggcgggcggggccatcatcttgccgccgtcctcttcccctcgcaggaacatggagaacccggcgtacccgccgccctgcggcgggggcggctgctggtggtggtggtgcatgaactccggccctccgatgccgcccttcttggcgcgccggatgccgacgcagaggtccccgttctccgtccgcatgaacacgatggagtcccccgcgacgagcttcttctggttcacgaaggtgctccagccggtggtgagcaagtggcgccggggcgtgccgcggtagatgtggcggaacttccagaccacgccgtgcacgtccttggcgagcaccgtctgcaccggcgggtcggcccggtagtcgagcttggggaagatggtctcggcgcagtagcgcggcacggagaagccccctccgttgttggcgtcggactgcgtcagcgtcttggcgaaggaggacagcttctcccgggcgtccgcggggtcgacgccgaactcgccgggcgctctcggaactccacctcgccgggcgcgaccggcaccaggcggatcttggcgaagacctcgtcggtctccggatcggccaggaagcgcaccccggtgacgctgcagagcacgagcgacgggagcgctcgcgccccggcgaggtccgcggccccgccgccatgcgcgtgctccgcgtgaccctgcgggaagtagtagacacgggagcgcacgggcggcatctgcaccatgccgccagcgcacgcgtgccacagctgcgggtcaaggcacctttcctcggccacctccttcatggcctactcctcctcctcttcgtcgtcttcctccaccgctaccaaatgcggtcactgtccagcagagcaacctcctccgtgaacgcccatgtgttccaactggcagatcatggggcggcggaaccgctactccgggagagacgttggcaccgggcaaagcagagcagaaacctacatcagggccggcatcggccgaggcaacgattctctccgagaacaccccaagcctgcttcggttgctcgagcccaggagacgaaatctagacggcggcgaggtggggagaagttgacggtggtggcgcgcgctgctacagcggcacacactgtgggttggttttaacccggccgg

SEQ ID NO: 1191 - DNA, 821 bp, Zea mays
gcggccgcggccatcatcttgccgccgtcctcttcccctcgcaggaacatggagaacccggcgtacccgccgccctgcggcgggggcggctgctggtggtggtggtgcatgaactccgcccctccgatgccgcccttcttggcgcgccggctgccgacgcagaggtccccgttctccgtccgcatgaacacgatggtagtcccccgcgacgagcttcttctggttcacgaaggtgctccagccggtggtgagcaggtggcgccggggcgtgccgcggtagatgtggcggatcttccagaccacgccgtgcacgtccttggcgagcacggtctgcacgggggggtcggccgagtagtcgagccgcgggaagatggtctcggcgcagtagcgcggcacggagaagcccccgccgttgttggcgtcggactgcgtgagcgtcttggcgaaggacgcgggcttgtcctcctgcgcgcccgacgccgccgcggcgccaatggcgtcgtcggcgtagcccggctcgttgggacggaccggggccaggcggatcttggcgaagacctcgtcggtgtccggatcggccatgaagcggacggcggcgacgcggcagaggacgagcgcggggacccggccggcggggaggtcccacggggccctgcgcgtgctccgcgtggccctgcggcgagtagtacaccttggagtgcaccgccggcatctggaccatcccgccggcgcaggcgtgccacagctgcgggtccaggcacctgtcactctcccgctcccgctccatggccgccgagtccacgaaagcctcgtgccgaatt

SEQ ID NO: 1192 - DNA, 1198 bp, Glycine max
acgctaaaggacctcttcccattccgacaaacaaaacaagaccacactaataatatatatttttcatatacacatgacatgagcgctcgctgtaagtagtaacctaagaaaggaagacagtatcaactaattaaacggtcagaacctcccaaatcaactcggggtcgaaggaaggcaatctagccagagaacaaccttcgaacaacaactctgtttcctctgtttgacactccgtcaaaaccgaggccggcgaatgcgaattctcccccttccaaaacccatcctccgaaacggccggagaaaacaactggttcgcccaattatcgttaaaaatcgacggcgacggcgacggcgacggcgacggcgacggcgaggacgaggaggagggcttctcactctggccgcgtttagggtcagtgctattgtgaagcttcttggcggcattctttttggctctctcccttttgaccttctggcatatggcttgaattttggcgtcgacggaggacttcaaggcgttcaatctggcggagtcaccgaaacctagcttggtggggtccttgagattggggaagttcaaacgcgcgtactctccacggagcttgtacgcggcgcggtcgtaggcgtaggcagcagcttcggcggtgtcgtaggttcccaaccacactctcatcctgttctgtgggagtctaatttccgccacccatttgccccagtgcctctgcctcactcccctgtacagctttttcttgcaagggttcgtcaacgaattactcaaggaggaagtgggaacattataagacccatttcctcggctttcttggtagaacttttggaggatgtccctttggcggaggtacacggaagaccccaaaggctcacaccccgaggaccgaatgggttctaaatcatctaacacggagttgctactagtgctgccatttgttgtttgtgggcaattggagaaaattgagtcaagggtgtttgtgccactgccacttgctaatatgagctttgacaaagaggacccaatattagtaccctcttggtcttggatttcaagctgtgactttgtgtctcgcattccctccatgatttctttaggcaaaaactttccggtgtacttctcaccgaaaataactggttcctcttccctgctgtataggaaacaaaaatagtagtttttgtcggacgcgtg

SEQ ID NO: 1193 - DNA, 800 bp, Glycine max
ggccagaacctcccaaatcaactcgggatcgaaggaaggcaatctagccagagaacaaccttcgaacaactcctctgtttccattgattgacactccgtcgaaaccgaggccggcgagaacaaatcgttcgcccaattatcgtaaaaaatcgaaggtggcgacaacggctgcgacagcgatgacgaagagcaagaagaggagttgatcttctgcccgccattagggtcagtgctgcccgaactatcatgaagcttcttcttggtggcattctttttgggctctctcctttttgaccttctggcatagggctggaattttgccgtctacggaggacttcagggcgttcattctcgcagagtcaccgaatcccagcttggtggggtccttgagattgggaaagttcaagcgcgcgtactctccacggagcttataggcggcgcggtcgtaggcgtaggcagcagcttcgccggtgtcgtaggttcccaaccacactctcatcctgttctgagggagtctaatttccgccacccattttccccagtgcctctgcctcactcccctgtacagctttttcttacaaggcttcgtcaacgaataacaactcaacgaagaactcctgcaaacagagtttatagacgtatttgccaaggatctgggaatattataagacccgttattgttcccatttcctcggctttcttggtagaatttttggaggatgtccctttggcggaggtacacggaagagcctaaagactcacaccccgaagacctaaagggttctaaatcatctaacacg

SEQ ID NO: 1194 - protein, 273 aa, Oryza sativa
MDASLRTLPPAIFPGEVRSAVSSLLLSPGGSALDTVFSHLPPPVTIPPLGSSVYYRQSELLRHFAASQAAQAQSATAAASSSSAAAAGLDDGAPRKLYRGVRQRQWGKWVAEIRLPQNRVRVWLGTYDSPETAAHAYDRAAFKLRGEYARLNFPGVMDGRDCPDNLRQLRDAVDAKIQAIRVRMARKRARARRQREESKKSQRAEDAKAATPSRPVASERAASETTTTTTTTSSSYGSPDGVLSMSAASVDGDCPLERMPSFDPELIWEMLNF

SEQ ID NO: 1195 - protein, 299 aa, Oryza sativa
MAFSEPPKPASQPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPQYAAAAAAPSSVQYGGGVGAAPHIGSYGHHHHHHHHHGHGAASGASSVGECSTMPVMVPVDPHRSSMSSSLLDMDRNGHDFLFSGADDNSGYLSSVVPESCLRPRGGGAAADHQDMRRYSDADAYGMMGLREDVDDLAQMVAGFWGGGDAADQLGACGFPASGGAADMVASSQGSDSYSPFSFLSH

SEQ ID NO: 1196 - DNA, 445 bp, Zea mays
gcgaaaaaaacagaaaaaaacaaaaattaaaaattaaaaaaaaaaaaaaaaagggcgtggtctcgggatctagaaccgagcctcaagcgggcaggccacccagcactcaggctagatagctcatcacagccacagcagctagaccctagtagctcactcgcgctcgtgccatgatgaatacccgagcctgtggcagcggcagtggcggcaggaacgaccagaccatgatgggcttctccgagcatccgaagccggcggcgtcggggcaggcgcagccgtccccgccgtcgtcgccgagcgagcgtccgccagcaggccgcgggcgccggcgcgcgcaggagcccgggcggttcctcggcgtgcggcgccggccgtggggccggtacgcggcggagatacgcgaccccacgaccaaggagcggcattggctgggcacgttcgacac

SEQ ID NO: 1197 - protein, 375 aa, Oryza sativa
MAFGQDTIEQLYRELAGGRRLSAKLQALLEGPLDSRGQKEAVDVSRELGRVFMVSLYMLKPCSNSSRRPEGVTRTAPETRTDDSICLHTPARVKRVRSEEVLVRNGREEVVTRTEIITPSPYKDGYQWRKYGQKNIQDSNYLRLYFKCTFSRERSCAAKKQVQQRDAGEPPMFLVTYLNEHTCQQPQAVPGTPNTAGSSPTTTSRQRQSSSSPPAEMLDLTMNGAGLFSRLLLPHAVGGGGSAAEEEAAIVTCLAAVISGGGAAAAPPPLIWPTSAPEAAFVASAAGHSPSAADESVADEAAAAQMADMDYCFGQYDQSTFGAAAAADHRVLIGDDGDVQRIVAARIADTVWPRYTRDTSAWETAGTSSMRGSID

SEQ ID NO: 1198 - protein, 375 aa, Oryza sativa
MAFGQDTIEQLYRELAGGRRLSAKLQALLEGPLDSRGQKEAVDVSRELGRVFMVSLYMLKPCSNSSRRPEGVTRTAPETRTDDSICLHTPARVKRVRSEEVLVRNGREEVVTRTEIITPSPYKDGYQWRKYGQKNIQDSNYLRLYFKCTFSRERSCAAKKQVQQRDAGEPPMFLVTYLNEHTCQQPQAVPGTPNTAGSSPTTTSRQRQSSSSPPAEMLDLTMNGAGLFSRLLLPHAVGGGGSAAEEEAAIVTCLAAVISGGGAAAAPPPLIWPTSAPEAAFVAFAAGHSASAADESVADEAAAAQIADMDYCFGQYDQSTFGAAAAADHRVLIGDDGDVQRIVAARIADTVCPRYTRDTSAWETAGTSSMRGSID

SEQ ID NO: 1199 - DNA, 939 bp, Zea mays
gaccctgggctgccggcccgccccgagctttcccatctttccttcttcacctttcgaagagtgccccccttcgtttgtcgacgcgctccgactccatgccgctgtcgccgccgccgccctcctccagcccgaggcaagcagcgatccaggagctcaggaggggtacccagctggcggagctgctcaggcagcaggtagagctcatcccggagcctaaccgccgccacgctgcagcggtcaacgtgggcgagatatccatggctatggagtcgtcgctctccatcctccagtctcagatggagcaccccttctctgagcctgaggtcatggcggctgcgctcactgcccactccgacggaggcaccagcggggaaagaaatggcggtcccgtggcccgtacaaggaaggtgagggtgcggcaccggccaggcagaggcaggcctgcagctggagatgaactgccgatcaaggagatactgactgaggcaccagaaaatgatcgtttccactggaggaaatatggtgagaagaatatcctctattctgaatatccaaggttatactacaagtgcgggtacagcgacgaccacaagtgcccagcgaagaaatacgtgcagcagcaaagcaacagctaccctccgattttcttggtcaccctgatcaacgagcacacgtgcgacgccttgttccgagacgacgagcccatcatcagctcaagcagcagtggctcgtcgcaggtcctcgacttcacgaaggcgtcgctttcttctcctctccattgatgttggcggcggcgcggctgcaggggttgggtgaagaaatagagatgcatggaagaagacagatattcgtgttcggatgatgagtagtactagctagctaagctagtcgtcttcaattcgttgcccacgatgatgtcggcggcagatcgatggagct

SEQ ID NO: 1200 - DNA, 598 bp, Oryza sativa
ggaacgtgccttcgcggtagacttcgcagggcatctcgggggctgcatctggccgccgaggtcctactcctgcagcttctgcggccgtgagttccggtcggcgcaggcgctgggcgggcacatgaacgtccaccggagggaccgggcaaggctcaagctctctggggttgtggaggacggcaccggccgcgaaagccacggtatgccgccaaaccaaaactacatgatacaaccatgccctccccaaattggcaccctgcagcacgcctacagtccaaaccctagaagtggcagtattctcgctgctgacactaaccctaattccatatgtgatgttgtcgcgtaccctgctagatccttgcttcaagttgcagctgctagaactgccttgggcaaacaagtcctgaacgcccctcttgtctcatcgaagtcgacgtcggctggtagagaacatggtaagagggagacgttgtttcttggtgctgttcgattggcacaggatcatgacacggtgagctctaatcttgacctgcgtgttgggaaaaatgaattgaaaatagctactgttttggggtgccgatcaagaacggactttatg

SEQ ID NO: 1201 - DNA, 1693 bp, Glycine max
cctttttttttttttttttttagttcttaagctattcattgtcacttaaaggagagctcttacattatacccttagaaagctattcatgttagatcgattcagggaatacatatataaactcaaaaaactgaagggaaaatttaaggtttacctatataattgaaaaaaataaaaggaaatccaaacatgcattcacaaacaaaatgattattcaaacccgtggtaaccgtggaatatcttgtaactgaagaatctttctcacagtcttcatgatccatgcaaattgcgagaggagaattgagacatactttgtattttgtgtatcagttggaagggaaatcttggtctttgtgggaggggcttttgctgctgttgggtgaatgaagaggtttatgagtcatcatagccaagctgaaagaatgattgagataattcgccaatggattttgagaacctgaactcaacatctgatagtggttgatttgtctcggatccatgtccattgctgtaacatgtgaagggaaatatggttgcgttgctcctggaggacatagcataatttgagaattcccagttgataaagacaatgatgatgttgggaaaggtacaacgttaatattgttgtgtatatctgttaggtttgataattcattgttgcccaacggatgagaaacatcaccagcagaatgttcccatcggtaaccatgtggcatagtattcagcaagcccaagaatgaaggatgattaagatttgctcttggtaagagattaatatttggtataacacgtgtgctaggaccttcattattgcttccttgcttatcctcttcacttctacttatccaatttggtttatcagtgctaatcatttctcgtgaaacttctttaggctttaatttccatgtagaattctggtttgaaccttcccactgaatgcttctgttgatattaagaagttgctcattaggctgagaatttgaggtggtagcttcattagaggtaacagcagatggatgaccaagggtgaagttattcactgaaggaacaacaggaagtggtggaagttcatcaatttcatgcttagctgcatcgagcaaccaatcaacaaccttgctaggttgactgagccctagcctatcttgaagatcatagagttggatggcagttggtactgatagcctcacccgtctgtctcttaaccctcttattgtgaaaaccttgctgtgcctgtcttttcctccaaaggctctagatactcgcacaatccttggatctttcaatcttggccattgtgctactgagctcgctgaagcctttgccttttcaggatcagtaattgattgagaatgaccctcctgttttaatggaaaatctgcttctttggggctcttaatcatgatcttatgtctctcattgttggttgctaggtgctgagttttgtccttccactttgtgattgtcaaaattctgttccacggtaccatcaacaaggaaactgctaaattttaagttcattgtttggatttactggttgtctctcgatcctaagaatcactttggatactaaacaccccaaggtagaaggaggaagtttgcactgtgcttttgcataccaagatagaacaaaatttaaagagcttgacttggctctgattgcacctaataaacttagtgtagaagctcgagccgaat

SEQ ID NO: 1202 - protein, 307 aa, Oryza sativa
MILGSNQAAAAAAAAAAAEEEAAELARKHTAAVATSRQWSAQTESRIVRVSRVFGGKDRHSKVKTVKGLRDRRVRLSVPTAIQLYDLQDRLGLNQPSKVVDWLLNAARHEIDKLPPLQFPPQDHLCMGHHHHLPSAMPLMHHHGHHHHADDDKYHVAAAAAALAAEKEAAAAGGGGGGGGDDVDGGGGGGAAHIVGRFPAGGYHRFMGLNNPLGMVNSAAGAAMPFHYAGESWNNGSVQDSGAGSPQVAAAAAHHTSPFPSLLSLAPGPHHQLVFYSSEAEQFTVDNLGSQGLSLSSARAFHDQTGS

SEQ ID NO: 1203 - DNA, 423 bp, Oryza sativa
  misc_feature (413)..(413): n is a, c, g, or t
gccgccgcgacgtggtacttatcgtcgtcggcgtggtggtggtggccgtggtggtgcatcagcggcatggccgacggcaggtggtggtggtgtcccatgcagaggtggtcctgcggcgggaactgcagcggcggcagcttgtcgatctcgtggcgcgccgcgttgagcagccagtccaccaccttgctgggctggttgagccccagccggtcctgcaggtcgtacagctggatcgccgtcggcaccgacagccgcacccgccggtcgcgcagccccttcaccgtcttcaccttgctgtgccggtccttgccgccgaacacccgcgacacgcgcacgatccgcgactccgtctgcgccgaccattgccgcgacgtcgccaccgccgccgtgtgcttcctcgctagctccgccgnctcctcctcc

SEQ ID NO: 1204 - DNA, 853 bp, Zea mays
  misc_feature (776)..(776): n is a, c, g, or t
  misc_feature (800)..(800): n is a, c, g, or t
  misc_feature (842)..(842): n is a, c, g, or t
cctcgaggccggcccgccagctgttccatcgtcccgtttgattctcagctgttgcaggagccatggtcgaagctatttgatctatctctgagctgagctgagctgggccggcaatttgatgatgcttgtgtgtgtgatcatgagtggataataagagatgataagcggcaacctcaccaatgaagacctgggggccgggcgcacgcgcaccaaggccgaggggccgacgaccgcggccgtggccggcgccgtcgtcgcaaagagtcccgtgctgccgagctcccggcaatggccgccgtcaacggagtccaggatcgtgcgcgtgtcgcgggtcttcggcggcaaggaccggcacagcaaggtgaggacggtcaaggggctgcgcgaccggcgcgtgcggctgtccgtgccgacggcgatacagctctacgagctccaggaccggctgggcctcagccagccgagcaaggtggtggactggctgctcgacgccgcgcagcacgagatcgacaagctgcctccgcttcagttcccaccgcaggcagcgcaggacctcgtcgcccatctgccgccgccatccatggtggcgcccttcgcagccgaccgggccgaggccgacggcgacaaacgccactgccacgccggcgtcaaagggctcatgggcctcaacaattccatccgcctcgtcaacgccaccatgccgctggctcacggcttgtactacacgcccggcgagtcttggaccggtaccaatgccgatgatgccgccgccctgnatccatcagacggtggctcacggncactcgccctcctcatctctgctgtctctttgctgctccggngcctcagctcg

SEQ ID NO: 1205 - DNA, 887 bp, Zea mays
ggagagtgaagcaagacggggagcggccgggagcagtgcatggtgtggtggtggtggtaaaaggacggggattggacagcgacgctgatcatttatgccgccgtgtaaatacccaccacaagcagctagcttcgcaggtcggcttccacatctctctcattctcgtctcccccccctgctagctgctgcagctctcaagctagctggcagctagggtttacaccgatccggggtccggtcgccgccggccggcggaagcgggcaatcgagctccgcgacgtcgagatctgcttaattgctaggtggtcgccgcgccggcagccccggcacagagaaagtcaattgctctttgcaggggttgctgctcgttttaaaagagatcctttgcagtggatgatacaccgacacgcagctagccagcagggacaccgcgagatggcgggcgccgtcgggctaacaagacgatgataaggggcggcaaccaccagcaggcggcggacgtcgaggaggagctagcccggaacagcaggcacgccgccgccgtggcgacgtcgcggcaatggtcggcgcagacggagtcgcgcatcgtgcgcgtctcccgcgtcttcggcggcaaggaccgccacagcaaggtgaagaccgtcaagggcctgcgcgaccggcgggtgcgcctctccgtgccgacggcgatccagctctacgacctgcaggaccgcctcggcctcaaccagcctagcaaggtcgtcgactggctgctcaacgccgcgcgccacgagatcgacaagctgccgccgctgcagttcccgccgcaggacctcatggttggtcacctgacgccccacaacatgccgctgatggtgcacgacgagaagtccggacccctcccc

SEQ ID NO: 1206 - DNA, 523 bp, Zea mays
gcgccacgcctccgctctcattctcgtctgcggcccactgttagctgctgccgctctctagctagctggcagctagggtttacaccgatccggggtccggtcgccgccggccggcggaagcgggcaatcgagctccgcgacgtcgagatctgcttaattgctaggtggtcgccgcgccggcagccccggcacagagaaagtcaattgctctttgcaggggttgctgctcgttttaaaagagatcctctagccagcagggacaccgcgagatggcgggcgccgtcgggctaacaagacgatgataaggggcggcaaccaccagcaggcggcggacgtcgaggaggagctagcccggaacagcaggcacgccgccgccgtggcgacgtcgcggcaatggtcggcgcagacggagtcgcgcatcgtgcgcgtctcccgcgtcttcggcggcaaggaccgccacagcaaggtgaagaccgtcaagggcctgcgcgaccggcgggtgcgcctctccgtgccgacggcg

SEQ ID NO: 1207 - DNA, 1586 bp, Zea mays
gcccttttttttttttttttttttcctcgaaatattggtatggattgatcgagtatatatgaaaacaaagtcttttttggttcgctttctagctaagcacaaattcaagaacgaattataaaattgttattacattgccaacacacacacacaccacacaccccatgaccggttacttccttgtataaaaaagaagcaacgaattgcattgcatgtcctgcaaaattaaccttaattactatgcatgctagcagctctctacgctagagcccctctactcgatcataccaaacaataacatctcaaaactgcagttgcaagctttacggagccttcaaacgagtacttgattactactacaccaagctttattgttctacgtaccttcttggagcagtagagatcagtgacctaatatcatccctggttgccggggtgaaggaagcttctagctgagctcagtgagagctggccttgcgagtgatcgaggctatctacagcgaactgatgatcggtggcttctttcatggcgaagccgccgccttccggcgagtagaagacgagctggggccccggagcagcaagagacagcagagacgagaacggcgagtggtgagccaccgtctgaggcgaggtgccgccgtggctcacctgatgatcatggacggcggcattgccgccattggtccaagactcaccgggcgtgtagtacaagccgtgagccagcggcatggtggcgttggcgaggccgatagaattgttgaggcccatgcccatgagccctttgatgcctccgtggcagtggcgtttgccgccttcggccatcgcggccgacgcgttcgcggcggcagcggcggcggcggcccggtcggctgcaacgttggcgaagggcgccaccatggacggcgggagatgggcgacgaggtcctgcccttgcggcgggaactggagcggaggcagcttgtcgatcctcgtcctgcgcggcgtcgagcagccagtccaccaccttgctcggctggctgaggcccagccggtcctggaggtcgtagagctggatcgccgtcggcacggacagccgcacgcgccggtcgcgcagccccttgaccgtcctcaccttgctgtgccggtccttgccgccgaagacccgcgacacgcgcacgatcctcgactccgtcgacggcggccagtgccgggagctcgacagcacgggactctttgcgacgacggcgccggcgccgccggccgcgcccggcccctcggccttggtgcacccgccgccccccagctcttcattgttgaggttgccgcttatcatctcttattctgctagccaccgatcatgatgacacaaacatcatcaaattataggtggcgacacacttcgtccttcccgggccaccagccggctcagctcagatcagatcgagagagatcaaatatattcgaccatggccgcggctctggccgaatcaaacgccggggatgttagtggctcctcccgccgccggccggcgcgcgcggcgctgatataagcgagagctcgaagccgcacgcccgaattcgtccggctagctccggacgcgtgg

SEQ ID NO: 1208 - protein, 215 aa, Oryza sativa
MHDPRGFPIHPQPYHLHPTAGGLGEGRMRGGGRRRPGAKLSTDPQSVAARERRHRISDRFRVLRSLVPGGSKMDTVSMLEQAIHYVKFLKAQVTLHQAALVQHEEGCQHADVAAAFSAADADLALELNHRHGGAGDDDAGMTTLEMAPMQEAVGYGDGPAHQMMQQALDPAGQLMMGGAHQLPPLPCCVFVQETDPSCYSVCNVHGEESGAQGSY

SEQ ID NO: 1209 - DNA, 1533 bp, Glycine max
ccacgcgtccgacggctgcgagaagacgacagaagggggttcttttcatgcatgtgttgaatgcacatgctggtctccggtccggttagggcatttctgggaccttaaatcaccaatttctcacccaatcaattccaattaagctgagagtgtttctgatctatatgtgatgggtgctccgaagcagaaatggactgcagaagaggaacaagcacttaaagccggagttgtcaagcatggtgttggtaaatggcgcaccatactgaaggatccagagtttagtagtgtcttgtacctgcggtcaaatgtggatctcaaggataaatggagaaatctgagtgtgatggcaaatggatggagctctagggaaaaatctaggttatcagtcagaagggtgcatcaggtcccgagacaggatgagaactctatggctatcactgctgttgctccaagtgatgaagaaattgttgatgttaagcctcttcaagtttctagagatatggtgcatattcctggtccaaagaggtctaatttaagtttggataaacttataatggaagcgatcacttgcttgaaggagaatggtggttctaataagacagctattgcagctttcatagaggaccaatattgggcactgccaggcttaaaaataaatcgcaagtatagaattgcacctatagcagcatattctgacagaagaagaaactcatccgtgttatatttggaagggaggcagaaagcctctatgaaaattgacagggatgagaccaacatccttactagatctcagatagatttagagttagaaaagataaggtctatgactccacaagaggcagctgcatttgctgctcgagcagttgctgaagcagaagccgccattgcagaagcagaggaggcagcaaaggaagcagaggcagcagaagctgatgcggaggctgcacaagcttttgcagatgctacaacaaaatcagcgaaagggagaaaatccccaaagaggatccatgcttgatggaagtttgaagaattagactcgaggagagatgaacggtggaattgagtaggacagccagccagctaaatatcatttgctggtatagtctatagttttgcaatattggaggctcttgtgactatgcaagtttcacctttattaggatatatttttggatattgaaatatccttcttgtagatagaaccattgtttgaatctttattgtaatttctttatagctgttgttaccttagcgctctgtccatgtacttgttgtttatagaaagtagatgtttagatgaatgggaattcgttcaaatttcttctgaaaaaaaaaaaaaaaaaagcgcccgccccgcccgccccctctctccctcgggccgaattcgcacgagggagagagaacgcggccctctaattgtgtctcagtgctcttaaatggcttagttctaatgcaattcccaccctcattccacaacccattctcaaaatgagatggagcaaatgtccctaagaaaccctgtccccatttaga

SEQ ID NO: 1210 - DNA, 1311 bp, Glycine max
  misc_feature (1301)..(1301): n is a, c, g, or t
ggccggaattcccggctcgacccgcgcggcccatttggcgcgggatgcaaacaaatctgggaccttaaatcaccaatccaatcccaatcaattcattttcctccaattccaattaagctgagagtgtttttgatctacacgcgatgggtgctccgaagcagaaatggactgcagaagaggaacaagcacttaaagctggagttgtcaagcacggtgttggtaaatggcgcaccatactgaaggatccagagtttagtggtgtcttatacctgcggtcaaatgtggatctcaaggataaatggagaaatctgagcgtgatggcaaatggatggagctctagggaaaaatctaggttatcagtcagaagggtgcatcaggtcccgagacaggatgagaactccatggctatcactcctgttgttccaagtgacgaagagattgttgatgttaagcctcttcaagtttctagagatatggtgcatattcctggtccaaagaggtctaatttaagtttggataagcttataatggaagcgatcacttgcttgaaggagaatggtggttctaataagacagctattgcagctttcatagaggaccaatattgggcactgccaggcttaaaaagtatgttgtctgcaaaattaaagtttttgacagcaagtggaaaactgatcaaggtaaatcgcaagtatagaattgcacctatagcagcatattctgacagaagaagaaactcatccgtgttatatttggaagggaggcagaaagcctctatgaaaattgacagggatgagaccaacatccttactagatctcagatagatttagagttagaaaagataaggtctatgactccacaagaggcagctgcatttgctgctcgagcagttgctgaagcagaagccgccattgcagaagcagaggaggcagcaaaggaagcagaggcagcagaagctgatgcggaggctgcacaagcttttgcagatgctacaacaaaatcagcgaaagggagaaaatccccaaagaggatccatgcttgatggaagtttgaagaattagactcgaggagagatgaacggtggaattgagtaggacagccagccagctaaatatcatttgctggtatagtctatagtttgcaatattggaggctcttgtgactatgcaagtttcacctttattaggatatatttttggatattgaaatatccttcttgtagatagaaccattgtttgaatctttattgtaatttctttatagctgttgttaccttagcgctctgtccatgtacttgttntttatagaaa

SEQ ID NO: 1211 - DNA, 1537 bp, Glycine max
attcggctcgagatagaactcgtttcatatgtctcattcttctctggttttgttttttggcaaaatcattcggattaattcaatttctctgtgtaaatactttaacgtttccaattctcaccttcgcccagtgatttgtagtcagcttttttcttgttcaaagatgcactagtagaagagggaattaccaagtttccaagctttcctttagagtagaagcaaagaggtaaagtgtcataaaaagctgtaggcttccttcaatgggtgctcctaagcagaaatggactgcggaagaagaagcggcactgaaagctggtgtactcaagcatggggcaggaaaatggcgcaccatacttacagatcctgagttcagtgccattttgcatatgcgttcgaatgtagatcttaaggataaatggaggaatataaacgtgacagcgatatggggatcccggcagaaggcaaagcttgctcttaaaaggaacctgccagcccccaaaattgacaataaccatatggccttgagtaccgtagttcgacatgatgaagttcttgatactaaacccttggcagtttctggtggaccattgcaatctaccaatttgaaagaacaaatatctaggttggtggataatcatatattagaggcaattgtctacatgaaggagcagaagggttctgacaaggctgccattgcttctttcatagaggaaaaatatcgctctccacctaatctcagtaaactgctgccagccaaactgaagcatatggtggcaagtggcaaaatagtcaaggaaaagcataagtacaggattgcgccaagttcaactgtctctgagaaaagaagatgctcttcattggtacttttggaagagaagcccaaagatccttcagaagtacataagaatgatgatgtcaacatcctttcaaaatcccaaattgatgcagagatttcgaaagtgaagggcttgacagctcaagaggcagctgctgcagctgcaaaagcagttgcagaggcagaggctgcaattgcacaggctgaggcagcagctagggaggctgaggctgcagaagctgaggctgaggctgctcaagtgtttgcaaaagcagcaatgaaggcgctaaaatgcaaaatgcttcatatttgatggtgtggacttacacatgctcatcatcagcagagttggcttgagatgatagttctgctgctgtgcttcctgccagtttttttcgtaactgtacataattttcggcttgtaaatctggaatatgcaggatgattcatgaaatattctgtcaggaatcaataacagcttttttttttcaattcatttttattttaaccttttcttataaaggaagacaatgaggggaaagctacaaagcagtaacggaagagtggaaatagcgatgtttttttgtaatggaataattgacatccgcgtagagtaaatgaaggaaacaatttttagtgttcaaatagcaatatggattgtcattgacatgcagatcatatattcaaggatgcttgttcgac

SEQ ID NO: 1212 - DNA, 2059 bp, Glycine max
gaaaaacagcattaacacaaataaactagaaaacatttttttttctcgttattctccggttcctcgcaggcaccaattccacatatctgcgtgtaaatactccaacttgtcccaattcacacctttgcctcgcgattctccgatgcgttacacctttgtccaccgattcctctttaattttcttccctttttcccccaattcaactaaattttctgctatctatattcccaggtaagtaaagtcagatttttcttggtggacggacatgcagaagaaggctgcactcaacttccaagctttcctctagaacaaaagcaaagattatactgtcataaaaaggttttgtacttattttaatgggtgctcctaagcagaaatggaccgcagaggaagaagcagcattgaaagctggagtagtcaaacacggggctggaaaatggcgcaccatacttacagacccagagttcagttccattttgcgcatgcgttcaaatgtagatctcaaggacaaatggaggaacataaatgtgacagcaatatggggatcgaggcagaaagcaaagctagctcttaaaaagaacctactaccatccaccaaaattgacaataaccacttggccttgagtactgtagttcaacgtgacaaagaagttgcaaatcccaagcctttggcagtttctagtgggacatctcctaattcaaaggaaaaaatatcgaagctacagaacttccagttggataatcttatattagagtccattatcaagttgaaggagccaaggggttctgaccaggcagcaattgctgcatatatagaggatcaatactgttctacgccgaccctcagaaagttactgtcaacaaaactgaagcacatggtggctagtggaaaattaatgaaggtaattttactgttagttaatcccttaacaaggcacattgttcttggcttattggaacttagtttcccaataatcaacatttttatctgcaaacctttgtaatgaagcatagtcagtctggataaattttagatcatgtatgacagatactttactgacaacattttttatgttatttattgaaggttattgacaaaatatgatttgcgacaagaaagtaattggttatatgtgtgcacagatgtgaatagaaatatgttctcttgtggcagttgaactatgcatatctgggcacgctctttagcaggagtgaaaaaactattttgaattgataaaattttcccatttaataaactaatattactgttaaataaatattgggtatgcaattaaactctatttggtcaatagatcctgagtgtgacatatctaacgagtaatgacaggtaaagcataagtacaggattgcaacaaatttaacaatatctgagaaaagaagatgctcttccctgttactcctggaagggaggcccaaagattctccaaaagcagagaagactggtgtcaacatcctttcaaaatccgaaattgatgcagagctatcgaaaatgaagggtgtgacacctcaagaggctgcggcggcagctgcaaaagcagttgcagaggcagaagctgccattgccgaggctgaggcagcagctagggaggcagatgctgcagaagccgaggcagaggctgcacgagtgtttgcaaaagcagcaatgaaagcactaaaatgcaagacacttcgtatttgatggtgtcagcttctgcgttgctgacatgaggagtatttgagatcataattctgctgctagacttcctgcatgtattcaattactgtacataatttaggcttgtaaatttggaatatgcgggattgatctatgaaacgttttgtcaggagtcattatgagcgtattatttatttatttattttgaccttatttttaagaaagacaatgaggcgagagtacaaagtattagtggaagagtggaatcagtgatctagtgttatgatggaatgtgtgatagacatcctctattagtaaatggaagaatacaatttttattagagttccaatgacaaaactgagtgccactttctcgtgattca

SEQ ID NO: 1213 - DNA, 507 bp, Glycine max
cttctgataacacatttggccagataaataacatcaaatagtggcttctgggctatctggagttgttttctttgcaaatgttggatgtctaagagatgattgaagttaattgggaattgagataagtaaagtcagatttttcttggtgaacggacatgcagaagtagtctgcactcaacttccaagctctccactagaacaaaagcaaagattatactgtcataaaacgtttgcagacttattttgatgggtgctcctaagcagaaatggactgcagaggaagaagcagcgttgaaagctggagtagtcaaacatggggctggaaaatggcgcaccatacttacagacccagagttcagttctattttgcgcatgcggtcaaatgtagatctcaaggacaaatggaggaacataaatgtgacagcaatatggggatctaggcagaaggcaaagcttgctcttaaaaaaaacctactaccatcccccaaaattgaccataaccacatg

SEQ ID NO: 1214 - DNA, 358 bp, Glycine max
gatgggtctctggtccgggtagggcatctggcgcgggatgcaaacaagcttgggacctgtagataccaatccgatcccagtcaatgcattgtcctacaattccaactaagccgaaagtgatggtgatgtacacgcgatgggtgctacgaagcagaaatggactgcagaagaggaacaagcgcttaaagctggagatgtcaagcacggggttggtcaatggctcaccatactgactgatacaaagtccagaggtgtgttatacctgcggtctaatgcggctctcagggatgaatggacaaagctgaacgtgatgtcgactggatggagctctacggatacatgtacgttatgagtctga

SEQ ID NO: 1215 - DNA, 546 bp, Glycine max
ctgctgcggctgcaaaagcagttgcggaggcagagactgcaattgcacaggctgaggcagcagctagggaggcagaggctgcagaagctgaggctgaggctgctcaagtgtttgcaaaagcagcaatgaaggcgctaaaatgcaaaatgcttcatatttggtagtttcctcaccaagaaatctaatttgattcctgtggatgaaaatatgagatggtcataactttatctaaattttattttcctgtttagaatgcttatcacatcataattattccgatagtatgctggttctctgcactcttcagtagtcactcctttagaatcttctcatccttatttattttgccttttgttcttggttactggattagaggctgatctgtctgtggttagacttttctccaagtggataatttgctcagaacatcttatagcacagttttttaccaaactgatcatgaatttctaacagtctctactatggaattcaatttccacaaatgaaatctaacactacaatagtagtgaacattataaagaaaac

SEQ ID NO: 1216 - DNA, 591 bp, Oryza sativa
  misc_feature (10)..(10): n is a, c, g, or t
  misc_feature (158)..(158): n is a, c, g, or t
  misc_feature (254)..(254): n is a, c, g, or t
  misc_feature (271)..(271): n is a, c, g, or t
  misc_feature (299)..(299): n is a, c, g, or t
ccgccggccnacccgccgtacgccgaggtataaccgtctcaaaccctacgccgtcgcggggattcttggattgaaatcatcggatgggttttggattcgtctcgatctatcgtttgcttttgcgtgtttggatctgattttgttttggggtttttttnagatgatcatggaggcgatcgtggcgctgaaggagaggactggatcgagctcccaggccatcggcaagcacatccatgccaaccatggcgccaacntgccgcccaacttccgnaagctcctctccggcaacctcaagaagntaaccgccgccggcaagctggccaaggtcaagaactccttcaagctctcctccacccgccctgccgctccggccgccgccgacgccaagcccaaggccgcccccgccacgaagcccaaggtcaagaccaccaaggccgcgaagccggctgccaaggcgaaggctcctgctaccaccaaggccgcgaagccggcgaccaagaccaagatcaaggatcgccgccgcgccggcggcgaagcccaaggcgtctcccaaggcgaaggccaagaccgccacctcgccggtgaagcccc

SEQ ID NO: 1217 - DNA, 1112 bp, Oryza sativa
tggcacgaggggcattcctgcaggctagacaatatcatagtagaggcagtaaggagcttgaatgagcctacaggatcaggctccccggcctgcgcgcattacatagaggagcaatactggcctcctgctgattttgatcatgtcctgtcttcaaaactgaatgatctgacagcatctgggaaattgataaaggtgaatcgaaagtacaggatagcccctagttcatctttgtcagaagggcgaagctccaaagtagtgctgctcgaagatataaaaaaagaaccaacaaagttagatagggaagatgttgcagtcctcactaaatctcaaatcgatgctgaattagctcggatgagaaccatgactgcagaagaggctgctgctgctgctgctcgtgcagttgcagaggcagaagctatcatgactgaagccgaagccgcagtaagagaagcagaggctgcagaagctgatgctgtagctgcacaagctttcgcggaggcagcaatggcaacatttaaaaacagaagttcagcaaaattgatcattcgagcttgaagctacctgtgggagctggtgcagcatcagtttcctccgaccttgttgtatgtacacttgtcccgcgttccaatgcaatgcaattgctactccagttgggctagggacgaccctattccatccttaacttatgcaagcttattacagaaccaaattgcccaaagccccaaactggaattgcaccgcatctgctgaatttgccaacaattttgttacgcctggatctgcacaggcattgcggctacggcatcttttgactcgctcatggtagtaacccacatatgctgggataatcagggagtgaccagtagaagtacatcatggttatccccattcctcctccttgggtgattgtaattcaccttgtaatcggttttggcgtcaaataatcagagtattgcgttgttgttgcatgtacagatgtaacagtgtctgtctggttgactggttcacttcattgtgtatatcaactggctttttttttaagctctttctcatggataatatggtaatgctgcagcgtgatgtaaaaaaaaaaaaaaaaaaacctgcagccc

SEQ ID NO: 1218 - DNA, 1164 bp, Oryza sativa
  misc_feature (1134)..(1134): n is a, c, g, or t
atagtggatccccgggctgccgtctcatgcctcactcgcctagaacccctcctcctcctcccgatctccgaggcaatcctcctcgaattccccgcgccccgatctccccctgacgccaccctcctcctccgccccggatcgccccgcccgatctcgccgcggggtcgaatttccccttctcttgtctccgatcagggccgcctcgatcgaaggcggcgccgcgccgaccatcccaccttgtttggttgtaatttcttcttgtcgcgtgaggaggggggcgtggcggcgggggagagcgcgtgagcgggcgggagatgggggcgccgaagcagaggtggacggcggaggaggaggccgcgctcaaggccggcgtggcgaagcacgggacggggaagtggaggaccatcctccgcgacccggaattcaccgcgctcctgcggctgagatccaatgttgacctcaaggataagtggcgcaacttgagtgtcactgctggaggatatgggtcaagagagagggcaagggtagctttgaagggaggcaagcgagggcctaaggcccttgctgaaccgatggatgccgacgaaaagaaccctgacattgatgataatgcaatcattgatgcacaaccgttggcagtggttgttgagcccatgcaacttgagagtactccagagaaagggggatcagttgctaggcttgatgaccttattttagaagctataaagaagcttaaggaaccgtctgggtctaatagaacaacgatttcttcatacattgaggagcaatactggccacctgaagattttcaacgattactttctacaaaattgaaagcattggttgctactggaaaattaatcaaggtaaatcaaaagtacaggattgcaccaagttcgaactcttcaggtggaaagagcatcaaggtgtattccactggagaaatgaacatagaaaataataatgttagacagctgagtaagcctcaagtggatgctgaacttgataagatgaaaagcatgagttaggaagaggcagcatcatttgctgctaagggcagttgccgaggcagaagcagccattgctgaaagctgaagaagcagccaagggctgcagaaggccgcagaagccgangctgacgctgcaaaggctttccttgatgct

SEQ ID NO: 1219 - protein, 103 aa, Oryza sativa
MGAPKQKWTSEEEEALRRGVLKHGPGKWRTIQKDPEFSPVLSSRSNIDLKVQPLTLPLRHRRLPCAGGSCDAATSSEEKNYGAVVCGYGHSGLKLAGQTGAVF

SEQ ID NO: 1220 - protein, 377 aa, Oryza sativa
MGAPKQKWTAEEESALKAGIAKHGAGKWRTILKDPDFSNVLRYRSNVDLKDKWRNMNVTVNASGARDRVKAPVVKKPRSAPKHEGHSTSTAIAAVTSDGDDDVAEPVPLATSTSSKRSLSRLDNIIVEAVRSLNEPTGSYKTAIANYIEEQYWPPADFDHVLSSKLNDLTASGKLIKVNRKYRIAPSSSLSEGRSSKVVLLEDIKKEPTKLDREDVAVLTKSQIDAELARMRTMTAEEAAAAAARAVAEAEAIMAEAEAAVREAEAAEADAVAAQAFAEAAMATFKNRSSAKLVIALSTSVLVSNDHSSLKLPVGAGAASVSSDLVRDVFNLVWLLFNSKSLKGPCILLFGCRSSTRIGLEKMEEYEKHRILIGIEV

SEQ ID NO: 1221 - protein, 297 aa, Oryza sativa
MGAPKQRWTAEEEAALKAGVAKHGTGKWRTILRDPEFTALLRLRSNVDLKDKWRNLSVTAGGYGSRERARVALKGGKRGPKALAEPMDADEKNPDIDDNAIIDAQPLAVVVEPMQLESTPEKEKSVARLDDLILEAIKKLKEPSGSNRTTISSYIEEQYWPPEDFQRLLSTKLKALVATGKLIKVNQKYRIAPSSNSSGGKSIKVYSTGEMNIENNNVRQLSKPQVDAELDKMKSMSKEEAASFAARAVAEAEAAIAEAEEAARAAEAAEAEADAAKAFLDAVVTTMQNRNHASAVY

SEQ ID NO: 1222 - DNA, 633 bp, Zea mays
  misc_feature (624)..(624): n is a, c, g, or t
tcagatcactttcatagggcatctcataaagtgactcttgtggtaaggccgaagcagcgctggacgccggaggaagaggccgcgctcaaggccggcgtcgccaagcacgggcccggcaagtggcgcaccatcctccgggactcggacttcagcgcgctcctgcgcctccgctccaatgtgtgacctcaaggacaagtggcgcaacttgagcgtcaccgcaggaggttacgggtctagagagaaggcaaggatggcgttgaagaaaggcaggcgcgtggtgcctaagcttactgctgagccaatggatgtagatgagaaggatatggacaacgctcatgacacagtcattgatgtggaaccgttagcaatggctttcgagcccttgccacttttggaaagcccagataagtcagttgctaggctcgatgatctcatagtagaagctataaggaagcttaacgagccatctgggtccaataaggcagtcatttctggatatattgaggaccaatactggccgcctgctgattttcaatacctgctatctacaaaattgaagtcattggttaattctggaaaattaatcaaggtaaaccaaaagtacagaattgcaccaagttcttncttgggcgg

SEQ ID NO: 1223 - DNA, 834 bp, Zea mays
  misc_feature (791)..(791): n is a, c, g, or t
ggccggccgggacccaacaatcaaacaagcctaatggcttcctctccatctcacgccactgcgttgcctacttgccctagaaccctcgccgccgcccctctttaggattcccatgtccctggtcgccccctgacacgcccgccccggatcctgcacccgaattccgcgtggaattccgggccgaaccgcctctctgcgtgcgcctccgaccaccaaactctctctctcacacgcgcgcgcgcgcgcacgtctgaggcggtttgattctccggtgggggttccttggtctcgaactctcgatttgctgctgatgggggtgccgaagcagcgctggacgccggaggaagaggccgcgctcaaggccggtgtcgccaagcacgggcccggcaagtggcgcaccatcctccgggactcggacttcagcgcgctcctgcgcctccgctccaatgttgacctcaaggacaagtggcgcaacttgagcgtcaccgcaggaggttacgggtctagagagaaggcaaggatggcgttgaaaaaaggcaggcgcgtggtgcctaagcttactgctgacccaatggatgtagatgagaaggatatggacaacgctcatgacacagtcattgatgtggaaccgttagcaatggctttcgagcccttgccacttttggaaagcccagataagtcagttgctaggctcgatgatctcatagtagaagctataaggaagcttaacgagccatctgggtccaataaggcagtcattgctggatatattgagggacaatactggccgnctgctgattttcaatacctgctatctacaaaatgaagtcattg

SEQ ID NO: 1224 - DNA, 1545 bp, Zea mays
  misc_feature (1524)..(1524): n is a, c, g, or t
  misc_feature (1540)..(1541): n is a, c, g, or t
  misc_feature (1543)..(1544): n is a, c, g, or t
ttgggaccctcgaggccggccgggctcccacccaacaacaaaacaagcctaatggcttcctctccatctcacgccactgcggttgcctacttgccctagaaccctcgccgccgcccctctttaggattcccatgtccctggtcgccccctgacacgcccgccccggatcctgcacccgaattccgcgtggaattccgggccgaaccgcctctctgcgtgcgcctccgaccaccaaactctctctctcacacgcgcgcgcgcgcgcacgtctgaggcggtttgattctccggtgggggttccttggtctcgaactctcgatttgctgctgatgggggtgccgaagcagcgctggacgccggaggaagaggccgcgctcaaggccggtgtcgccaagcacgggcccggcaagtggcgcaccatcctccgggactcggacttcagcgcgctcctgcgcctccgctccaatgttgacctcaaggacaagtggcgcaacttgagcgtcaccgcaggaggttacgggtctagagagaaggcaaggatggcgttgaaaaaaggcaggcgcgtggtgcctaagcttactgctgacccaatggatgtagatgagaaggatatggacaacgctcatgacacagtcattgatgtggaaccgttagcaatggctttcgagcccttgccacttttggaaagcccagataagtcagttgctaggctcgatgatctcatagtagaagctataaggaagcttaacgagccatctgggtccaataaggcagtcattgctggatatattgaggtaaaccaaaagtacagaattgcaccaagttcttccttgggcggaataagcactaaggtatcctcttctgaagggatgaacacagaaaataataatgttaaacggctaactaagcctcaagtgattgctgaactggagaagatgaaaggcatgaccagggaagaggctgctgcctttgctgccaaggcagttgccgaggcagaagtagcaatggcagaagctgaggaagcagcaagagttgcagaggctgcagaaaatgatgctgaagctgcaaaggcttttcttgatgctgtcattttgtcaatgagaaacaggaacgctgcttccatgatacttcgagcttgctgatccttcacccatgccgtcgcatggttttcgcagcagcacaccgatgttctgctgcaaagattttctggatagatgagtttcttgtatagccttatagatcatggcgggttttcaacagcttgctgttgtcctgtgctgtgcagccaatcgacaacatgataacaagaatgatcgagaaagtagtcttcatttttttttgtttcccattgtgttgctttgtaattaaactatagccttttcccttcattagttgatgaagtgatgtcgtctaatagaccccctgtagtgaaaagaaaatgtcagaaagcccccctagttaatgcaaattgctgtgatattatttttgcagaaatgattatatggtgtcaccgtttaagacttnaaaaaaaaaaaaaaannanna

SEQ ID NO: 1225 - DNA, 1691 bp, Zea mays
  misc_feature (22)..(22): n is a, c, g, or t
ttgggaccctcgaggccggccnggtccgccaccttctccacccaacaacaaaacaagcctaatgggtaatggcttcctcagttcctctccatctcacgccactgcgctgccctagaaccttcgccgccgcccctctttaggattaccgtgtcctcgatcgccccctggcacgcccgccccgatcgccccctggcacgcccgccccggatcctgcaccggaattccgtgtggaattccggacccgatcgaaatcgaaccgcctccctgcgtgctcccctgatcaagaaattctcacgccgcgcgaacgcacgcctgaggcggttggatcctctggtggggttccttggtctcgatttgctgtgtgtggatgggggcgccgaagcagcgctggacgccggaggaagaggccgctctcaaggccggcgtcgccaagcacgggcccggcaagtggcgcaccatcctccgggactcggacttcagcgcgctcctgcgcctccgctccaatgttgacctcaaggacaagtggcgcaacttgagcgtcactgcaggaggttatgggtctagagagaaggcaaggatggcgttgaagaaaggtagacgcgtggtgcctaagcttactgctgagccaatggatgtagatgtgaaggatatggatgacgctcatgacacagccattgatgtggaacctttagcaatggctttcgagtccttgccaactgaggaaagtccagataagtcagttgctaggctcgatgatctcatattagaagctataaggaagcttaaggagccttctgggcccagtaaggcagccattgctgcatacattgaggaccaatactggccacctgctgattttcagcgcctgctatctacaaaactgaaggcattggttaattccggaaaattaatcaaggtaaaccaaaagtacagaattgcaccaagtccacccccctcgggcagaataggcactaaggtatcctctgctgaaggcatgaaggcagaaaataataatgctaaacggctaactaagcatcaagtgattgctgagctggagaagatgaaaggcatgaccaaggaagaggcagctgcctttgctgccaaggcagttgctgaggcagaagtagcaatagcggaagctgaggaagcagcaagagttgcagaggctgcagaaaatgatgctgaagctgcaaaggcttttcttgatgctgtcactttatcaatgagaaacaggaatgctgcttccatgatgcttcgagcttgctgatcctttacccatgcggtcatatggttttggccagcagcacaccggtgtttctgctgcaaagattttctggatatatgagtttcttgtatagccttatttatagatcacgacgcatcaactggaggggtttttaacatcttgctgttggtcctttgtcgttgcagcctttagacaatcgacaatatgataacaagagttatcttgaaagtagtcttcatttacttttgttttctccccattgtgttgctttgtaattaaactctagccttttcgtttagttatttgaaattgtgtcgtctagtagaacaactgtagtgaaaagaaaatgacaaaaatgtcagatagccaccttagttattcaatttgctgtgatagtatgtttctagatatgattagctaatgacagcgtttaagattacattcc

SEQ ID NO: 1226 - DNA, 1912 bp, Zea mays
ggccggggatgaacttcccactttccaattcgacatcttcgccctcgaatcgagcttccctccaccgaatcgagttcctccatccaaatcgagctcattgccgccggatcgaggtctgcgtggatcgagctcgagctttggagaaggagaggaaacgggggacgggcacggggggagcaaggcaaccaaacgggtggagggaaacacgccaaacaggctcctcgatcgttccgggctcgggctgccacccgccattcggtgtcccctccttgacaggtgcccgagccgcgccgagctccagcctcatttccacggtccgcgccggcactcttccctctcccgatcgtcctcctcgtcgcctgccgcctcttccttcttcccactccactagcttcaggttggactgcacaacgtggagcggagatctatccgaacacgggattgattcatctggtggtgttaacaacatagggtttttgatatagcaatgggattactcatgtataaatgaacaaagtttggagacagttggacctgacaattgccactttttacatgttttaactcattttttttctgggaaacaagtaattctgaagttaccttggaagtcctttgcgcttttgactggtcgggttgcataggccattgttgagaggtgatttggcctaagaatgggggctccaaaacaaaggtggacttctgaggaagaggctgctcttagagctggaatagcaaggcatggagttggaaaatggcgcacaatattgaaagatccagaatttagttccaccttatgctaccgctcaaatgttgatctcaaggacaagtggcgaaacatgaatgtgattgtcagtacatcgagttctcgtgacaaggcgaagtctgcattgaagagaatacgaactattcccaagaataatgagcacaccatggcaattaccagagttacttctgatattgatgatgagattgttgacgaaaagcctatagtatcattgcctagtgaagcaaagaacacatcaagttcgaagaaatctcacaggctagataatattataatggaggctataaagaacttaaatgagcctacgggatcacacagaactactattgctaattacatagaggagcaatattggccacctagtgattttgatcacttactatctgcaaaactgaaggacttgtccaccagtggcaaattgataaaggtgaaccggaagtacagaatagcacctagttcacccaattcagagcgccgaagccccaaaatgccactgttggaagatgtccaaagagagcctgtcaagatatggagtgatgatactaaaacccttaccagatctcaagttgatgctgaattggcacgtatggcaaccatgactgctgaggaagcttcagtggcagcggctcgagcagttgctgaagcagaggccatcatggcagaagctgaagctgcagcgaaagaggcagaggctgcagaagcagaagcccaagccgcacaagcatttgctgaagcagcgtttttgacattgaagaacagaaatgctggaaaattgatggcctaaggttgatcctacttggactctcggcctcgcggctgttctgaaacggcttttctgtgccatgtagatttgtacaacagtacgtgtttactacacttcggtttaaagcagctgccccggtgagtgtatcaccttatgttagtgggagccatgtgaaaactccagcctccagcgcactagtagcaacaatagcagcttgccacaacgccattcagaaaactgggtggcataaactcttccagtgtcaaatgtttcgctaacgatttgcagtattgcattgtgcatgaacagcctttgcattagtgcattattgcgctgcctgccaacagtcggcccgtttgctg

SEQ ID NO: 1227 - DNA, 1317 bp, Zea mays
gtcgacccacgcgtccgcggacgcgtgggatcgggcgtaccccggtgcccgttcaccgccgttcacgccgcgtgtgcgctctggctctgccgctctctctctctctcctgcgcgtggcgcagctgccgtcctataccaggcgcccaggtctagcctcgtcggtgccttcgccaggtctttctcgggcccttcgccaacgacgagcgcccgctaggttagaaggtatgcattcgtgttcataatattgtatttgactaaaaagactgggcctacgcatgggggctccaaaacagaggtggacttctgaggaagaggctgctcttagagctggagtagccagacatggagttggaaattggcgcatgatattgaatgatccagaacttagctccacattgcgctaccgctcgaatgttgacctaaaggacaaatggcgcaacatgaatgtaattgtcacttcatcgagtactcgtgacagggggagaacttccacgaggagaacccgagctgctcctaagaataatgaccaattgttggcaatgagcacaatcacttctgaggttgatgatgagattgttgatgtaaagcccatagtatcaatgtctgttgaaggatggaatacttcaaattcaaagaaatctcactcaaggctagacaatattataatggaggctataaagaacttgaatgagcctacagggttcccacagaactactattgctaattacatagaggagcaatattggccacctagtgatttttgatcacttattgtctgcaaaactgaagtatttagctaccagtgggaaattgttgaaggtgaatcggaagtacaggatagcacctagtttgctggaagacgtgcaaagagaacccttgaaattagggagtgatgctagtagaacccttacaagatcccaagtcgatgctgaattggtccgtatggcaactatgactgttgaggcggcggcggcagctgctgctcatgcagttgcagaggcagaggctatcatggcagaagctgaagcagctgctagggaagcagaagctgcggaagcagagggcccgagctgcacaggcctttgctgaagcagcagttttgacactgaagaacagaaatgctgcgaaattggtatagctcgagtccatgaatcttagatatgccctcttgtccttccacacgtagaatccagttccgtagctctgtatgcaactaattggttactaaaagaacctgaaatcagaagttttcacaaacacaccgacttattcaccgaagattatgatttccaaaaaaaaaaaaaaagggcggccgc

SEQ ID NO: 1228 - DNA, 661 bp, Oryza sativa
tttggtactcccatcaacatggttcacaccacaccactacaccagtgacaccaccaccaccattacagggaccttggcctttcttgaaggaggatgagttcatcctggacaacaaagcagaataaggtgtttgagagggcgctggcaatatatgacagggatacgccagatcgctggcagaatgtggcacgggcagttggtggtggaaagtcagttgatgatgtgaagaggcactatgaaaagctgatcaaggacgtggatcgcattgactctacaggaggccatcaaggatcccattacaacagctccaatgctagcagcagcagcagcagcagcaactctcggggcagtgccaatgaggaccagaggaggaggtaccacaactttcagtgaatgtgacattgacatctcgaaagccgaaagcagcctgagttccagcaagaccgacacatatgatcgactgtccctgcagatgctaccttcactatttcgtttatgttttctattatgcgcgtgtgtgaatcagaactggccctaatagaccagtagttagtaccttagtttcaattgagctatgactggtttgctgaattatactgttgtattccatctgacgatgctgtatatgtaatatctgatggaaagtttataatcttctctg

SEQ ID NO: 1229 - DNA, 523 bp, Glycine max
gcggtgccgaagacgattatgcaattgatgaacgtggaagggttgacccgcgagaatgtcgcgagccatctccagaagtatcgtctctacctgaaacggatgcagggcctttcgaacgagggcccttcttcttcggatcagttattcgcttccacagctgtgcctcagagtttgcatgactctgctcctcccagtgcccatagcaatggccatggtcatctccctgttcccatgatgtccatgccatatccccctcccatgatgtccatgccatacccccctcccatgatgtccggcatgccccatgcccatggccacatgggcatccccatgcctaattcctccgccacctcagcttaccatccttataacatgttgcatcaaagggattggcctcaccttgctcctaatgataaatgaacctccaaggtcagccatcaccatcatatggaaagtcaattgtttgaaatttgaattgaatacaatgttatagaaggtgctatatgtttaaattggttcactt

SEQ ID NO: 1230 - DNA, 1468 bp, Glycine max
cccacgcgtccgcccccccggagacgagcgagtacgacgaagagcgcgtgatggagtgggaggcgggtctcccaactgccaacgatctcacgcctctctctcagccgctgatcccgccggaactcgcgtcggccttcagcatcttgccggagccccaccgcaccctcctcgacgtcaaccgcgcctctcgcaacacgctctccacgctccgcggcggcggagggagcgtgcaccaggccttctcctcctccaacaacaaccacaactacgacggcgacggcgacggaggcgtcgaggaggaggaggaggaggacgacgatcgcgacggctcggggccggattcacggaagcagcggaagatcgactgcggcgcggccgaggaggcggactcggcggttcagacggagacctcggcggagcggacggcggtgaagcggccgcggctggtgtggaccccacagcttcacaagaggttcgttgacgtggtggcgcacctcgggatcaagaacgcggtgccgaagacgattatgcaattgatgaacgtggaagggttgacccgcgagaatgtcgcaagccatctccagaagtatcgtctctacctgaaacggatgcagggtctctccaacgagggtccttctgcttcggatcagttatttgcgtcgacacctgtgcctcagagcttgcatgactctgctcctcccagtaaccatagcaatggtcatgggcatgggcatggccatagcaatggccgtggtcatggtcatggtcatggtcatggtcatctctctgttccgatgatgtccatgccatatccacctcccctgatgtccatgccatatccacctcccatgatgtcgggcatgccccatggccacatgggcatccccatgcctaattcctccgccacctcagcttaccatccttataatatgttgcatcaaagggattggcctcaccttgctcctaatgataaatgaacctataaggtcagccatcaccatcatatgcaaaagattcaaaggcttgattattggtagtatagctttctgagaagggaggagctgcattgatgattaccctgtaattcactcaaaaggattattgaggaagtatatgaagaagagtatatggagctagattacaatcttagtcagtagtgtgtatcctgtgggagatttacaaacttattggtacacatctctaattcctgtcacctaattgtatgacgagaattctggcttatttcttctggtctgcctagacagctgattctaaagtaaattcttaactggttctctgattcataaattatagattcctattatattgtgtaatcctgaatgtgttaactctctttttcagaaccattgaataaaagaaagaccgaacaacagacaggaaacatttattggttgctctggccttaaatgttcttctttttcttatacctcttgatcattatttcctt

SEQ ID NO: 1231 - DNA, 811 bp, Glycine max
ggctggtgtggaccccgcagcttcacaagaggttcgtggacgtggtggcgcacctcgggatcaagaacgcggtgccgaagacgatttatgcaattgatgaacgtggaagggttgacccgcgagaatgtcgcgagccatctccagaagtatcgtctctacctgaaacggatgcagggcctttcgaacgagggcccttcttcttcggatcagttattcgcttccacagctgtgcctcagagtttgcatgactctgctcctcccagtgcccatagcaatggccatggtcatctccctgttcccatgatgtccatgccatatccccctcccatgatgtccatgccatacccccctcccatgatgtccggcatgccccatgcccatggccacatgggcatccccatgcctaattcctccgccacctcagcttaccatccttataacatgttgcatcaaagggattggcctcaccttgctcctaatgataaatgaacctccaagattcaaaggcttgattattggtggtgtgtaattcacaccctgtaattcacattgatgattaccttgtaattcacacaaatggattattgaggaagtatatgaacaatactatatggagctagattacaatctgaatcagtagtgtgtaaccctgtgggagatttacaaacatattggtacacatctctaattcctgtcacctaattgtatgacgagaattctggcttatttcttctggtctgcctagacagctgattctaaagttaattcttaactagttctctgattcataaaaaaaaaaaaaaagggcggc

SEQ ID NO: 1232 - protein, 1153 aa, Oryza sativa
MAMRGEPWRRQEGEQAQAEADRERELDLFRSGSAPPTVEGSMGALHAAAAADVFLEDELRADPAYHSYYYSNGNINPRLPPPLLSKEDWRSAQRLRPGLGGIGDGRKPRGGGGGRGGGGAGGMGPGDGLIGMPGLEIGRQNSFSGFGTIKRLSVAKVLVLKLLIILFKAKEITSDLYMMQDDSYQHDTDRQGANCNGTDLLSSSKVQYGLHRETGAISGLHSDSKAPCLPENQNESSHSYASIIGSSLSRSASPDPELVRRVPSPCLPPIGVKLGATDKKNNVGSSSFNCSSPNIIESDDLVSALSGMNLSSSRAMNGNTMDQSKLHQDVDDVRKFLFDQYMDQTNGNQRHSYMKRSEQGHVKVPQEYSGASMNPSVMRSQINAGGFTSFNNSSVGSGFASPRLGSRSPGGSLSSRQNLTGASNLPNYVGIGSPTAASAHQMPVDPLYVQFLRAAEIAALAANCEDPLMDRANLGGSYMDLFGPQKAYLSPLLQSQKQYSYYGNLGVGLGYAGNSLTSPILPSSPGGPGSPLRHGDRSMRYPSGMRNFGGSFGSWNSDLGGKMEANLVPSLLEEFKSNKSKSYELSEIAGHVVEFSADQYGSRFIQQKLETASTEEKDMVFAEIMPQALTLMTDVFGNYVVQKFFEHGSSAQIKELADQLIGRVLALSLQMYGCRVIQKAIEVVDLDQQTKMVAELDGQVMRCVRDQNGNHVIQKCIECIPQHAIQFIVSTFYGQVVMLSTHPYGCRVIQRVLEHCDDPKTQQIMMDEILQSVCLLATDQYGNYVVQHVLEHGKPHERSAIIEKLIGQIVQMSQQKFASNVIEKCLAFGNPVERQVLIGEMLGSSNESEHLEVMMKDQFANYVVQKVLETCDDQQREMILTRIKAHLNTLKKYTYGKHIVARVEKLVAAGENPSIMGEEAPEEYELGGGEDERVMEWETGLPGADELTPLSQPLVPAGLAAAFRIPPEPGRTLLDVHRASAATVSRLRRASSSSSSSFPAFASKGAGTGADEAESGGGADGGNGNTNNSSSKRARLVWTPQLHKRFVEVVAHLGMKNAVPKTIMQLMNVEGLTRENVASHLQKYRLYVKRMQGLSNEGPSPSDHIFASTPVPHASLHDQVPSPYHPHPHHHSYNNAAYAATVSSYHHYHHANH

SEQ ID NO: 1233 - protein, 192 aa, Oryza sativa
MTPVSHQLVPPALAAAFGIDLAAVGVLLPSPSVDSPVSHLFFPVDEDDDEDEEGEGEGGNDDAPAAAAAGGGGGRCGKKARMVWTPELHHRFVEAVAHLGEKGAVPKAIVRLMNVDGLTRENVASHLQKYRLYLKRTRVAATPPPSPPPPPPPPPPLPPAMYVPCFAAKPPLDAANRSDSPPSRTSDATTKQ

SEQ ID NO: 1234 - DNA, 318 bp, Oryza sativa
gaactagtggatccccgggctgcaggaacaacagcagcagcaagagggcgcggctggtgtggacgccgcagctgcacaagaggttcgtggaggtggtggcgcacctggggatgaagaacgcggtgcccaagacgatcatgcagctgatgaacgtggagggcctcacccgggagaacgtcgccagccacctccagaagtatcgcctctacgtgaagcggatgcagggcctctccaacgagggcccttccccctccgaccacatcttcgcctccacccccgtcccccacgcctccctccacgagcaggttccttctcctt

SEQ ID NO: 1235 - DNA, 538 bp, Oryza sativa
cccgggctgcaggaatcggcacgaggctcgtctcttcctcttcctcttcctcgtcgtcgtcgtcgccgagccgtcgcatggtggacgccgctgcggcctccggggacgcgtgcggccgcgtgacggagtgggagaccggcctgccggctccaggcgagatgacgccggtctcgcaccagctcgtcccgccggcgctcgccgccgccttcgggatcgacctcgcggccgtgggcgtgctcctcccctctccctccgtcgactcccctgtctcccacctcttcttccccgtcgacgaggacgacgacgaggatgaggagggggagggcgaggggggtaacgatgacgcccccgccgccgccgccgcgggcggcggcggcgggaggtgcgggaagaaggcgaggatggtgtggacgcccgagctgcaccaccggttcgtcgaggcggtggcgcacctcggcgagaagggcgccgtgcccaaggccatcgtgcgcctcatgaacgtcgacggcctcacccgcgagaacgtcgccagccacct

SEQ ID NO: 1236 - DNA, 1003 bp, Zea mays
tgaaaagggaaaagaaacttatctttctttctttatttcttaaaagagatccatttaccgctcacacgaagaactgaattagcaagagatccaaaaccaaaaggatcgatgggattattgagggatccaatccaacagaagagtcatttgtgggcgtggtggtagtgatggtactggtactggtaccctcctcctcccattccgttgtggttgtggtacgcctgtccgccgctggccatggtgccgtacatgggcacctcatgcaccaggctttgcggcaccggcgtggatgcgaagatgtggtcggacggcgacgggccctcgtcggagaggccctgcatccgcttgacgtagaggcggtacttctgcaggtggctggccacgttctcccgcgtcagcccttccacgttcatcagctgcatgatggtcttgggcaccgcgttcttcatccccaggtgcgccaccacgtccacgaaccgcttgtgcagctgcggcgtccacaccagccggggccgcttgctgctgctgctcatgttattgttgccgttcgtcgtcgccgccgccccgccgcccgccgccgacgagtccgccccttcgtcccccctcgccgccggatggaagggcgcgaaggaggagctccctccgctgcccgacgacgacggcggcggcgcgcgacgcagccgggacaccgtggcagccgacgcgcggtgcacgtccagcagcgtccgcccggcctccggcgggatgcggaacgccgctgccagacccgccggcaccagcggctgcgacagcggggtcagctcgtccgcgcccgggagacctgactcccactccatcacgcgctcgtcctcgctgccgccgccgccgccgccgtagcacaccatgtggagctcgtagtcgtcgaccgcctcctcacccattcgcttaccttcctcccaaatcgtagtcgtcgccggaacaggggtggagatatttgtgtgtcgggtcggatcgggtcggagat

SEQ ID NO: 1237 - DNA, 1265 bp, Glycine max
attatgttgccgcggaaaaaggagattacttatctatgcaaacatgactgagcatcagaagaatttgcaggatcatttagttaataagacgttggggaactatttgaaagaaaatatgtcaagtggactttctgttcctgcaattatgattcgtaatttggctattcaacttaggaaggtgtgtaaccatcctgatctccttgagtcagcatttgatgattcatatttgtatcctcctttggaagagatagttggacaatgtggaaaattccatttgcttgatcgattgctgcaacgtttattttcaaggaatcacaaagttcttatcttcagtcagtggactaaagtgttagatataatggattattattttagtgaaaaaggctttgcagtttgcaggattgatggtagtgtgaaactggatgagaggaaacaacagatccaggacttcaatgatgtaaatagcaattgtagagtttttcttctttctactagggctggtgggttgggaatcaatctcactgtagctgatacatgcattctttatgacagtgactggaatcctcaaatggatttacaagccatggatagatgccatagaataggccaaactaaacctgttcatgtttacaggctctcaactgcccaatctatagagggtcgcatgttgaaaagagctttcagcaaattaaagcttgagcatgtagtgattgagaagggacagtttcatcaagaacgtacaaaacctgccagtatggatgaaattgaggaagatgatgttttggcattgcttcgcgatgaagaaacagctgaagataaaatgatacatacagatattagtgatgaagacctggagaagctcttggatcgcagtgatcttatagtcaatgactttaacgatgataacttcaaagctccagtcagtgcctttcctcttaaagggccggggtgggaggtggtgattccaactgcgactgggggcatgctctctactcttaactgctagtttcttgtcactgtttatggccggagtttgaaaatcttgctttttgtgggatgagatggaatggctttttgaaacattcttttatgtcacggtggtaatgccctggatggcattcattttttgtagatgcttctaacggaactatgtttagaaatgaagctactctggatatgttttttgcgagttggaattgaacattctacttgtgtagtggcgaaagtgaattggtttggatacaataaaccttaatttaacagtt

SEQ ID NO: 1238 - DNA, 637 bp, Glycine max
ccacgcgtccgctttagaggaaggctaaaaaggcagttgctgccatgctgacaagatctaaagaaagtgagaagactgaagatatgaacatgactgaggaagaaagagttgagaaagagcagaaagagctcatgcctttactcacaggtggaaaattgaagaattatcaactgaaaggtgtaaagtggttgatttccttgtggcaaaatggattgaatgggattcttgctgatcaaatgggtcttgggaagacaatccaaacgattggatttctctcacatctaaaagcaaaaggtctggatgggccgtacatgataattgctcctttatcaaccctctcaaactgggtgaacgagatttctaggtttgcaccatcactccctgccgttatctaccatggtgacaagaaacagagagatgatatccggaggaaacatatgcccactagaacaattggcccgcaatttcctatagtcataacttcttacgagattgctttaaatgatgccaagagatatttcaggtcatacaattggaaatatcttgttgttgatgagggacacagactcaaaaactcacaatgcaaattagtgaaggcattgaaattcataaatgttgaaaacaagcttctttttac

SEQ ID NO: 1239 - DNA, 357 bp, Oryza sativa
  misc_feature (9)..(10): n is a, c, g, or t
  misc_feature (12)..(12): n is a, c, g, or t
  misc_feature (146)..(146): n is a, c, g, or t
  misc_feature (194)..(194): n is a, c, g, or t
  misc_feature (199)..(200): n is a, c, g, or t
  misc_feature (211)..(211): n is a, c, g, or t
  misc_feature (228)..(228): n is a, c, g, or t
  misc_feature (253)..(253): n is a, c, g, or t
  misc_feature (285)..(285): n is a, c, g, or t
  misc_feature (291)..(291): n is a, c, g, or t
  misc_feature (297)..(297): n is a, c, g, or t
  misc_feature (323)..(323): n is a, c, g, or t
  misc_feature (330)..(330): n is a, c, g, or t
  misc_feature (340)..(340): n is a, c, g, or t
  misc_feature (351)..(351): n is a, c, g, or t
acttgttcnncnaatgactggcgggaagttgaagtcctaccagataaagggtgttaagtggttaatatcactttggcagaatgggcttaatgggatattggctgatcaaatgggccttgggaaaacaatacagactatcggttttnttgcccatctcaaggggaagggtcttgatggtccatacctgataattnctccnntatccactctntcaaactgggtgaacgngatctcaaggtttgttccatctatnactggtctgatttatcatggggacaaagcagnccgggnaagagntaaggggaaaattcaatgcccaaaancactggnccagattttnccattaatcgnaacttt

SEQ ID NO: 1240 - DNA, 743 bp, Oryza sativa
  misc_feature (359)..(360): n is a, c, g, or t
  misc_feature (386)..(386): n is a, c, g, or t
  misc_feature (398)..(398): n is a, c, g, or t
  misc_feature (667)..(667): n is a, c, g, or t
ggccttacgagtgcctacaggtttgacttttctgcgaaaggaggtgaagaagaacaagaggatagtgaagagaagagaaaagtcgatgttgtttcaaagcttcatgccatattgcgcccgttccttctaaggcggatgaaggaggatgtagagcatatgcttccacgaaagaaagagataatcatttacgctaacatgactgaccatcagaaacaaatccagaatcacttggttgaacaaacatttgatcaatacctgcatgaaaaatcagaaattgttctgcggaaacctggcattaaggcaaagctaaataatctgttaattcagttgaggaaaaattgcaacccatcctgatcttnnctggagtctgcgtatgactcatcagngtctgtatccancctgttgagaagctcttggaacagtgcggcaaatttcagctcttgaacagattgctaagtttgctgcttgcacggaagcacaaggttctaatattttcacagtggacaaaagttttggacattatcgagtactacttggaaacaaaaggccttcaggtttgccgaattgatgggagtgttaagttggaagagaggaggaggcagatagcagaatttaatgacttgaacagcagcatgaatatctttattctaagcacacgggctggcgnggcttggtatcaatcttacttcagcggatacctgtatcctatatgatagtgactggaatcctcagatggatttgca

SEQ ID NO: 1241 - protein, 739 aa, Oryza sativa
MSEVRSVPGMKVEASPAAAAAATVDSPTSVLEDDEKISECKNGDVLDTTEAIKQEEDHLDVLIEEKVDGFVDASSSLNVEPAANNSDLSPLTVPVKEEGQLLEPVKEEKADDFVDAVPSLPIDLEAKNGDASLITDAMKEEEEKLHDARVKAEEEEVARKREEAARLAFDPNARFNKLDELLSQTQLYSEFLLEKMETIADVEGVQTHAEEEPVEEKKNGRGRKRKATSAPKYNDKKAKKAVAVMLTRSHEDCSPEDCTLTEEERWEKEQARLVPLMTGGKLKSYQIKGVKWLISLWQNGLNGILADQMGLGKTIQTIGFLAHLKGKGLDGPYLIIAPLSTLSNWVNEISRFVPSMTGLIYHGDKAARAEIRRKFMPKTTGPDFPLIVTSYEMAMSDAKHLAHYKWKYVIVDEGHRLKNSKCLLLRELKRLPMDNKLLLTGTPLQNNLAELWSLLNFILPDIFSSHKNLSHVPYRFDFSAKGGEEDQEDSEEKRKVDVVSKLHAILRPFFLRRMKEDVEHMLPRKKEIIIYANMTDHQKQIQNHLVEQTFDQYLHEKSEIGLYPPVEKLLEQCGKFQLLNRLLSLLLARKHKVLIFSQWTKVLDIIEYYLETKGLQVCRIDGSVKLEERRRQIAEFNDLNSSMNIFILSTRAGGLGINLTSADTCILYDSDWNPQMDLQAMDRCHRIGQTRPVHVYRLATSHSVEGRIIKKAFGKLRLEHVVIGKGQFEQDRAKPNALD

SEQ ID NO: 1242 - DNA, 1378 bp, Zea mays
agaacaaatgcttccacggaagaaagagaagagcatttatgctaacatgactgaggttcagaagcgaatccaggatcacttagttgagaaaacctttgatgtctacttgaatgatgaatcagatattgtgttgcgtagacctggcatcaagacaaagctaaatagtctctttattcaattgaggaagaactgcgcccatcctgatcttttggaagctgcatttggaacaacaagcctttatccacctgttaataagcttttagagcaatgtggcaaatttcagcttctggacaggctactaacttccctacttgcacgcaagcataaggttctaatattctcacaatggacaaaagttttggacattcttgagtattacctagattcaaaaggccttggggtttgcagaattgatggtagtgttaatttggaagagaggcggcggcagatagcagagtttaatgatttgaatagcagtctgaatgtctttattctgagcacacgggctggcggacttggtatcaaccttacttctgctgatacatgtatcctttatgacagtgactggaatcctcagatggatcagcaggccatggatcgatgccaccggattggtcaaacacgcccagtgcatgtatataggctggctacctcatattctgttgaggagcggatcatcaagaaagcttttgggaagttaaagctagagcatgtggtgataggcaaggggcagtttgaacaagaaagagcaaagcctaacgctttagaggagggggagctgctggcgctgcttagggacgagcaggacgaggaagatcggatgatccagaccgacatcagcgacgaagacctcttgaagctgatggaccggagcgacctgtccggaccacctggtgctgccgatgccgctccactgatcccgctgaaaggccctggctgggaggtcgtggtcccaaccaagagcggtggcggtatgctctcgtcgctcaccagctgagcgatgccggcaccatgtttggggtgcccattttgctagtcactcatcatcatgtggacgatgatgcgcttgttggccggtcgctgatcaggcggatattttgcatgtatgcccccctacaaactgttgatctgggtgttgagcctgcagcattagggttagggtcagtgacacgcaacgcaagtcgggtgaagttatgctgtgaacttctgatgagtagctgcaagctgcctttcagacttgagctttttgctgcttctgttgctgcgttatatggtgtagtaacaatagctgatgtttacaccaaagcggagatggatgccctctatgatgtagtccttgctatataacatgaacattcatgtgattttctgtagtgtc

SEQ ID NO: 1243 - DNA, 1504 bp, Zea mays
gaagaaaaggctgcatgttgtttcaaagcttcacgctatcttgcgtccattccttctaaggcgtatgaaggaggatgtggaacagatgcttccacgaaagaaagagataatcatatatgccaacatgactgagcaacagaagcaaatccagcatcacctgatcgaaaaaacatttgacaactacttgcacgaggaatcagatattatattgaaaagacctggcattagggcaaggttgcataatctaatgattcagctgaggaagaattgcaaccatcctgatcttttggaatctccagttgattcaactggtttatatccacctgttgagaagctcctggaacagtgtggtaaattccaactttttgacaggttgctaaatttcctgatggcgcaaaagcacaaggttcttgtattctcgcagtggacaaaagtgctggacattattgaatactaccttgattcaaaaggccatgctgtttgccgaatcgatggtaatgtgaaactggaagaaaggaggaggcagatagcagaattcaatgacgtgaatagcagcatgcgtatcttcctcctgagcacaagggctggtgggcttggcatcaaccttactgctgctgacacctgtatcctctacgacagcgactggaaccctcagatggatttgcaggccatggaccgatgccaccggatcggccaaacacgcccagtgcatgtgtataggctggctacgtcacactccgttgaggggcggatgatcaagagagcctttgggaagctgaagctggagcacgtggtgatcggcaagggacagttcgagcaagacagagctaagccgagcgccttagatgaaggtgagctgctggcgcttctcaaggacgagcagaccgaggaggacaggatcgtccagaccgacatcagcgacgaggacctccagaggctgatggaccggagcgacctcatgggcccgccgcctggcgacgctaacgcccgtccgcctcttgtaccgctgaaaggtccgggctgggaggtggtggtgccggccaagagtggcggcggcatgctgtcgtcgctcaccagctgagccgtcgttgctgcggggatctgttgtgcttttggtttgtcgcactcagttttggtttggcccccactggtggttttggtggcagctgttgcgctgctcaggcgatggctgttgaactggggcgttgcccctgcagaagtagctttttagtttaggatcagcaacaaaacaagcaggaggactctaggccatgtgtggtcgagtctccgtacggtggtcgttgcgttagattacgtgggtgggtgatgggacggttggttgaaccagacccgacggcagcatggacacacgccggttgctttgtaaagttagtatcgcgtcgtccgtgatacaatgcggtcctccgtctacatgggtgctgacgctctcttgttcggctgtcttgtgatgttgcaaacgcccgtgccgtgacaaaagccggtt

SEQ ID NO: 1244 - DNA, 2387 bp, Glycine max
catagaaacaaaaaggaattcattagatttgaataaaagttataattttacatggcgaaattattgaaaattgaggggattgagtgacagcagcaaagttacattccaagaaggtcggttgggaagagagagcaatgtaataaagaccatcatagcatcgtctctctgagcaaagtaagcacagcagcaccgcttagcagttacagtgtccgttcccttcgtcgttggcaaaatggctgccggcacaactctatcaaaattgcaagtcacctatgcttccgctccctcgttcctctcgaatgcctcccttcctcctcccactccgccggctgcggcgggggcgacggctcgtacctcgacggcctccgtttgaagtgccgctcgtcgtcgctagattcgtagtccgcgacggcgctgctgctcttcctcccttcgtagtacccgttcgacattgtcttcaggtgtgccgaagaggcagtgggagcggcggcggcagcggcagcggcagcggcaggttctgttgtggaagaagcggtgacttttctcttcttaggaagttcctcttcagcggggaagcttatgcgggagaacacgctggccttctgcttgcgatccgcggcggcggctgcggcagcggctgatgcggcattggatgaaggtttggcgactggttccgatgaccttctggatgaggattccgatcggtgacggcggtggtggcgctcgtgctcatagtcgcgatccctgtcttcgcgttcgcgatcggagtggtgctctaactttctcttggttgggcgtggaggtggaggctccacctcgcgcggagacctatcaggtgagtgtcgctctgaacggaaacggggctgatggtaatcgctacccgaggacggtggaattgacctagtttttgatttcattgaagaaacatccccaacactgctcacttccctaccaaagtctcgatctttagagaagtccctttcaggacgtctatcattttcacgcttcctcctcatatcagctttacgggcttcaaactcctctctactcattactggggctggagcattcattcccatactgaagtcagcaagatccctatgaggtgggaaaccaggcatcatgtaaccttgcatgccaaatgggtcttgtggcataccaccaaatggcatgtccaaggggcccaggccgtaacccatcatttgcattggattaccatacggtgccataaatccatccatgggttgcatgccattccagtacgaattatagccagcaggtggaaccattggcatcatatagttctctgccccgaagtcatgtggggttttccactgcaaatcatttggcagcaaacggactttcttctttttctttttctttccagcctcagtaggaaccaacttttgctgcacttcttcctcaacctgctgagcactccattgtgaggctggctccttcacactcatagactcgtgagtagcttcagatatatcagcagctctggggttccttacttgctcggatgtctgctgtggagcagaaacagcctttctatcatcagttgtttcctgtatatttgttgttttttcattaacaggtgaaacctttagttctcccttggatgcagcagatgaggttggggatggaatcttaggctgcggacagcgagcagactccatatcttgagcttggaaagtgctcccagcattttcagcactgctattgcccgactccaatatacgattaatggtatctcgtaatgtcttattcggtaagagatcatctgcaagaatatttgttgcaccacatacacagatagacttggagataatatagtccctaatacatctgtcacaaaagcttttaaagcaacacttgcttgtcagtacagcatctttcattaacaggtgaaacctttagttctcgagctcgggtggtaggtccccaacggaacgtgttgatggcatcccttctatttctttctcaaaagcggcctcatttggcttcaagacagctactgaaccatttggtaaagcataggaaccttgtggatttaccatcagcatggatcttggaataccggtgggttgcttgacttttctcatgtcaaaaattcgggtcaccatttgtaggacagtgctgaataaaatgtccaggcaccttgcatctgtgacatacatagccttgtgggggtgttttccgctccatcccaaaaccacgtccaccacccatccgtccccctgtaccccttccaaagcctctaccagtgccaaagtctgaaccttgacgttgccagtccaaggctggagtatcaagaaaggctttaatcttactgtcttcatcagctttgctaggaggaggagcctctggaattaagttgcttg

SEQ ID NO: 1245 - DNA, 828 bp, Glycine max
gatatgattgtccatcatacatctgtcacaaaagcttttaaagcaacacttgcttgtcagtacagcatctttcataacatcattacacaagggacagcggagctcaggtggtaggtccccaacggaacgtgttgatggcatcccttctatttctttctcaaaagcggcctcatttggcttcaagacagctactgaaccatttggtaaagcataggaaccttgtggatttaccatcagcatggatcttggaataccggtgggttgcttgacttttctcatgtcaaaattcgggtcaccatttgtaggacagtgctgaataaaatgtccaggcaccttgcatctgtgacatacatagccttgtgggggtgttttccgctccatcccaaaaccacgtccaccacccatccgtccccctgtaccccttccaaagcctctaccagtgccaaagtctgaaccttgacgttgccagtccaaggctggagtatcaagaaaggctttaatcttactgtcttcatcagctttgctaggaggaggagcctctggaattaagttgcttgattgaacaggcacttgatcaggaattgaatacaaatcattgccaaattcatcccaatctgaatcttcaggatatttcatggcagatgtatcttcagctggtaggcttccattttcaggttcagattccaccaccttattttccaccttttgttctatttcagtaacaattggtaaacgtggccttcctggaacccgacgaattaacactgaggtatttttaggaaaaaacatcggacgcgtgggtcgacccggaatccggaccggaaccgc

SEQ ID NO: 1246 - DNA, 436 bp, Glycine max
tgcttgattgaacaggcacttgatcaggaattgaatacaaatcattgccaaattcatcccaatctgaatcttcaggatatttcatggcagatgtatcttcagctggtaggcttccattttcaggttcagattccaccacccatattttccaccttttgttctatttcagtaacaattggtaaacgtggccttcctggaacccgacgaattaacactgaggtatttttaggaatcaacatttcttcatcaagatattcttcattggtctgggcgttggtgaccacaaggtcgaaatcagtacccctccctaaatgcttggattcaaatattttttctttcaatgtaccaacagagatgaaaggaccgtccatgggaattgaatcataatctcttgcactcttaaatttataatacacctgacgcgtgggtcggcccg

SEQ ID NO: 1247 - DNA, 740 bp, Glycine max
  misc_feature (658)..(663): n is a, c, g, or t
  misc_feature (684)..(687): n is a, c, g, or t
  misc_feature (715)..(716): n is a, c, g, or t
  misc_feature (720)..(724): n is a, c, g, or t
  misc_feature (737)..(739): n is a, c, g, or t
aattcttatccgtctcaatcacttgacaaagaaacataaacttatgttttgtttgaaagagaaaaggcaggaggtggtagcaattaattagatttgaataaaacagttataattttacatggagaaattattgaaaattgacgggattcagtcacagcagcaaagttacattgaaattcccttccttcaaagaacaagaagtttatttcaaggttcggaagagacaagttgagtctggtcgtctctcggtgtccgtttccttcgtccttggctgcctatcaaaattgccactcacctatgcttgcgctccctcgttcctctcgaatgcctcccttcctcctcccactccgccggctgcggcggaggcgacggctcgtacctcgacggcctccgtttaaagtgccgctcgtcgtcactggattcgtagtccgccacgccgctactcttcctcccttcgtagtaaccgttcgacactgtctttaggtgtgccgaagaggcactgggtgcggcggcggtagcggctggttccgttgtggaagaagcggtgacttttctcttcttaggaggttcctcttcagcaggaaagcttatgcgggagaacacgctggccttctgcttgcgatccgcggctgctgccgctgctgctgctgctgctgcnnnnnnagcagcagcggcattggatgnnnntttggcgactggttccgatgaccttctnnatgnnnnnttcgatcggtgannnc

SEQ ID NO: 1248 - DNA, 671 bp, Glycine max
  misc_feature (587)..(587): n is a, c, g, or t
  misc_feature (636)..(636): n is a, c, g, or t
ccacgcgtccgcggacgcgtgggtttgggtccaattgctgctcgctatgatagtatttttatttattttaatgagtcaaatatatttaacagtagttttcttttgttttaaaaaaaaatggtcctaacattgattttggtgcagaggtcaattccaccgtcctcgggtagcgattaccatcacccccgtttccgttcggagcggcactcgcctgatagatctccgcgcgaggtggagcctccacctccacgccctaccaagagaaagtccgaccacaactccgatcgcgaacgcgaagacagagatcgcgactacgagcacgagcgtcaccaccacaaccgccatcaacgatcagaatcctcatccagaaggtcatcggaaccggtcgccaaagcttcatccaccgcatcagccgctgccgcagccgccgccgcggatcgcaagcagaaggccagcgtgttctcccgcataagcttccccgctgaagaggaacttcctaagaagagaaaagtcaccgcttcttccacaacagaacctgccgctgccgctgccgctgccgccgccgctcccactgcctcttcggcacnacctgaagacatgtcgaaacgggtactacgaagggaggaagagcagcangcgccgtcgcggactacgaatctagcgacgacgag

SEQ ID NO: 1249 - DNA, 535 bp, Glycine max
aaacatctaaactgttctgtacttgcatgatgaggaagaactacaaaccagagaaacattagcataaatgcataatattcaaattctgaaaaccctaaatacaacagatgaatgaaaaacatacatctgtcacaaaagcttttaaagcaacacttgcttgtcagtacagcatctttcataacatcattacataagggacagcggagctcgggtggtagttccccaacagaacgtgttgatggcatcccttctatttctttctcaaaagcagcctcatttggcttcaagacagctactgaaccattaggtaaagcataggaaccttgtggatttaccatcagcatggatcttggaataccagtaggttgcttgacttttctcatgtcataattcgggtcaccatttgtaggacagtgctgaataaaatgtccaggcaccttgcatctgtggcatacatagccttgtggaggtgtttttcgctccatccctgccagacctcagcatcagttgtgatcaacatattagtattaaaaac

SEQ ID NO: 1250 - DNA, 780 bp, Oryza sativa
gcgcgcgcccccctgccaacacacgcagcaaaatccacaccgcttcccctccccgagaagaagagagcagcatccatggcgcccaaggcggagaagaagccggccgcgaagaagcccgcggaggaggagcccgcggcggagaaggccgagaaggccccggcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggtccaccccgacatcggcatctcctccaaggccatgtccatcatgaactccttcatcaacgacatcttcgagaagctcgccgccgaggccgccaagctcgcccgctacaacaagaagcccaccatcacctcccgggagatccagaccgccgtccgcctcgtcctccccggcgagcttgccaagcacgccgtctccgagggcaccaaggccgtcaccaagttcacttcctcttaggctgcacctggtgctattgtgctagtagtaatattagtttgatctatttatctactagctgtagtgcatcaatgatgggaaatggatgttggggatttagtgactgtaagaagaattaggtggggctgcttttgaggaacttctgtttcatggattcgaaatacactagtaatgcttttgtatcaaaaaaaaaaaaaaaaaaaacgaaaacatcgactagttctcgctcctctcctcgtgccg

SEQ ID NO: 1251 - DNA, 893 bp, Oryza sativa
acggcacgaggagcagcacaccggccgggacgccccaatctcgcgaatcccaccgcttccctttcctctcctctcctctccccgagaagaagagagcagcggcatccatggcgcccaaggcggagaagaagccggccgcgaagaagcccgcggaggaggagcccgcggcggagaaggccgagaaggcccccgcggggaagaagcccaaggcggagaagcgtctccccgccggcaaggccgagaagggcagcggcgaggggaagaaggcggggcggaagaaggcgaagaagagcgtcgagacctacaagatctacatcttcaaggtgctcaagcaggtccaccccgacatcggcatctcctccaaggccatgtccatcatgaactccttcatcaatgacatcttcgagaagctcgccggagagtccgccaagctcgcccgctacaacaagaagcccaccatcacctcccgggagatccagacctccgtccgcctcgtcctccccggcgagctcgccaagcacgccgtctctgagggcaccaaggccgtcactaaattcacctccgcttaggcttcacccctgcatctatctattgctattgctaatagttgtagtttgatctgtttgtgttagttttagtgctatcgatgattggaaaatggatgttagatcgttagcttggtagtcagatgtcagtgatctggaacagtagctctgattttaaaccatgtgaatgtgattcctgggtatgtgatgtttgaccgccctgtgcctgctggtcaacgaatgataactagatctaatttttgtggaactatttacaattcaactgttgtaaaactcgagaccatcacaaagagcttccgtgctgactacgttcttggtgaaggaggg

SEQ ID NO: 1252 - protein, 697 aa, Oryza sativa
MGVVYYKYKSSKETISVPVPHSFVSVSELKQLILTSDKHGRGRTRGRGPREDIVLSNAQTGEEFLDENAMIPQNSTVLVRRTSGQQSEKIVLFSSREVIEDGAIASNKSEITESTSKSCSSTEVQDEDAAIASIIDAAELKWEDKPSKRGQTGGRFTSGRYGHGPVEGETPPPGYVCRSCGVPGHFIQHCQQERKTPPSGYVCYRCRIPGHFIHHCPTIGDPKFDDYKKPHTLVPEVSACPIDGIPSALAPAASVSVVDDLPAELHCRLCNKVMADAVLTSKCCFDSFCDKCIRDYIITQSKCICGVKVLADDLIPNQTLRSTISNMLATRASSITSGTGKHRSSSGSNVDPNSASQTPSAALEKQSKDHHISSAAPDAGLQVATEHVSHLEHKLTTGVDLEVKDEGNSAGILVEKIVPTADARLKDVTDSTSKPATISGTMEPKASKTDQLKKKRKKADSTKIVHPNNANYGYSIPFDPAYCNPYVSGYPWLTDPYMYGPAGMPYGGYPMGPYGVNSIGNMPLQFPSAMQGNLANTHCWETQSMIHWANEDAARPRLAAKPKEPEPANQSRSSERNQRLSSSHGTDPSYKTSRSSSDRRDHRRSIDYVEDHRSSDYAEDHRSSKRMRASSPSPTGGDRHSRARSRYSSRKLTYEDSSPTGGDRHSRARSSHSSRSLTYEDSSDDERNFKRRWGGKR

SEQ ID NO: 1253 - protein, 311 aa, Oryza sativa
MAVFYRYRSRVDTFSVPVPEPFVSVGELKRLITATARHGHGRSRGRGPGTASRCAATRLARTQVGGPDVTRRPASGESDGVIPAELYCKICRNVMADAVVTSKCCFDSFCDGCIRDHIASKSKCACGAQARADDLIPNTTLRTTIANLLATTTGAAASASSGTDKTRSSAGSNAAHPAAPLSPAASQASRSSNVSSEKAEHSDGGASTSKKIATISGALGPRKAQETVAGDHSAESGARAVHGGDHYGVPFCPATGYVDPFFFGGMPFGADPYMYYGGVPYGCGGAPNGYYGGEELRDRKRARVSPGTGCW

SEQ ID NO: 1254 - protein, 1054 aa, Oryza sativa
MASAEKPVDDEELISYILAGLDFDYNSVVSSVTGRTGPISVSDVYALLVGFESRLELLQNAGNPSANTASRGGRARGGRDGRGRGRGNPGRGGSFGRGRNDGKPKPTCQLCGKIGHIVAKCWKRFDPSFTGEEKNANTAAVNSYGIDTNWYIDSGATDHITGEMEKLMVKDKYTGNDQVHNASGAGMNIDHVGHTAIRTPTRDLTLKNVLHVPDACKSLVSAHRFTRDNKTFVELHPFFFLVKDQVTRMPLLRGRCRSGLYPLPTDKLQTISNKQAFGVVKPSLFRWHSRLGHPSFSVVNRVISQNNLPVVRDSSQEFVCDACQKGKSHQLPYPKSSSVSIEPLQLVFSDVWGPAINSVGNKVYYVSFIDDFSKFTWIYLLKHKSEVFAKFQDFQNLVERLTNRKIKAVQTDWGGEYQRLNSFFQRIGIEHYVACPYAHQQNGSAERKHRHIVEVGLSLLAHASMPLKFWDEAFTTAAYLINRTPTKVINFETPLQRLFNLPPDYSLLRTFGCACWPNLRPYNARKLAFRSKQCAFLGYSTLHKGFKCLDISTGRVYISRDVVFDEQIYPFEKLHPNAGARLRAEINLLPAHLLPLLDHGGVQMHDQPLIDDSNPANPIIENSAGSSAGNGAKSGAQHGHDFMQSSGGQPTGGHHDSLTHSTMHGTENQADQENSASSRSAEPVTPRHAASPSAAPHAATAPIASSHAAASSLSGDIVGPGSRGPSQEDQDTSQEDQDTSASAPASSTSHDDDSAQFAAQPTRPVTRAQRGIHKPKKYTDGHGGPVVKAATIRLVLSLAVSQGWSLRQLDVQNAFLHGYLEEDVYMKQPPRYEEKKMPHYLCKLDKALYGLKQAPRAWYSRLSKRLQELGFVSSKADTSLFFYNKKGLLFWSSSYSFTQELEKDFALKDLGDLHYFLGIEVKKTEKGLLVTQESAFSDADWAGCLDDRRSTGGFAVFLGSNLISWSARKQASVSRSSTEAEYKALANATAENKTHRSGFHFVREQVAQKMLEIRFVPSQDQIADGFTKPLPVRQLQLFCNNLNLGELRLRGSVR

SEQ ID NO: 1255 - DNA, 2807 bp, Zea mays
ctgtgcggcgctcaggcggcgggtttccacgggcgcgttcgtgggccgcttacatacaataaaatccaccgccctcgccgccagcctgcccccaatcccaccgccagtctccgcccgcgcctcagaagtcagaaccctagccccggcgacgccttcagatccggcgcccttatccggcggaatcgctcgctcctaccaccggttgccgcgttccggcatctcggctacccggcgtcctctacccgacttctacgccctcgatctcccccagccgtcgtcacgaggaatcgtttgctccacaggctacgtctccaccaagcctgcatcgacgactcgaaggatccgtgccgtcgtcgatcgccgatcgcctcttcgtagatcgaatctgttcagtgttctgatattcgttgtatttcatctgagatctgaaaaaagtattcgggccatctcgagatagagaggccttcataggcggagaaaaagaaacaggactcgccatccatcatgggtgttgtctattaccaatataagagtgaaaaggaaatctgttctatgcccgtgccccatgcttttatttctgtgtctgaactcaagcagcttatcgtgacgagcggtaggcacggccgtggtcgaacccgcggtcgtgccacagaggatattgtcatctccaacgcccaaactggcgaagaatatgcagatgaaagagcatccataccacagaacacaactgtgttggtccgcagaattttcattcccgggcaactgtcagagaagattgttttgtctcctaggcggaaagtcactgaagaatgttctgtaccttgcaagtcggtggttactgactcaagctcaaagtcatgttcctccacagtagtgcaagatgaagatgctgcaattgcagcagtaattgatgctgctgaactcaaattggaacagctcccctctaaaaaaggacaaggcagtggaaggtttacgtcaggacgtaactatgggccgttggaaggggaggcacctccacccggctatgtctgccgctcttgcggtgttccaggccatttcattcaacactgctcacaggaaaacaagatgcctccacctggatacatttgctacagatgccgaattccagggcattttatccaccattgtccaagcattggcgatcccaagttcgacaacaataaaatgagtcggtctcttgtcccagtagttacacctgtcgatggcattttggattcacttgtcccgtctgccccagccggggctgttgatgacttgccagcagagctccactgccgactatgtaaaaaagtgatgagagatgcagtattgacaagcaagtgctgttttgacagtttttgtgatagatgcattcgggattatattattaaagagtcgaagtgcatttgtggagtcgagacactagcagatgacctcattcccaatcaaacacttcggagcacaatcagcaatatgttgggaacacagactagcagtggtggaagtggtacaacaagacacagaagttcgtcaggcagcaaccctgaccccaaaatacagagccacactgcctcaacaagggaggtgaagcaacctagagaccaccagctaccagcagcatctgcacctgatgatgtgctccaggttgccacagaaggtgctctagtgaaccagcctcgggagaaattggcacccagtgctaaaatccttggtaaagatggaggcaattctgcacaagtgtcagcagagaagactgtagcaaatgctgaagccctcaaagtaaaggatggaactgaatcgacttcaaaggccaccactgtttcaggggcccgagaacacaatggcacgaggacagatcaagcaaagaagaagcggaagaaggcagacttaaccaagaacgttcagcctaacaatgttggctatggttacaatgtttcatttgaccctgcatattacaatcccttcatcaatggacatccttgggcaactgaaccttacatgtatagctcaatggggatgccgtacgctggttatccgatggatccatattgtgcaaatccaatggatccatattgtgtgaatccaatggatccatattgtgtaaattcgatgcaaggctatccagcaagctaccaaaggcctgaaactgagcccatgcgtcgtgggagcactgcggctgccagagcaccttcaaagcatcgtgagaggagtgaccggcccaaggacactcgtcttcagccccagtcaacagagcacaagcgacggctggtctcctctcatggaacaaggtcaaactcagatagaagggaccatgggcattcttatggggcatactgacagggcctcagttgacttccttgaggttcattctactaggaagcggatgcccgttttctcccgaagttagtatgatggtagacaaatcggtggtgatcgaaacggttccaggagtatgatgactcgtgaggagcacgcaagctacgaggaacgtaatttcaagacgagatggggtcatagatcatcaggaggcgtggacacaaggcactgtcctaaacttggcagaccaagtgcagcaatatattgctggttaccagtgctcacctattgatcttcttatactcgtaattgtatgtatgcccctgaaagtagaagaaagattgtcacaaagcagagggagctttcggttccctagcgaaatgtattgatattgaacaattttttttgtattaatgctgagagttgccagctctctctataatgcgaaccctccaaataatttcgctaaaaaaaaaaaaaaaaaagcggcc

SEQ ID NO: 1256 - DNA, 734 bp, Zea mays
gttatcttctatcaggcattcgggattatattattaaagagtcgaagtgcatctgtggagtcgagacactggcagatgacctcattccaaatcaaacacttcggagcacaatcagcaatatgttgggaacacagacaagcagtggtggtagtggtacaacaagacacagaagttcgtcaggcagcaaccctcacccaaaaatacagagccacgctgcttctgctgcgtcagcaagggaggtgaagcagtctatagaccatcagctaccagcggtatctgcacctgattatgtgctccaggttgccacagaaggtgatctggtgaaccagcctctagagaaattagcagccactgctgaattccttagcaaatatgaaggcaattctgcagaagtgtcagcagagaaggcggtagcaaatgctgaagccctcaaagtgaaggatggaagtgaaacgagttcgaaggccaccactgtttcagggtcccgagaatatgatgtcacaaggacagatcaaccaaagaagaagcggaagaaggcagacttaaccaagaacgttcagcctaacaatgttggctatggttacaatgtttcatttgaccctgcatattacaatcccttcgttaatggacatccttgggcaactgaaccttacatgtatagctcaatggtgatgccgtacgctggttatccgatggatccatattgtgcaaatccaatggatccatattgtgtg

SEQ ID NO: 1257 - DNA, 377 bp, Zea mays
aaagattctcaagaaaagtttcctgcaggggaacaagcggtaaagaagaagaaaaagagggggccacgtgttcctggaaatgctgaagagcaatggaaaaattttcaagattttggagctgaaaatttttcggggatgcccttgggtccaactggagcattcaacccttactggggcggaggagtgccattgccaatggattacatgagtgcaccgtttcctggtcccatgccttacatgggttatccaccaggtccatttgacccttttggtgggggtgttctcccacaagatccatttatgcccccaggatacatgatgccaggagttcctagggatctttctgaattggcagttaacgctatgggaataaacat

SEQ ID NO: 1258 - DNA, 371 bp, Zea mays
gccaaatccctgatggttatggttctggaagaggctatggtagagggatgggtggaagaatgatggctggacgtggctttggacgtgggctagaacgcaggacacctcctccaggctatgtttgtcacagatgcaaagtacctggtcattttattcaacattgccccacaaatggggatgctagatatgatgtgaaaaggatgaaacccccaactggcattccaaaatcaatgctaatgcaaactccggatggttcatacgcactaccaagtggagctggtgctgttttgaagccaaatgaagctgcttttgagaaggagatagagggcctacctaccacacgtcctgttggtgatcttccaccagagcta

SEQ ID NO: 1259 - DNA, 743 bp, Zea mays
gccggggccatcaccaatcagttaatcacagctcacagcaaacaccgcgaagcgcgaagccggcccgctcccaaacccgaccgagcaaagcgcaaagccccccaacctcagatcaatccgcagcatcgatggcgcccaaggcggagaaaaagccggcggcgaagaagcccgtggaggaggagcccgcgacggagaaggcggagaaggctccggcagggaagaagccgaaggcggagaagcgcctccccgcgggcaagtccggcgccggcgagggcaagaagggcaagaagaaggccaagaagagcgtggagacctacaagatctacatcttcaaggtgctcaagcaggtgcaccccgacatcggcatctcgtccaaggccatgtccatcatgaattccttcatcaacgacatcttcgagaagctcgccgcggaggccgccaagctcgcccgctacaacaagaagcccaccatcacctcccgcgagatccagacctccgtccgcctcgtcctccccggcgagctcgccaagcacgccgtctctgaaggcacaaaggcggtcaccaagttcacttcgtcttagataggttgccttccctctcgtttgtactggtgtctggtagtagatctcgtctagttgggggtgctgttgctagtcggtcgtggccccctttggtgtgataggccctgtttaattggttgcaggtgattagtttgtatatggttgtagtagatcttcgtttcg

SEQ ID NO: 1260 - DNA, 743 bp, Zea mays
atcaccaatcagttagtcacagctcacagcaaacaccgcgaagccggccccactcccaaacccgaccgagcaaagcgcaaagccccccaacctcggatcaatccgcagcatcgatggcgcccaaggcggagaaaaagccggcggctaagaagcccgccgaggaggagcccgcgaccgagaaggcggagaaggctccggcagggaagaagccgaaggcggagaagcgtctccccgcgggcaagtccggcgccggcgagggcaagaagggcaagaagaaggccaagaagagcgtggagacctacaagatctacatcttcaaggtgctcaagcaggtgcaccccgacatcggcatctcgtccaaggccatgtccatcatgaattccttcatcaacgacatcttcgagaagctcgccgcggaggccgccaagctcgcccgctacaacaagaagcccaccatcacctcccgcgagatccagacctccgtccgcctcgtcctccccggcgagctcgccaagcacgccgtctctgaaggcacaaaggcggtcaccaagttcacttcgtcttagataggctgccttccctctcgtttgtactggtgtctggtagtagatctagtttggggtgctgttgctagtcggtcgtgggcccctttggtgtgataggccctgtttaattggtttgcaagtgacacatttgagcaccaaactgttgtagtattcaagatgcaaattgcgccccctaca

SEQ ID NO: 1261 - DNA, 804 bp, Zea mays
aaaaaaaaaaaaaaaaaaaaaaaaaaaaaaaaaaaaaaaaaaaaaatcaccaatcagttagtcacagctcacagcaaacacggcgaagccggccccactcccaaacccgaccgagcaaagcgcaaagccccccaacctcggatcaatccgcagcatcgatggcgcccaaggcggagaaaaagccggcggctaagaagcccgccgaggaggagcccgcgaccgagaaggcggagaaggctccggcagggaagaagccgaaggcggagaagcgtctccccgcgggcaagtccggcgccggcgagggcaagaagggcaagaagaaggccaagaagagcgtggagacctacaagatctacatcttcaaggtgctcaagcaggtgcaccccgacatcggcatctcgtccaaggccatgtccatcatgaattccttcatcaacgacatcttcgagaagctcgccgcggaggccgccaagctcgcccgctacaacaagaagcccaccatcacctcccgcgagatccagacctccgtccgcctcgtcctccccggcgagctcgccaagcacgccgtctctgaaggcacaaaggcggtcaccaagttcacttcgtcttagataggttgccttccctctcgtttgtactggtgtctggtagtagatctcgtctagttgggggtgctgttggctagtcggtcgtgggcccctttggtgtgataggccctgtttaattggtttgcaagtgattagtttgtatatggttgtagtagatctcgtttcagctgtgattctttattactgctatgctata

SEQ ID NO: 1262 - DNA, 1193 bp, Glycine max
aacacaacttccacattccgatggaggagtcatgggaaaattggcatcttcatatggaaaccggttgcgagaacgatttcttaggcaagtgtcacggcactgacgatgacgagttcttcagagacatccttcagcaaccaccacctgcggctttctcttccgaaagcgaaagcgatcactccttcctcgctgtccaaaacacttctagcatccccaacgacggtgccgttttgtctcctaggaattacctcgtcaaaagcagcagctccaactccttggtctctcaaaacgcttccaaacgacctcgtcgtttgtcctctcccaggacttacattctgtccttcgacaactcaaccatggttccggccacacccgaaacccgcccccgctcctccaataattcccctctgcctgccaaacgggccctggaaagcccaggcccagtagcccgaaggcccaaccaaggagctaagaagataagaacctcttctcagaccatcgatcacataatggccgagagacgacggaggcaggaactcacggagaggttcatagcactctcagccacgattcccggcttgaacaagacggacaaggcttctgtacttcgagcagcaattgattacgtgaaacaacttcaagaaagggtacaggaactggagaaacaagacaaaaaaaggagtacagagtcagtaatattcatcaagaaacccgacccaaatggaaacgatgaagacaccacctccactgaaacgaactgtagcatccttcctgagatggaagcaagggtgatggggaaggaggtgctcattgagatccactgtgagaaagaaaatggtgttgagctaaaaatattggaccaccttgaaaatcttcatctcagtgttaccggaagcagtgtcttgccatttggaaattctgctctctgcattaccatcacaactcagatgggtgacgggtaccaaatgactgtgaatgatctagtgaaaaaccttagacaattgttctcaaaatcacatgtgctaagcgacagcgatccgtactagtgtatcaaacaatgagttgtagtgtatggaaatcgaaagttttggatttattaccctctttgattttggcttgttttcatgttgatcgtaacgttaataaacaaatactatatgtctgacctggatttatgcccggcatctaccctg

SEQ ID NO: 1263 - DNA, 1752 bp, Glycine max
  misc_feature (849)..(851): n is a, c, g, or t
cggcttgagggaccaatatgattgaaagatgtcacatctattaatcagatatattaattaggttgatagcttcagctgtttttcatttcatgaggacttctcatatggagatttcatcaatcagagggttgcctgaaatggggataatagaggatcctaacttcctccatcactggcagttaaactctattgatacaactagcctaacaggtgctccttttggagagattttacaaaagcactcattctctgataactcaaatttcaaccccaaaacatccatggaaacatcaccaactggaattgaaagacctgcaaaacagctcagaaataacagctggaatcacaacaaaagtcaacaacagacaccagaaacacaatttgcttcatgctcaaatcttctttcatttgttaattcgaattacacgagcgaattgggactagtgaaacctaaggtggagatggtgtgtcctaaaatcaacaacaacgctctcgcagacatgttgatctctcaaggaaccttaggaaatcaaaactatcttttcaaggctagccaggaggccaaaaagattgaaacacgtcctaaactttctcaacctcaagaccacataatagctgaaaggaagcgaagagagaagctcagccaacggttcattgctctatctgctcttgttccgggcctaaagaagatggacaaagcttcggttcttggagaagctataaagtacttgaagcaaatgcaagagaaagtgagtgctcttgaggaggaacagaacaggaagagaactgtggaatctgtggtaattgtgaagaaatcccggctatctagtgatgctgaagactcttctnnntcagagaccggtggtacatttgtcgaggcactacctgaaattgaagcaagattttatgaaagaaatgtcctcataagaatacattgtgagaagaataaaggagtcatagagaaaacaatcagcgaaattgagaaactccatctaaaagtcatcaatagcagtgccttgacatttgggagtttcatcctggatataacaattattgctcagatggatatggaattctgcatgacagtgaaggatcttgtgagaagtttacgctcagccttttcatatttcgtgtgaagaaactcgttatgcattccgaaaggttcatgaagaataggagtgcaatcaattataccagttcatataaactattatcaagtttaagttcttcaataataattatgtttccaaggtctgcaatgtctgccatctacaccatgtttgctctgaggttcatttatgaagaagggttttttctagcgatcttttctttttgcatggtcaacttgttgacagtgttattgtcacacaccctactgtttcaagagtgaatgtagagcttgttaggcattttttggcagaaagttgaaaagttcaactagctgtttcccatctatttcttacctaaatctttagaagcaggcctttgttgagtgacttcctatcttcttttttttttttcaggtgttcttgagttacttttttatttgaaacaaaatatacgcctgtaaaagtttggttggatttggtaagtgatggaataatcgtccttttgtttatcttgtgtatatgctcgacatgttgcatggcctcaacatgatattctgcaaaagcattaatgctaccaatttaagcatatgtaaattgtaggtggtggattaagcttaaaaaaaaaaaaaaaaaaaaaaaaaaa

SEQ ID NO: 1264 - DNA, 1468 bp, Glycine max
  misc_feature (1006)..(1006): n is a, c, g, or t
ctcaaattcgtcccctccaatccaacaacaccgatcagtttcatggtattgttgtttcttctgccttaagcccaaagcgataagaccaaggtgcttcagtttactcccacatacccggaaacgtttatcagaaaaccagaactttgaagctgaaagccccaaaggccatagaagctacaagtccccatctcacgttcgggatcacatcatcgccgagagaaaacgaagagagaagctcagccagagcttaatcgctctagcagctcttattcctggcttaaagaagatggacaaggcatcagtgctgggagatgctataaagtacgtgaaagagctccaagagcgtatgagaatgcttgaagaagaggacaagaatagagatgtggagtctgtggtgatggtgaagaaacaacggctgagctgctgcgacgatggttcagcttcacatgaagatgaagaaaacagtgaaagactcccccgcgtggaagcgagagtgttagagaaggacgtgctccttcggatccactgccaaaagcaaaaggggcttttgctcaacatacttgtcgagattcaaaaccttcatctcttcgttgtcaatagcagtgtcctacctttcggggattccgtacttgacataaccattgttgctcagatgggaaccggctacaatttgaccataaatgatcttgtaaaaaacctacgcgtggctactttgaaatccatgtcataacaccaacgtgatcttgtctgtttctggtccagcaggatggtctggtggtgggtggtaatattaataatgatattttcatgttttgtggtgtgcagatacccaaaaatgattgaaaatgagttattgtttgaaggtaaaaaatttggtcctccagtctatttttaattttggatttgatctcccactaaattaattcacaaatattatttttttattttataaaatcatgtaatgttcgtcctccagtccacacttgaaccttaacgggttacaagngtgacgttgattattgtcacgtgtcacttttttattgaatgatgactttcacgtgtcatgttttgatgggtcaatgaaaacaacaatgtatttcatcttttatggaattaacatccacatgatacgtgacaatcatcattcaataagaaagtgacacatggtagtcaatgtcactttgtaacaatcaacgtccaattgtgggttgagggaccaacattgcatgattttaaaaagtaggagaaaaaaaaattgtgaattaatttaatgggggacaaaatttgaaattgaagacaaactggagaatcaaaaatgtaattttgccttgattcaaatgctctcttgtcaatttgaatgcacaaaatttatatgtaattgaactttcatttcaaaatttacttctcttgatatttaatgcaaatatttattatatgaattgtttaaatgaaacttcaattttaattt

SEQ ID NO: 1265 - DNA, 1825 bp, Glycine max
gaatagcctagaatagcgaaagaaagtgttgctgctaattccatttcagtgacccctaattatgatggaggaattgaacaaaccattggacggatcagcaaccagctggttatccgatttggtaagaaaaaaaaaaaaaaatcattttcattcttccattcttcaaatgcccaaatagatgatcataatccataaatcctttaacccttttgtgttcctcttttgttttgttttatttataggaaatggatgattacaatttatttccagatgaatgtcccttgaacttgaacttgtttgatgaccaagagtttctctcacaagacattgctagtgcccttcaagaacagacacagaccttgcaacaatctttgtcttcagagtgcccttcaaaaactgtgagcaactcatccaccgatgaaaccacttttgactttgagagaccagccaagttgctgaaaacgacaacaagcagtagttgttgtaactctgactcatccaccatcaccaaaagcctttcacccaaactttccccatcgtcatctttttcctcatttcagtctcagattctctcctttgacaatcctaacccaacctcatcttccaacaccaccacccagttttatgggtttgactgtaccttaaacccaacacagaacgagatggtgtcagtgtcagtccccaacatgagaaaaccacggttcccaactcaaaccgcaaaaggttcaccgaaaaatcaaaactttgaaacaaaaacctcacatggtaagaggtctccagctcatgctcaagatcacatcatggctgaaagaaaacgaagagagaaactcagccagagcttcattgcccttgcagctcttgttcctggcctaaagaagatggacaaggcttctgtgttaggggacgctatcaaatatgtgaaagagcttaaagagcggttaacagtgcttgaagagcagagcaaaaaatcaagggcagagtcagtagtggttctgaacaagccagacctctctggcgatgatgattcttcttcatgtgatgagagcattggtgctgatagtgtcagtgactcactgtttgaagtggaatcaagagtatcagggaaggagatgctgctcaggatccactgccagaagcaaaagggtcttttggtcaaattactggccgagattcaaagccatcacttatttgttgctaatagcagtgtattaccctttggtgattctatccttgacattaccatagtggctcagatgggagaaagttacaatttgaccactaaggaacttgtcaagaacctacgcgtggctgcattgaagatattgtcataacatgaacgtggcttgagtatggaggataccctcatgacatatgatatggattggaactctgaatcacatttaatgcgccagccaccgagtaaatcacaaccaaaatggaagccttgttattaatgtgtgatttccgctacaacctgcagtgttccccaatatgtagattcagcttgatcccaagtgatcttgtctttttcgtgttatgttttggtttctcaggccttcagtgtgtgcctgctcgagggaaaaataattgaataattttgtaaagatgttaggaataatttcaatctgacacggcttaattaacatgagcttaaatagagattagaagctggataatggtgacattgacagtttttgatgtaccatttgttcttttgaacatgtttgaaggatgcaaatctctctaatttctggttatgcttccactttaattataatattggccccccagcatttatgttaatcacctactactataatgggct

SEQ ID NO: 1266 - DNA, 1561 bp, Glycine max
acgtgtcatgcactcgtcccttacctcggaattcggctcgaggaatggatcaaaccaatggacggatcagcaactcagctggttatccgatttggaaatggatgattacaatttatttccagatgaatgtcccttgaacttgaacatgtttgatgaccgagagtttctctcacaacacattgcttgcgccttccaagaacagacaccgaccttgcaacagcaatctttgtcttcagagtgcccttccaaaactgtgagcaactcatccaccgatgaaaccacctttgactttgagagaccatccaagttgctgaaaacgacaacaagcactagttctaactttgactcatccaccatcaccaaaaccctttcccccaaactttccccatcatcttcctttcaatctcagattctctcttttgacaacaccaacacccagttttatgagtttcactgtaccttaaacccaacacagaacgagatggtatcggtgtcagtgccccaaaagggaaaaccacggttcccaactcaaaccccaaaagggtcaccgaaatatcaaaactttgaaacaaaaacctctcatgctaagaggtctcctgctcatgctcaagatcacatcatggctgagagaaagcgaagagagaaactcagccagagcttcattgctcttgcagcccttgttcctggcctaaagaagatggacaaggcttctgtgttaggggacgctatcgaatatgtgaaagagcttaaagagcggttgacagttcttgaagagcagagcaagaaaacaagggcagaatcgatagtggttctgaacaagccagacctctctggtgataatgattcttcttcatgtgacgagagcattgatgctgatagtgtcagtgactcactgtttgaagtggaatcaagagtatcagggaaggagatgctgctcaagatccactgccagaagcaaaggggacttttggtcaagttactggctgagattcaaagtaatcacttatttgttgctaatagcagtgtcctaccctttggtaattctatccttgacattaccattgttgctcagatgggagaaagttacaatttgaccactaaggaacttgccaagaatctacgcgtggctgcattgaagatattgtcataacatgaacgtggcttgagtatggagaataccctcatggcatatggcatggatattgaaactctgaatcacatttaatgccccagccaccgagtaaatcacacccaaaatggaagccttgttattaatgtgtgatttctgctacaacctgcagtgttccccaatatgtagattcagcttgaccccaaatgatcttgtcttcttcgtgttatgttttggtttctgaggccttcagtgtgtgcctgctagagagggaaaaataattgaataattttgtagagatattaggaataatttcaatctgacatgtcttaattaagattttaattgagttgattaaccagaagggatgagttgtttaatttctatgaataaaaaaaatctgacccggcttaattaacattagcttaacca

SEQ ID NO: 1267 - DNA, 712 bp, Glycine max
caaatcatcctcaatccatcataaagtactatacgataatgttcgtatcatggatatttttttttaatacaatctgagaacttccttgatgcactagcacggatcactaattcactattgcatgtcatacacctccaacagatattctctcagttttttcactaggtcatccttggtcatgctgttttcgccattcatctgagcaataatgttgattataagagtagaagtcccaaatggcaatacggtgctactggttgtagatagatggaggtttctaagcaaggcatgtattttgaacactatgtccttttgcttctcacaatggattccaatgagtacttccttatctaggactcttgcttcaacctcaaatagtgatatttctttgttcgtttcacaattgccggtgtttttatctgaggaggcttcagatttccttatgaatgttgctgaatctactttgttttgattttccaactctttaactcgctcttgaagttgttttgtgcaattgacagcttcacgaagcacataagccttgtccatcttcttgagcccaggaatagttgctgaaagtgctataatgctccctgtcagttcctgcctccttttcctctcagcaattatgtgatgccgtgtctcacatgaccttctaaccttcttctttggttgggtttggggcatcaatgcatcaaactcgagctggtgc

SEQ ID NO: 1268 - DNA, 1285 bp, Glycine max
gctaaaatgggtttctattttggtaataggagattcgatcaatataaatatatatatatagatatatatatatatatatatatatatgattatatacgttatgtacaggcccgtccgagtcatggctaaaatgggtttctattttggacactaatgactatcatttattcagtgaatatgacatgaactctgtcgaggaacaattggagggagagaattcagtggatcctggtgaactctcatgggaaaatcactcttattcatatctcactaaagaaagcaccacccttttgagcaattcttcatctttggaagagatcaacactggctttgatatgacaagtctcaaacaagatgcttctccacagaaaccgaagtcttgcattctgtcttttgaggattccactttagtgccaattaatcccaagaaaacatgccaaatatatgatcatggtgaacattcaaaggagacacaagaaaagccacacaatagaaaacccctcaagaggggtagacgcttttctcagacacttgatcacatattggctgaaagaaaaaggagagagaatatcagcagaatgttcatagctctttcagcacttattccagacttgaaaaagatggacaaggcttctgtccttagcaacgctatagagtatgtgaaatatcttcagcagcatgtgaaagatttggaacaagagaacaagaagagaaagacggaatccttaggatgtttcaaaataaacaaaacctgtgatgataaacctataaagaaatgtcctaaagttgaagcaagagtctcaggaaaagatgttctcatcagagtaacgtgtgagaagcaaaaggacattgtacttaagctactggccaagcttgaagctcataatctctgcatagtgtgtagcaatgtcttaccttttgggaattccgctctcagcattaccagcattgctatgatggaccatgaattcagcatgacagtggacacgtacgacctagtgaaaatgttgactgaggaattgttggagtgctgtaaattgcaacgataatgagccacgctaacgaattggctaccagtaaatttaaaagtgcattttaagcagttcaagcattttatttggtgtccctattagataattaatattggcagtatcttcatatattatgcatttggtgtgcataatagttgtctttttggccatcttcacaaataatcatcatttttatggcaaaataaaatgattttgtgatttcacattttgtgcattttcaatatttttatatt

SEQ ID NO: 1269 - DNA, 784 bp, Glycine max
  misc_feature (632)..(632): n is a, c, g, or t
cccacgcgtccgcccccgcgcccgtggatcgatcgagtttcaatttcctctattatctttgttgctttccatgtaaccccacctcttatccatatatatccattcttcttcctcacacttgtttaatttgcacaaatatattatactccaaataaaccgtctcataatggaggagtcaggggaaaattggccttccgataattcttatctggatgaggtcaacgatgaatttggtagtgaagatgaagagggaggttcattttctggaatgggcgagaccgacagaaagaagagaaagcgagaactcgcagagaggttccttgcactttcagccaccatacctggcttcaccaagacggacaagacttcaatcctggccaatgctagtagctatgtgaaacaacttcagcaacgtgtgagggagctagagcaagaagttcaatccaacgtttctagcaatgaaggtgccaccagctcttgcgaagtgaactcatccaatgattattactctggtggtggaccaaatgaaattcttcccgaggtcaaagtaagagtgttacagaaggacgttctcatcataatccactgtgagaaacagaagggcatcatgctcaaaatactttcccagcttngaaaatgttaatctcttctgtagtcaacggtagcgtcttgcgatttgggaaaatcactctcgacactcacccattatgcctaaggtttatttataatttttttatcgaccaatgttaattattttttttgttaaatggaaagaattcccacc

SEQ ID NO: 1270 - DNA, 683 bp, Glycine max
  misc_feature (10)..(13): n is a, c, g, or t
  misc_feature (674)..(675): n is a, c, g, or t
  misc_feature (681)..(682): n is a, c, g, or t
gggaaaattnnnnttccgataattcttatctggatgaggtcaacgatgaatttggtagtgaagatgaagagggaggttcattttctggaatgggcgagaccgacagaaagaagagaaagcgagaactcgcagagaggttccttgcactttcagccaccatacctggcttcaccaagacggacaagacttcaatcctggccaatgctagtagctatgtgaaacaacttcagcaacgtgtgagggagctagagcaagaagttcaatccaacgtttctagcaatgaaggtgccaccagctcttgcgaagtgaactcatccaatgattattactctggtggtggaccaaatgaaattcttcccgaggtcaaagtaagagtgttacagaaggacgttctcatcataatccactgtgagaaacagaagggcatcatgctcaaaatactttcccagcttgaaaatgttaatctctctgtagtcaacagtagcgtcttgcgatgtgggaaaatcactctcgacatcaccattatggctaagatgggtgacggttacaagatgacggtggatgaactagtgaagaccctgagagtagcgatatcttgatgactcattagctagcctgtcctaatgtacctaccaagcaagtgcagtattaattgtaatttgagaaaaagctannaatgannc

SEQ ID NO: 1271 - DNA, 933 bp, Oryza sativa
agctcagccagcgcttcatcgccctctccaagatcgtccctggcctcaagaagatggacaaggcgtcggtgctgggcgacgcgatcaagtacgtgaagcagctgcaggaccaggtgaaggggctggaggaggaggcgcggcggcggccggtggaggcggcggtgctggtgaagaagtcccagctgtccgccgacgacgacgacggctcgtcctgcgacgagaacttcgacggcggcgaggccaccgccgggctgccggagatcgaggcccgcgtgtcggagcgcaccgtgctggtcaagatccactgcgagaaccgcaagggcgccctcatcaccgccctctccgaggtcgagaccatcggcctcaccatcatgaacaccaatgtgctccccttcacctcctcctccctcgacatcaccatcatggccaccgctggagagaacttctcattatcagtcaaagatatcgtcaagaagctaaatcaagcattcaagttatccctgtgaaggacttgctttcctgatcaagtctaatctagatcaaatctttggttggtaatcttcctactacctttttatcattagccttgagagaaatctgaggctgatggttctaattaggtcctttccctgcttctgcttctgaagagagtttgcttgcaatccaccacagagcacaccccctcaaggatttagccattaaccacctgtttttgctgcatgggtgcagagaatttgcagattacctaaatatccacctacaagtcttctattttctctcccatcacatttttttgcatggattgagctagtcactccatgttcttgggagagggtagaaatgtaaaaaagagacctgtctttttctagggcctgtttatcaaggggagtttgactttttcaaaaaaaccttattttcatttctccccttctg

SEQ ID NO: 1272 - protein, 338 aa, Oryza sativa
MDDSSFFMQWAMDTLHQLPSDSTAAAAYATDVAGDSGAFPSLQALRNASAAGGGGGFRDLTVQVDQVHRANSWSSSDSPGGGAATAAAGWSPHVTGGGGRGHRPMSWNFSAASAQPTTEDSGGGGGGGVVPAPLQAMETTATARAAVKKGGGGGSSSSAAAPGYVQDHIIAERRRREKINQRFIELSTVIPGLKKMDKATILGDAVKYVKELQEKVKTLEEEDGGGRPAAMVVRKSSCSGRQSAAGDGDGEGRVPEIEVRVWERSVLVRVQCGNSRGLLVRLLSEVEELRLGITHTSVMPFPASTVIITITAKASSLSNHPALLCLYICIKLPCVISS

SEQ ID NO: 1273 - protein, 361 aa, Oryza sativa
MAYSTNQIMILQHAWMLVGEANSQLIISTVAHSWYQSNSIEVVLWWFWSRIAQTPTEYGFFGQAMACRTDEENDDDPRALEHLDPLSMQQLAESLANELFNQPQEQQEEQHGYHNPSLRVLPFVGDINKPEGHTPAAAAIRDSFFSLTNGSSSSLNFSALEQQQDSGPMTKFCSPLSEMKRGGRRATSSMQEHVIAERKRREKMHQQFTTLASIVPEITKTDKVSVLGSTIEYVHHLRERVKILQDIQSMGSTQPPISDARSRAGSGDDEDDDGNNNEVEIKVEANLQGTTVLLRVVCPEKKGVLIKLLTELEKLGLSTMNTNVVPFADSSLNITITAQIDNASCTTVELVKNLKSTLRNF

SEQ ID NO: 1274 - protein, 322 aa, Oryza sativa
MSTLSNKVSLSSNLLNLQTGLAEEPEELTYMYHQEEHARMQEQFAGTPLVEQPVRFDQFYPASMAPNQFHPSHCSSFPAFGGSSALPSLAFGAVATTKKEQVQQPSPSSSNVLSFAGQVQGSTTTLDFSGRGWQQDDGVGVFQQPPERRSRPPANAQEHVIAERKRREKLQQQFVALATIVPGLKKTDKISLLGSTIDYVKQLEEKVKALEEGSRRTAEPTTAFESKCRITVDDDDGGSASSGTDDGSSSSSSPTVEASIHGNTVLLKICCKERRGLLVMILSELEKQGLSIINTSVVPFTDSCLNITITAKARLALPVYYS

SEQ ID NO: 1275 - protein, 353 aa, Oryza sativa
MEDSSLFMEWAMETLQHLHPLPATPPPAGGGYAGDNATFPSLQALRESSVSQNGMAPPEPTAHEGHRASNSWSSGDTDSVSGGGGGAVMEHDGWSTSPNSVRCAAGGGGGGGGGGLWPVSWNFSSAMTQPCNDQATPSNPPTTTRARYGGGGVRYLPAAVSPSPSAQTRRASSKGNGGGGSGSSSAAPYAQEHIIAERKRREKINQRFIELSTVIPGLKKMDKATILSDAVRYVKEMQEKLSELEQHQNGGVESAILLKKPCIATSSSDGGCPAASSAVAGSSSSGTARSSLPEIEAKISHGNVMVRIHGENNGKGSLVRLLAAVEGLHLGITHTNVMPFSACTAIITIMAKE

SEQ ID NO: 1276 - protein, 254 aa, Oryza sativa
MDDSSLFLHWAVSTLQHQHPAAVAVVADDDATFFSFQELCDTEEVVVVPVQEEVITEAHGAAERRRRWRRAGDGVRVTAGGRGIHHQEDLGAHGGAAAAYAQLEHVVAERKRREKINQRFMELSAVIPKLKKMDKATILSDAASYIRELQEKLKALEEQAAARVTEAAMATPSPARAMNHLPVPPEIEVRCSPTNNVVMVRIHCENGEGVIVRILAEVEEIHLRIINANVMPFLDQGATMIITIAAKASSSLLY

SEQ ID NO: 1277 - DNA, 904 bp, Zea mays
  misc_feature (770)..(770): n is a, c, g, or t
tcgaggccggccgggccgggagacaaccccggccgtcagctggcaaaatggaggactcgagcctgttcctgcagtgggcgatgagcacgctgcggcatgagcaacaacccgcggcagccgtcaacgacgactgcagcagcgaggcaacgttcccctcactccaagcgctccgcgaggcctcgcatgcggccgagatggtccaggagctgatcggagaagccccagcgaacagctggagctcgggcgacaccaccgacggcagcataggaggcaacagcaactcggtccctggccctgctgcggcggccatggagcacgatgtctggcctgctgcgtcgtcgaagacctctccggccaggcgcgccttgagcaggagcagcagcgacaccaaccctcccgtgagctggaacttcagcgccgcagcctcggcacagctggccggcagcgccgacggcatgctgccggaattcgcccccaagagcgccctaccgccggaccaagcgtacggatcaccgcgggcaaggagagccggcttgaagagcctggcgggatccatgtcgtcggcggcgtacgctcaagaccacatcatcgcggagcggaagcggagggagaagatcaaccagcggttcatcgagctctccaccgtgatcccaggcctcaagaagatggacaaggcaacgatcctttcagacgcgaccaagtatgtgaaagaactccatggaaagctcagggacctgggaggctggcggcagcaaccggcgcaagagcantcgagacggtggtgctcgtcaaaaggccgtgccctcatgctgcgcccgcgccggacgacgatgccctcccattgtcagcgtcgtcaggcacgccggctgagacgaagacgcagctgccggagatcgaggcccgg

SEQ ID NO: 1278 - DNA, 1547 bp, Zea mays
gctcccccgaggactactcctcgccgtctcatcctctccttcggcggccaccacgccagggcgcccaagcaggagctgctcgacgccgccgccgccgcgctgccgtcgttccagcaggcgcgcccggcgcccaagcgctcctacgacgacatgatggccgaggccgccagggcgcctgccgccgccgccgccgccgcacgcccggcctcacagaaccaggaccacatcttggccgagcggaagcgccgcgagaagctcagccagcgcttcatcgcgctctccaagatcgtcccgggcctcaagaagatggacaaggcatccgtgctcggcgacgcgatcaagtacgtgaagcagctgcaggaccaggtgaaggggctggaggatgacgcccggaggcgcccggtggaggcggcggtgctggtcaagaagtcgcagctgtccgccgacgacgacgagggctcctcctgcgacgacaactccgtgggcgccgaggcctccgccacgcttctgccggagatcgaggcccggctgtcgggccgcacggtgctggtgagggtccactgcgacaaccgcaagggggtgctcatcgccgccctctccgaggtggagcgcctcggcctctccgtcatgaacaccaatgtgctccccttcaccgcctcctccctcgacatcaccatcatggccatggctggtgacgacttctgcttgtctgcaaaggatattgtcaagaagctaaatcaagcattcaaatcacccttctgatgggattagcttaatctatgtcaacttttttcccattagccttaaggctttcgcccgcagcggttcggcatcaggtccttccttgcctttgcttccgaagagagttgcttgcagtccccaagagtccccccacacaaagatagccatttccactggttttttgctacatgggtgcagagattgatcacctagctagttacctacttaccatcccattttatctgtctctccagttttttacatggtttgatgttgtcactccatgtttttgggagagagcagattgtaaaaaaaaaacagcctttttttctagggctttgctatataggcctggggagtttgacttttacaaacctaatttttctttctccccttcgcccgtatgttgccctttaattcaccttgttttttccatgagaggatggtgtttttcaaacaccagcacctaccttcgccgtcctctcaaccttgatcacactgctcccagaaaaagcttcagttgtggagaaaatggcgccgtctttttttttaatcagctctgagggggactttgcaagccttgatttggaagtactgtagggatgcctcacttctattgtttctgttttttttgagggtcctacaagttggccgccacttgaaacttgatggagcctttgcctatagttttcacatgtgagttttgttgtcacaggacaggatgaaggtgtagttgttgtcatctcttgtttactctcatacaagcataaataaataaatgtgctcgtttggtaccttggcaccaa

SEQ ID NO: 1279 - protein, 210 aa, Oryza sativa
MEAPPSLSIVDEDGFVIDLSLTLGLTSPPPSPGGASPSIPPGRGGGGGTSGGDNNRGSRGGGNGGGGGGVRLFPCLFCNKKFLKSQALGGHQNAHKKERSVGWNTHLYLPAGVAAATTTTTTTTAMAVPDMVGMPTHQMSSMALHSCRPHQGSHVTAADIATLAAPPHYTVDHGVAGIASGGGDSSVGWRQRQREAGGEKQRQVDLNLKL

SEQ ID NO: 1280 - DNA, 2169 bp, Glycine max
ggctcgagaaaagatagagcaaggaactcataaaagtgggaggaatgtggggttgaaagcttatgttgtgtgccaagtgcttgagattgttgtcaaaaaggaaataaaacaagctgaaataaaatctacacaagtcaaaatcaggaggttcttccgaccagaagatttatcaaatgagaaggcatattgctctgatatacgagaggtgtattacagtgatgaaacatatataatctctgtagaatccatagaagggaaatgtcaagtcagaaaaaagaatgatattcccgaatgcagtgctcttggtggaatcttccaaaatgtttttttctgcgagctcttgtatgatcctgccactgggtcactgaagaagttgccggctaatataaaagtaaaatattcaagtggacaaacatctgatgctgcagctagaaagaggaaaggaaaatgtatagagggagatggtgtttcagagtccacaaaggaaggaaaaacattaaatgataaacgtttagcaaccttggacatttttgcaggctgtggtggcttatcagaggggttgcagcagtcaggagtttcatcaactaaatgggctattgagtatgaagaaccagccggggatgcatttaaagctaatcatcctgaggcattggtgttcattaacaattgcaatgttattcttagggctgtaatggagaagtgtggggacacagatgattgtatctcaacatctgaggctgcagaattggctgcaaagcttgatgagaaggaaataagtagtttaccaatgcctggacaagttgatttcattaatggtggtcctccatgccagggtttctctgggatgaataggtttaaccagagcagttggagtaaagtccagtgtgagatgatattggcattcttatcctttgctgattatttccggccaaggtatttcttgttggagaatgtgaggaactttgtgtctttcaataaaggacagacattccgtttaactttggcttcacttcttgagatgggctatcaggtgaggtttggtatccttgaggctggagcatttggggtttctcagtcaagaaaaagggcattcatatgggctgcttctcctgaggatgtgcttcctgaatggccagaaccagtgcacgtcttttcggcccctgagttgaagatcacattatcagaaaatgtccagtatgctgctgtccgcagtactgcaaatggtgctcctttacgtgcaataactgttcaagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaatgaattgaacttgattcgatgccagaaaattcccaagagaccagcacctggtctcttggcgtgaccttccagaagaaaagataaaactgtctagtggacaagttgttgatttgataccatggtgcttgccaaacacggctaagcggcacaatcaatggaagggactgtttggcaggttggattggcaaggaaatttcccaacttccgttacagaccctcagccaatggggaaggttggaatgtgcttccaccctgaccaagataggattcttactgttcgtgaatgtgctcggtctcaaggcttcccagatagctatgaatttgctggcaatatcatacacaagcaccggcagattggtaatgctgtgcctcctcctctagcatcagcattggggagaaagctcaaggaagcagtggacagtaagagctccacttagaagatgggccttctacattaggtcatgcttattgtattcataacagtcaccaagatattgcaaatcatcattccgggttccaaaaactagaaacccttgtatatagtgatatccattggtcatttgttgaggctaattccttgtttaactttcctcaaccaaggaattgaatggatgatgctcattttctatcaactaggattttcttgattagatggtattttggctgtttatgaaagaaatggttgggaattgattacctcccaatgtgtagttgaaaattgagaccaattttttttaacctgttatgaatatttgttgttgccactatttggct

SEQ ID NO: 1281 - DNA, 851 bp, Glycine max
agcggattgaaaatggcttggtttgtgttctgttgcaaatatttttttcagtgactcagaatatcacgatgaagttctaattttgcccaagaaatgagcaatttttcatacagtatgataaacaaatatagacggtagattaaaaaaacaaaacattcacctatctatgatacacaaactataccttcctaagtttaattaacagtacactcaacagatcaatcaatacaaataatcaacaaaagtagttggctttccaatcttcaaaaactccaaatcattctcaaagggtgtcagattcaaatccaaaaccaaaactctcttgttgtcagctttcttcttgggcgatgaatcaaaactgctacccccactactactactcgtagccgtagcagaattgtacacgttgtttccattcaaattcgccgctctgtgcctcctcatgtggcctcccaaggcttgccctatagcaaactccaacccacaaatggaacactcatgagtcttaggctttgggggtgaatcatgaagcaattggccttcgatattatctcctgccatcaacctaggctttttgtggctagccctgtggccaccaagtgcttgaaatgaagggaattgcctattacatgtcttgcactcaaagacacgattgctcatagaagtgcttgagtaggtggcctcaaattcacttccacgagaaagcaacatcaaacaattcgccatggttaagctatcaacctctctttctctcttcatgacaactaaccaaaacaaaaattgaaatatggccgggtgcttggttttaaggtgtggaaaatgaatatgtgaatgtatgaaaagggacaaag

SEQ ID NO: 1282 - DNA, 803 bp, Glycine max
gtcgacccacgcgtccgtacggctgcgagaagacgacagaaggggagggcacttctccaatctcaacaactttcgtgtagtgcactgttttgctatagtaacccattaattaaaccgacctacgtagtagccatgaagagaggcagagaagagagtaagttagacatggctaattgcttgatgctattgacgaaagttggagagagtgaaaccaattacccaatatcaaagggtagtgatattggtgatttcaagtgcaagacttgcaatagaaggttctcttcttttcaagcccttggtggccatagagcaagccacaaaaaaccaaagctcatggtcacagatctttcgtgccatcaagagttaccgaacccaaccatgaaacaacaacctaggatgcacccgtgtccgatttgtgggcttgagtttgctattggacaagctttgggagggcacatgagaaagcatagaactgctattaatgatggcttgttgtgtggtaaaccttcttcttcgttgtccatcttgaaggaatcatcgaaagatggtgatcaaaagttgaatttgcgcttggacttgaacttgacgccattggaggaggatgatcttaagctcaacctaaggacgcccgtgctcaattgtttcatttgattggaaattaattttgtactaaaccagattctttttttcttattaatatagttaatgtgtatttttcgtaatttattattatacgtacgacctataggtagctcattttgtagtcatattgtgttcataatacgaaacttcttagttcttat

SEQ ID NO: 1283 - DNA, 924 bp, Glycine max
tgccgcccccgcggccctgcttccccattagagaacattttaccaattgagcactttcaaacaacgttgttgttttttgtacacaaccatcagagataaggagagtgaggtgggcatggctagttgtttaatgttactaaccaaagttagtgataccgaaaccccatcaagaaagagggttctaagtggtggtgattttaagtgcaagacttgtaacaggaaattccaatcgtttcaagcacttggggggcaccgagccagccacaagaagctaaagctcatggcttcaaacctttcgtgttcgaccgtgacacaaaagatgcaccagtgccccatttgtggaattgaatttgcgattggacaagcactgggagggcacatgagaaaacatagagcttccttaaacgatggtttgataactcatgatcatgttgtgccaacatctattggtactaaaaggcttcgcttgtgcttggacttgaacttggcaccgtacgagaatgatctcaacctcaatttaaggacacctactttaaatttgttcgtttgatcgatttgagtgttttttgggcgaattcttgttggaaattgttttatttttattttttgtttcttactttgccgtgctttttagtttatgacgtacgcgtgattctatagggttctatgtatattcatggtgctaacttgaaagtacagggaaaattttgctgactaccgttaagcaaagcatattaagcatactatcatggctcttttcaggaacatgttttgaaaagtcactttcaatatgaaggattcagttactgttagttgagggtagtaattattggttggatctgttatgatagataccattaactgtgagattaaaaacaaaatagaattgcccacacttatctttgtctaaaaaaaaaaaaaaag

SEQ ID NO: 1284 - DNA, 530 bp, Oryza sativa
ggcgcgtgcaccgccgcggcggcggcggcggcctcctcgcggtggcggcgcatgtggccgccgagcgcctggcccatctcgaagccttggccgcagatgtggcactcgtgggtcgccgccgccgccggcttctcctgcaccttcttggtggtctccttggccgtggcggcggcgaggccgagcgcgagcccgtggcggccgcgcaggtggctggtccggtggccgcccagcgcctggaacgacgggaacgcgcggctgcacgtcttgcagacgaagtccccactcccggacgccgccggcgacgacccgcgccgcggcttcttccgctcgccgctatccgcggcagcgccgagcgtgagcgacagcgagaggctgatcacctcgccgtccctcggatgcttggtcatggtcaagaaagaaaccgaacgaactggagatcgatcgaacacaagatgatcgacgagacgagttttagctagctagcttctgactcgatcgagagaatggttaatattgctcctcgtgccccg

SEQ ID NO: 1285 - DNA, 881 bp, Oryza sativa
gcaaactaaggctaggctcgccgcgagaggaaggtaagtaagtacgtacatttgcgcgaggtggacgagcttgacgatggcgagtgggcaacgagcggtcggcgaggggagcggtggcctccgcccgacgacgcacgtcgcgggcggcggcgggagcgcgcgcggggagtatttcaggtgcaagacgtgcagcaagacgttcacgtcgttccaggcgctcggcgggcaccggacggggcacacgcggatggcggcgcggcagcggcaggagcacggcgccgcgggggccgccgtcgtgggggctaccaacaaccagcggcgggtggtttccgcccaccagtggcacctgtgcgccgtgtgcggggtcgagttccgcatggggcaggcgctcggcgggcacacgcggcgcgcacagaggcgaggcgccaccggccaccccccccccggcggctgcggctgcgagcgccggccccgtgtccagcatggagcccccggagatgatcgacttgaacagcccgccggcggtcgaggaggccggtgaaggtgatcaggaggttgagcgtgcggaacaggagccccatctgcttaatctgctcgtgtggggtggtgttctctgtttggtgattgtgtgcgcgcggttgcgtttccaaggccattctagtgggcccaaggaagttataaaataaagtggggccaaggatctcgatccgtcttaaaaaaaacttaatttagtaattggataggacaaaaaatggatatcccccccccttgtattagattatgtcctatccaagtactaggttgagttttttttggccggagggagtatgtagtataatatgtttgtgcattttccgtgtaaaaaaaaaaagtgccctagc

SEQ ID NO: 1286 - DNA, 760 bp, Oryza sativa
ggtcaccctgcggggcccggcgcgggtatcgatctgcccccaaccaaaaatctctctctcaatccattgatccattaattcacaagcttatcgaatcggagatgaagcacccgaggcaggaggaggaggtgtcgctggcgctggcgctgagcacggactgctcgtcgacggcgtcggactcgtcggcggcggcggcgggcggcgcggcgaggaggaagagggcgcggcggaggagcgtggtggcgacgtcgggggaaggggagttcgtgtgcaagacttgcagccgcgcgttcccgaccttccaggcgctcgggggccaccggaccagccacctccgcggccggagcaacgggctcgacctcggcgccatcggcgacaaggcgatcaggctgcacagggcggccgacaaggagcacagggacaagcacgagtgccacatctgcggcctcggcttcgagatgggccaggcgctcggcggacacatgcggcgccaccgcgaggagatggccgccgccggcggtggatcctccgccgacgactgggtctggcgctgcgacgcgcggccggaggggatcgccgccgagccaccggtgttgctggagttgttcgcctagttaccgctggtctccattagtttcgtccaagttttgaactgacgcagtgtgtgtcaccattaattagttcatgtacatggtctagaaaaaaaagtcaggttcattcgatcttgtaactatgaataggggtttaatttttttttttc

SEQ ID NO: 1287 - protein, 198 aa, Oryza sativa
MKRFAFEDSDMARVLMLMSSHGQQEQALALPVPVQLPLAAARGDRAPERAFVCKTCNRVFPSFQALGGHRASHKKPRLDGDGDLSLSKPKLHGCSICGLEFAIGQALGGHMRRHRAMTGGMPRAIVVDKKPDVVDVHVHGHDDDGGIKRGGLWLDLNHPPCDDAGDDDAECGHNAAGAGITFHQFLDTGAMAVDCVGY

SEQ ID NO: 1288 - protein, 187 aa, Oryza sativa
MSVASPSPSWQTPYRIGDEAPEAGGGGVAGAGAEHGLLVTASDSSAAAAGGAARRKRARRRSVVATSGEGEFVCKTCSRAFPTFQALGGHRTSHLRGRSNGLDLGAIGDKAIRLHRAADKEHRDKHECHICGLGFEMGQALGGHMRRHREEMAAAGGGSSADDWVWRCDARPEGIAAEPPVLLELFA

SEQ ID NO: 1289 - protein, 186 aa, Oryza sativa
MKRLTFGAEPEMVDSASIAQEVMLLLARSGGGGAGYVVGHGGEAPRVFECKTCRRRFPSFQALGGHRASHKRPRGGGGGGAAAAVAAAAGEGEAGVALSLAAGTPAVKASRAHGCAVCGVEFALGQALGGHMRRHRIAGAEADEAVSARGGEPAPERNPREARGVVGLDLNAAPADDTGLLLVDCL

SEQ ID NO: 1290 - protein, 206 aa, Oryza sativa
MSKRQFGEMDGGIDTARVLMLLSRRRRQHGDVGHARAARVFECRTCGRRFPTFQALGGHRASHKRPRHGAERAPRPAGDDDVGAGAGAALRLVGAASSLSTDEARAGGGGRRTRGAGAAHGCPVCGLEFAVGQALGGHMRRHRAAAGDVAAPRVKTDDVVVGDECTGGICLDLNLTPSENCDKCRHAQLGVAVNSVQRTILLDRPL

SEQ ID NO: 1291 - protein, 217 aa, Oryza sativa
MSKRSRSMWDMQEFVGSVDTARVLMLLAQQSQHGLLGGGGFAAGAQPVVVRGGAHDRVFECKTCNRQFPTFQALGGHRASHKRPRQQQQHALGGGAGADDAGLCLGRQPTPPRPQPAKPRVHECPVCGLEFPIGQALGGHMRRHRAEAEAAATTTTTTTKNGDVGKAAAVKACDGGGVCLDLNLTPSENRAKCRNVVGLGAGGQGVHKALAMLDCFL

SEQ ID NO: 1292 - protein, 159 aa, Oryza sativa
MESLRVHASALLSLSSPAASASQPTSSSSTTEGVFECKTCSKRFPSFQALGGHRTSHTRLQAKLLSDPAAAAAAAAERDRARVHECAVCGVEFSMGQALGGHMRRHRGETGTTTVVLADADDSGGATVPQPPEPMPDLNYPPLEDAGDGSEPELLNLLV

SEQ ID NO: 1293 - DNA, 568 bp, Zea mays
ccccgcgtccgccaagtctcaccgccgtctctctcccagtcccaaatcttgagctcgatcgcaaaccctcagacacttcttcccccagccgacgtacatgaagcacccgagagacgccggcgccatgccgctctccctcgcgctgtccctcggcgccggcgtggcccccgggcacggcagcagcaagcggccccggcgcgcggcgggcggcggggacggcgagttggtctgcaagacgtgcagccgcgccttcgtctcgttccaggcgctgggcgggcaccggacaagccacctgagggccggccggcacggccttgcgctcgggatgcccgcgccggcgccggcgaaggaggcgccgccgcccgcgacgacccacctgtgccacgtctgcgggctcggcttccagatgggccaggcgctaggcggccacatgcggcgccaccgcgaggaggctgccgccaccaccgcgcaggcgccgcccgtcctcctccagctcttcgtgtagagttttgcccgtccacggagtctagctagtagaaggaattcttcgcgttccctgtcgtcactc

SEQ ID NO: 1294 - DNA, 1503 bp, Zea mays
acccacgcctccccccacgcccccggcacaaaacacatcaccgcatctttttccttccgagctgtacgtatctgcagagagagagagagagagagagagagagagaaagattaggtcagagaccatgaagcacccgaggccgacggagcaggatgtgtcgctggcgctgtcgctgagcacggactcgtccacgacgacgtccgactcggcggggacgccaccggcgaagcgggcgcgggcgcgggcgcggcggcggggcgccgtggtggccacgtcgggggagggcgagttcgtctgcaggacctgcagccgcgccttcccctcgttccaggcgctgggcggccaccgcaccagccacctgcgcgcgggccgccacggcctcgacctcggcgtcgtcggcgcccgggcgctcaagcagcacaagcagcaggccgccaacgccaacgccaacggctgcgaaggaggcaataagcagcagcggcggcacgagtgcaacgtctgcgggctcggcttcgagatgggccaggcgctgggcggccacatgcggaggcaccgcgaggaggagatgggcgccgccgacgcctgggtcaccctctggcgcaccgaggcgtcgcgcgccgccgacccgcccgtcttgctcgagctcttcgcttagatgattagatcgatccggccggcatcgggtcgggctaatccctccttgttatttggggggaggctaactcgtcatctagacatctagtagcgtcggtagtttaatccaggacatgtaaatcgtattggttcgttcgttgccttttttttgtaattacgctagtatagtactagcttctgctgtgtttagcggttcggtcatggggccggttggattcaaaaaaaaaaaaaaaaaaaaaaaaaaaaaaaaaaaaaaaaaaaaaaaaaaaaaaaaaaaaaaaaaaaaaaaaaaaaaaaaaaatggcaacgaccctttaaaaagatatcagagtttccgtggggcgcccccctctgttctttcccttttccccccccccccccccgtgccgccttctctttttcccttttttgcccccctttttactttttccccccccccgccttttccccccctttgccccgttggccccccctcccccccccccccctttcgcctcttcccccctttcccccccttttcacccgcgctttttaacagcacatgccccccccctgtgctcccttccccccccttttggtcccctttttggtaccgggcccccccccttcccccccccccacccccccccctttttttatagcccccctcccccggtcttttccctttttttcccccccctttgccccccccttttggggttttttcccctccgctttccggccccctgggccccctttttcccgcctatagtttttaagcttgggcgccccctttccgcctacactattttatgggttttgccccccttcccccccccgatacccctggttggtgggatcgcgggtccc

SEQ ID NO: 1295 - DNA, 499 bp, Zea mays
ccacgcgtcccactgcggcctgctgctttcacctccctctccctctcgggctctctcctaacatctcgagctcgatcgcaagccctcaccccctcagacactccttccccaccaccgacatacgtacatgaagcacccgagagacgccggcgccgtgccgctctccctcgcgctgtccctgggcggcggcggtggcgtggccaccaagcacggcatcagcaagaagccccggcgcgcggcgggcggcgagttcgtctgcaagacgtgcagccgcgccttcgggtcgttccaggcgctgggcgggcaccgcaccagccacctgcgggcccgccacggcctcgcgctcggcgtgcccgccgccgcgccggcgaaggaggataccgcgacgaagccggcagcggcggaacccgcgcccgcgagccacctgtgccacgtctgcggcctcggcttcgacatgggccaggcgctcggcggacacatgcgccgccaccgcgaggaa

SEQ ID NO: 1296 - DNA, 798 bp, Zea mays
gtcagcaaacttccgtcgatctctctcgatggtcatgacgcttacgagacacgactcgggagagagcaaggagatggagggcctccgtgcgcactccgaggccgcgctgctcacgctgtcgtcgacgacgacgggcggcaccggcaccggcaccggcaccggcacggccgcggcggcggagggcgcgttcgagtgcaagacgtgcagcaagcggttcccgtcgttccaggcgctgggcgggcaccgcaccagccacacgcggctgcaggcgcggacgctcgtcggcgacccggccgagcggtacgacgacaggccggcggcgcgggtgcacgagtgcgccgtctgcggcctcgagttctccatgggccaggcgctcggcggccacatgcgccgccacaggggcgagggcccgccgccaccggccgcgcacgacgacgacggcgacggccccgcccagccggaccgggacatgcccgacctcaacctgccgccgttggacgacgacgatggcagccaagcaggttcacggcagtcgggcggtggtcgcggctccgggcctcagctgctcaacctgctcgtatagcgtgcgtggcgtgcacagattgtggttcggatcgagatgtaaatgaatcgtggcttagattttggaacctactacacgtgagatggaattcttcgatgacgagcttatttagttccataggttgttcctggttttagttggtttgctccttcgtgtaatgcctattgttcggttcaattcatttgttgtgagtaaaatatactctcacattagac

SEQ ID NO: 1297 - DNA, 570 bp, Zea mays
acaccacctgcgcatcttctttccgagcagtacgtacgtagctgaattgctgaaaagagaggcagagatccgatccggaccgcgaagagacgatgactcacccgaggccggatcatgaaccgtcgggcgaggtgtcgctggcgctggcgctgagcacggactcgtccggctccgcgggtgccccggcggcgaagcgggcgcggcggaggggcgccgcggcggccacgtcgggggagggggagttcgtgtgcaggacctgcagccgcgccttcacctcgttccaggcgctcggcggccaccggaccagccacctgcggggccgccacggcctcgagctcggcgtcggcgccagggcgctcagccggcagcagcacaagcatcatcagcaggccggcggcggcggcggcggcggcggcggcggaggaggaggtggagacagggagccgcaggcgcagcacgagtgccacgtctgtgggctcggcttcgagatggggcaggcgctgggcggacacatgaggcggcaccgcgaggagacgacgacgggcgccgccgacgcctgggtctggggcg

SEQ ID NO: 1298 - DNA, 788 bp, Zea mays
  misc_feature (646)..(646): n is a, c, g, or t
  misc_feature (693)..(693): n is a, c, g, or t
gattcacccgcttccgagaaagaattaatagcactcgatcgatcgggctcaccacgtccagctctcggtcctcgtctttgctgctagcagctagctagcttcgcgatcgtgctcaagatcaacgacgatccatggcgtatggcaagaggtcacgccagaaggccgaggagatggtctggctgcccgacggcgccgatgtcgcgcgcttcctgctgctcttctcgggccaccagcactaccacggcgacggcatggcggcctcggcgcccgagcgggtgttcgagtgcaagacctgcaaccggcagttcccgtccttccaggcgctgggtggccaccgggccagccacaagaagccccgtctctcggacggcgtcgatgccgcagcggccgagccgcccaagcccaaggtgcacggctgctccatttgcggcctcgagttcgccatcggccaggcgctcggcgggcacatgcgccgccaccgggctgccgatcagacagacggcggcagcctcggcaccgggctcaccccgaaatacgacagcggcaagacggccgcatcgccggccgagctggttctggaccttaacgccgtgccggagctggagggggagcaggatcacgccaagctggagctctccatcgaatntcccgtagcagtagttgactttcacgcacgctaagaaataacgtggnaatagattgaatccttctcggtttcatttttccattattatttacataaattacaaaaatacacattaatcaaaaaaaaaaaaaaaaaggcccct

SEQ ID NO: 1299 - DNA, 1132 bp, Zea mays
gtaggccgcgaacctttttcccattatctaaaaaatctatctccaagccatgaactgcaaaagtcagaagaagcagctgagtcagtaacaataacaagtaatcctgatctgattcccagcagaagcttctttctgtccctccaacggaatctgtccatggttcatcaaccatgcgtgctgccgtggcacggcgtcgactcggcgcgaatcgacgccgtctgcacttgcctctgtgcccaatcatcgtcgctactgcacgccgtagctgcgaatcgatccacataaaacaactccgtctccagcctagctaatactaacagctatagagctgagtgactgacacccattggcggctggactattagtttatgcttggcgtttgtaatgctcggcctataaatacgcctgctcagtgatctgatgctccggcattcagatatatacagataagattttcttgctagcctcgaatcgcgatcgagtagctcatcagctgattcacaagtgcaagcatttgatgaagaggtttgcagttcaggagagcgagatggcgcgcatgctggtgctcatgtcgcgctcgcacggccaggaccaggcgctgccactgtcggcctgcctcgccggcggccagcaaggcgaggaccggcaggcgccggagcgcgtgttcgtgtgcaagacgtgcaaccgcgtgttcccgtcgttccaggcgctgggcggccaccgcgccagccacaagaagccgcggctggacggggacggcggcggcgacccctcgctcgccaagcccaagctgcacggctgctccgtctgcggcctcgagttcgccatcggccaggccctcggcggccacatgaggcgccaccgcgccatgacgggcggcgtgccggcggtgccgcccgcgacgacgaggatcgtcgtcgacgagaagccggacggcgacgtcgtcggcatcatccgccacgaccacgtccacgaccacggcggcgtcaagcagccccgcggcgggctgtggctcgacctcaactacccgccgtgcgacgacggccgcgacgcgggggaggcggagtgtggccgcaatgccgccgccgccacggggatcacgttccatcaatttcctcgacactgccaccat

SEQ ID NO: 1300 - DNA, 951 bp, Oryza sativa
gtcctccccggcgagctcgccaagcacgccgtctccgagggcaccaaggcggtcaccaagttcaccagcaactagggtttgaggagatgatgctgcgaggtgggcggctgggtggcttggcctctcggatggttggagccccgcctttcagcacggagatatttgtgagcacgtccgcttgtgatgatctgtgcgtcagaacttcatgagtgaatggggtttcttgatctggtgtgattctggggggtgtggtggatgaaatgagcactaaatgggctatcattttacacaacagaggaagaacttaaaaatgtcttctcaccactttggcgctgttgaggaagctcgattggtaagagaaccaaactggaaggcccaaaggatttggttttgttaaatattcttctcaagcagacggagagaaagctgttaaggaaatggatggacggatcattcgtggaagactaatttttgtggaaattgcaaaagaataaaactgcatagggcatagtctatcaccatcgttgctgaactggtgcagttttcctgccttaaaccgtactcgtacatggctaatctggctcagttccaacaagacctatgagcacttctcctgtcctgaatgcgtaattttgtgacttttgttgagcccagtattggtttgcgaacaacattgtttgttttttttttaagacaaaagaaagctttcaaacaggaaaattgttgttggaaggttaggttgaatttatgaacccgggctggaaggttatatgtgcgtagaatgctggatgacccatatacccgcccctgctccactagctatttcttccaccgttttcttctgtgtcatctataaagcgatattgtttgaatttgatctctaaagtattaaagccgtcatctcggtccggtgctctggttttggatggctttgtaccctaaaaaaaaaaa

SEQ ID NO: 1301 - protein, 117 aa, Oryza sativa
VTEDMLAELFGSYCSVVVDCRICGDHSSGLRFAFIEFQDESDAYAALDLDGYVLGICPLRVSPSKTAIMPVNPSFLPQVNVTDLKYFCEEHFGQVFRLKLLGDDGHPTRIAFIEFLR

SEQ ID NO: 1302 - DNA, 2821 bp, Zea mays
  misc_feature (1927)..(1927): n is a, c, g, or t
cattgggtacctcgaggccggccggggaactttccatcgaccttttcccccctaaaaaaacccagcgacgccaaatcagactgccttccggttccccatctcccctccctcagcgcagactcagccatggcttccgccgaaaccctagcccgctccccctcgcgcgagccttcctccgacccgccccgcgccggctcttccgagccccaccacaacggcgccggtgactcgtctcgccgccgccgccgcagccgctgggagcagtctaacgacgactccgccaacaactccggcggcgagggcggggccgtgggccggaagcgcaaaacgcggtgggccgaggaggagccgcgcccagccatcgcgctgccggacttcatgaaggacttcgccgccgagatggaccccgaggtgcacgctctcaacgcgcgcctcctcgacatctcgcgcttgctgcagtcgggcctcccgctcgacgaccggcccgagggcgcgcgctctccgtcccccgagcccgtctacgacaacttcggcatccgcataaacacccgcgaataccgcgccagggagcgcctcaaccgcgagaggcaggatattatctcgcagctcatccgccgcaaccccgccttcaagcccccctccgactaccgcccacccaagctccagaagaaactctacatccccatgaaggagtaccccggctacaactttatcggcctcatcattggccctcgtggcaacacgcagaagcgtatggagaaggagactggtgccaagattgtcattagggggaagggtagtgtcaaggaagggaagtttctgcagaagagggacctcaagccggatcccagtgagaacgaagatctccacgtgcttgttgaggcagagacgcaggaggcactcgatgcggctgctggtatggtggagaagctgctcaccccggtggatgaggtgctcaatgagcacaagcggcagcagctccgggagcttgccgctcttaatggaacaattagggacgacgagttttgtagaacatgtggtgaggctggtcacaggcagtatgcttgccctaacaagatgaacacgtttaagagtgatgtgcagtgcaagatctgtggggatggtgggcacccgactattgattgtccagtcaagggcacttctggtaagaagatggatgatgaataccagaacttcctggctgagcttggtggcggcagtgcacctgagtccatgaacaaatctggtggtccaatgttggctcttacaggaagtggtggtagcggtggtgcttctgctggaacggggagtaacccgccttggtcagccggtggtggtgctgctggcattgggctcaatggtatcaagaaagactatgacgagacaaatctgtatatcggctacctgccacctacaatggatgatgatggattagtcagtctgttttcgcagtttggggagattgtcatggctaaggtgatcaaggatcgaaacaccggacagagcaaaggatatggatttgtcaagtattcagatgtgtcagaggccaatgcagcgattgctgcaatgaacggtcaccatcttgaaggtagagttattgcggttagagttgctggaaagccgccacagccggcaccagcagtgtcagcacccccatcgtatcctcctccggatcctacttcaggtggctattcctcccagtcctacatgggggcaccaccacctcctcctccagggagtgacgctccagttccttggggccagccgccaccctatgcttcatatcctccgccaccaccaggctctggtgtctacagtcctgcaccccctgcaccaggtcaagctgccccacctccgtatgggatgcaatatccaccaccaccaccaccccccagcagctccaatcccctccaccaggcactgctcncatcaagtgatggagctcagaactatccacctggtgtaacaccaccaagttctggctcatccactcaccctgttgcaacatcagtatatgcatcatctggtgcaccaaatgcaccatcgatataccctccaccaccttatagttattcctcatactaccctccaccatttcagccaccacctccaccaccaccaccaccggctagtgttgatccctctcagagtattgcaactgcaccttggctaacccacagtgtggtggtgccaccaccacccacgagtgttgatccttctcagagtatttcaactgcaccttggttaacccacagcgcagtgccgccaccaccaccacctttgtcctccacaaccgaccagtctactgcttcctatggtgccgatgcagagtatgacaagtttatgtcagagatgaagtgatacgagcgaagctggatgattcttccaatgaagggcaaaaggcttgatctttcttggagcttataccaacctgatttatttcttgttggaagtttcggactcacatcttaaccttgctgtgtgctgttgtgaccgttgcagaggttgcatgcttaagaaggcatcaagtattactggctcagctggcatcagaatatttgctcatcttcttggaactattttaaggaatcttttactaatgcttttgttgtgatgtctattcttgttattatttgagattaccctgtgttgtcactttaatgctctgttctttgtgacatgtgttaatctcactttattattcatatatattattcttcatcttgatttggtagtgctagcagtccttttgaaaaaaaaaaaaaaaaaaaaaaaaaaaaaaaaaaaaaaaaaaacaaaaaaaaaaaaaaaaaaaccaacc

SEQ ID NO: 1303 - DNA, 653 bp, Glycine max
aattcgcggccgcagaaattttttttttttttttttttaaaaatgaaatatagcctttttttttattaacttccatttcatttctacacgtctgaaggattgtacaagcaagaatgtccacttgcatgtgctggtagcacatagtggaaacaaattgatcttttaaactttgaaaaattaaagtaaaagagcagatgaagtgtgatctcatgtcttgtatagctgctgagttaaaacatccaaaactgaagtcaaaggggccatgctggttggaagaaagaaactcctccatacccttctttcttatactttcctagctcttttgcctcggatgcccttgctctctgcattgtttccaaagcatctgtctcggaattgaagtcataaaaggtacttgctgcagtaagcttcaaagaaaggaactctacttgatgctgcaaggactgcacatagtttatgatttcatccaacattactgccatacccatggtcttgtaacatcctggaacaatgttctgtaagcaccttaatttctcattgattttccctcttctaaccctttctgctaaactgtgactatcagtagcttgacctcttctggctctgacatgaaccacttcccttgctttctcctcttctgttacattgctttt

SEQ ID NO: 1304 - DNA, 1332 bp, Glycine max
gttttaagagtaccatgcttcctttgcttcgaggcaatgagctggttatccagttttctaataggccccaccgccagcaacacaaaatctccgaagatctaattctggatgattatgcttctctgaatgtcaatgattctaaccaaaaattcatcactagtagcagcagccaaccaacaaagaaacttttctatggggcaaataaaaagaatcatgactcacacgaacatacggcgcgagtgattcataaggagattgagaggcaaaggagacaagaaatggctaccttctatgcctctcttagatcccttctccctcttgagttcatcaagggaaagcgttcaatatctgaccacatgaacgaggcagtgaattacataaagcacatgcagaaacatatcaaagagcttggtgccaagagagatgaactgaagaaactctccaatcattccaataatatggaaaataaccatgagggcttgcatacatcttgcaacttcactgtccacgagaaaaatggtattattggaatagaaatcaccagtgtcttcagagaggaaaagcctaaaatttcaaagttactacagtttttgactgaagaaggacttgaagttgttagtttcttttcaacagaagtcaatggcagattgctccacagtgtgcagtgtgaggtgaaccattccaacagtgtagatccatctgagctgagaaagaaagtttccaaagcattttcaacctttagatgctctgattgattttgtcgttgaagctagctagcctcacaatctggctaataacaggaaatttacccatagcatgcattttaaacggagagctactctaactatggtactatagaaaaaatctaagagttttagtattgttatttttttggattaatagttgaatgagtttgagaagtgaaaaagagagagggagaaagagagattcattaaatggaagctcgtttaactattggtaaaaaaaatatcagtactaaaaccttaaatttctcaggctaccatagaatttctcttttagacttttctaacttgatagactttgtttggatgagtttgcttgcaaattttacattggcaactgtccccttttttctctttgatttggactctgctgctttctttgtgaagaatgagggaagaagacagtaaaatcgtacaactcaaaaatgaactctatcccaattccttttgtagcttttctgcaataaaatggattcagtttctgtcttttttttttttcctttcaaaatttacagatgtgcgttaattgtttacttgcaagttttagttaccttgtaattgaacgtag

SEQ ID NO: 1305 - DNA, 1098 bp, Glycine max
ctcatcacgacatttcattaccccaaactaaaatgtttctgttaccttagccaaaccaagattgaggaaaataattcggaacactagttgtgctgaccaaccaaccatgtttcctttacaacgcggcaatgagctggtaatccagttttctaatggtcaccacccgcagcacaaaatctcccaagatctgattctggatgatcaagatatcgatcaatctccccttgtcggttattccgataaaaaattgcgtactagccgtccaaaaaaactattttatcatgaggctgatacctgccacgctaattctaaccaagaatatacaaaaaagatggttcatagagagattgaaaagcaaaggaggcaagaaatggctacccttcatgcctctcttagatcccttctccctcttgacttcatcaagggaaagcgttcgatatctgatcaaatgaacgaggcagtgaattacataaatcaccttcagaagaatattaaagaattgagtgacaagagggataagctgaagaagaaaccctccataagtcattccacccctgaaggccatgagaattacaagcatgcatctagcggtttcactgtccaccagaatagtggtggagctgtggggattgaaatcagtggattcagtgaggaagaggttccactttcaaaattgcttgaactggtgtttgaagagggacttgaagttgttagttgtctttcaaccaaagtcaatggcagattactccacagtttgcagtgtgaggttgacaattccggcagtgtagatctatctgagctgagaaggaaattttccaatgtaattccatcacttagatgttctgagtaactttgtggactggaaattaacacataacacatgtatctgccctttctaactggttcgtaattttggttgtgtgagtttgcttgcaccgtatatatttggaacccctttgactctttggtttggaaccttcagcttccattgtcaggaagagaaagacaaaacatgtgtagataaaatttgctttttccttcccttcacagctgtctttgctttttgaaatttacacatgatgatgaccgttttgtttc

SEQ ID NO: 1306 - DNA, 701 bp, Oryza sativa
gaactagtggatccccgggctgcaggagagtattggtgctaaccgcaacaagaggcagtcacggaaaagtagagatgagaatggagatgatggtgatgattctgatgagaacagtaatgagagtggagactcatcaacacagaagaagccaagggtcgtgtggtctgttgagctgcaccgaaagtttgtggctgctgttaaccagcttggcatcgagaaggctgttccaaagaaaatattggatctcatgaatgtagagaacatcaccagggagaatgttgctagtcatttgcagaagtatcggctgtaccttaaacggttgagcactgatgcaagcaggcaggctaaccttgcagctgcatttggaggaaggaaccctgcttacataaacatgaattcatttggaaactacaacgcatatggtagataccgtacagtcccaactgctggccatacccaggcaaacaacattcttactaggatgaactccccttctgcgtttggtgttcatggtttgctgcattcacagccaattcagttaggacatgcccaaaataatctgagcacttcactgaatgatttaggagggcttaataatggtaacatgatcagaggtgcacagatgtcaacaattctaactggtccttctggtaactcctttccaaacatatcgaatggtgcaccgctggcaactgcgaaca

SEQ ID NO: 1307 - DNA, 923 bp, Glycine max
ctgtttcccatgatcagctttttagcattattgactattccccaagctgggcatttgaagggtcagaaattaaggttatcatttctggagaattcctaagaagtcaacatgaagcagaacaatgtaagtggtcatgcatgtttggtgaggtagaagtgccagcagtgatcattgcaaaaggtgttctttgttgtcatacacctccacacaaggctgggagggtacctttctatgtaacttgttccaataggttagcatgtagtgaagtgagagaatttgatttccaagtccactatactccagaagacactacaggtgagaatagaggaagcacttttgatacttttagtatccgatttggagaacttttgtccctggggcatgcctttcctcagaattcagattcaattagtgttagtgagaaatctcaactgagaagtaaaatcaattctttactgagggaggaggaggatgattgggacaagctactgaaacttactcaagaggaagatttttctccagaaaatttacaggagcagctgcttcaaaatcttctgaaagataagttacatgcatggctccttcagaaaataacagaagaggggaaaggccctaatatattagatgagggtggccaaggtgtgcttcattttgcatctgctcttggctatgattgggccctagaacccacaatagttgctggtgtgaatgtgaactttcgggatgtaaatggatggactgctcttcattgggcagcattttgtggcagggagcgcacagttgctttcctcatctctctcggcgcagcacctggagcactgactgatccatgtccagaacatccttctggtagaacaccagctgacctagcttctgcaaatggacacaaaggaattgcagggtatcttgctgagtcttcacta

SEQ ID NO: 1308 - protein, 1033 aa, Oryza sativa
MAAAADARRFAVVPQLDIAQILKEAQQRWLRPAEICEILKNYKSFRIAPEPPNRPQSGSLFLFDRKVLRYFRKDGHNWRKKKDGKTVKEAHERLKSGSIDVLHCYYAHGEENENFQRRTYWMLEEDFMHIVLVHYLETKGGKSRTRGNNDMHQAAVMDSPLSQLPSQTIDGESSLSGQFSEYEEAESGGTGYHSFTQMQQQQNGIGPVTDASMFSSRVSASSIGNYQGQHAMGHTTNFYSSSQHDSPLVLSDPNLELANNGHESLWNGVMKPDEGTVQMTHLQPPVHPEQGMFTTEGQGVEYLTFDEVYSDGLSLKDIGAAGADVEPFWQFSSNSYLTEAIAFQLSSATADISATENSVQQNDGSLGAAIGFPFLKTQSSNLSDILKDSFKKSDSFTRWMSKELLDVEDSQIQSSSGAYWNTEEADSIIEASSREPLDQFTVAPMVLQDQLFSIVDFSPSWTYAGSKTKVLVTGRFLHANEVTERCKWSCMFGEVEIQAEISADGTLRCYSPPHKPGRVPFYVTCSNRLACSEVREFEFRPSDSQYMDAPSPLGATNKVYFQIRLDNLLSLGPDVYQATITNPSKEMIDLSKKISSLLANNDEWSKLLKLADDNEPLSHDQQDQYAENLIKEKLHVWLLHKVGDGGKGPSVLDDEGLGVLHLAAALGYDWAIRPTVTAGVNINFRDFHGWTALHWAAFCGRERTVVALIALGAAPGALTDPHPNYPAESTPADLASANGHKGISGFLAESSLTSHLQALNLKEANMSEISGLPGIGDVTERNASQPAIGDSLGAVRNAAQAAARIYQVFRVQSFQRKQAVQYEGDKGGISDEHALSLLSMKPSKSGQLDPLHAAASRIQNKYRGWKGRKEFLLFRQRIVKIQAHVRGHQVRKHYRKIVWSVGIVEKVILRWRRRRAGLRGFRPTEGAIESSSGGTSSNLVKDKPAGDDYDFLQEGRKQTEERLQKALARVKSMVQYPEARDQYQRILNVVSKMQESQTVQEKILDESTEMDEGDFMSEFKELWDDDTPLPGYF

SEQ ID NO: 1309 - protein, 938 aa, Oryza sativa
AGSIDVLHCYYAHGEENENFQRRTYWLLEEDFTHIVLVHYLEVKGVKQSFSRAKEEIMQLSGADSPSCSNSITSQNQMTPQIMDAAESPISGQISEYEGAEPAKFGAADNCPASSRYNPLIEMQQPLDGIVMDNILYPSSSAICNQVSGYHGELPPGTSNLNGHTFSHSDIARMFDDSSSGLRDISRTLFDSMPYDEHFSGYANGFMEPTLHSSFSMIEANNLEDSSLLETYTSEALYTNNLSQKEADALSFAGISSPEVNGNKYTEGSTKHPLLKQLSLDLFKIESSGLKKHDSFSRWMSKELGEVVDLGIKSSSDALWSSIEIVNAADGPSAPTNEQLDAYAVSPSLAQDQLFSILDISPSCSYIGLKTKVLVTGTFLASKENVENCKWSCMFGDVEVPAEVLADGSLRCYAPEHQSGRVPFYVTCSNRIACSEVREFEYRDSDAQYMETSHSQANGINEMHLQIRLEKLLTLGPDDNQLLVCGNEKLELINAINSLMLDEKWSDQGSPSGSKDVVTPRNQSLKKLMKEKLHCWLIYKIYDCEKGPNILGKEGQGIIHLAAALGFDWAIRPILVAGVNVNFRDAHGWTALHWAASCGRERTVGVLIANGAAAGALTDPTSEFPSGRTPADLASTNGHKGIAGFLAESALTSHLSALTLKESKDSNAEEACRLTIPEDLPEMNYGQLAVQDSHAESLKDSLSAVRKSAQAAARIFQAFRVESFHRKKVVEYGDDDCGLSDEHTFSLISLQKVKQGQHDTRLHSAAVRIQNKFRGWKGRKEFMIIRQRIVKLQAHVRGHQVRKNYKKVVWSVGIVEKVILRWRRKGRGLRGFRPEKQLEGQTQIQPAKTEDEYDYLQDGRRQAEGRLQRALDRVRSMTQYPEAREQYRRLTTCVAEMQQSRMMQDEMLSEAAGADGSDFMNGLEDLICRDDPQMSAIW

SEQ ID NO: 1310 - DNA, 1385 bp, Zea mays
cccgtgcaaaaagcctcaaactcctaactgctgcactgcagtaacatgcaaccgttaagtctgggtaagatctctgatatcaaactctttacaccgatttcacacagtaaatacaaggctccttcaaatgtagataatattctactgtacataaggcaaaagaaataccacacctaagtccaaatccaaacatgtcagatcatgcaccagcaacgctactttgggttatcagccatttgtgccatcaattcagtagcactcaagacaaacggagcaatctacagagaaataaatccaacaaaacaggtttccacactaaaaataacccgggataggtgcatcgtcatcccacagttccttgaattcactcatgtccatctctgctgactcctccggcatcttttcttgcatagcctgagactcctgcatttttgacacgacagtgaaaatcctctggtactgatctcttgcttccgggtactgagccatggacttcactcttgcaagagctttctggagccgttcttcagtctgttttcgtccttcttgcagaaaatcgtaatcatctccagaagacttattttggatcgaactgctacttgttccgccactactgctctccactgatccttcttgagaccgaaacccacgtaacccagcccctttacgcctccaacgcaatataactttctccacgatcccaacagaccaaactattttccgaataatgcttcctcacttggtgacctcgcacatgagcctggatcttcacaattcgctgcctaataagaagaaattcctttctccccttccatcctctgaacttattttgtatgcgagttgcagcagagtgcagaggatcaagctgccctgacttgggtggcttgacagaaaggagtgagagagcacgctcatcagacatgccacctttatcctcatattgagccgcttgctttctctggaaggattgcaccctgaaaacttgatatatccgcgcagcagcttgagtagcatttcgaacaggacccaatgaatctccacttggaggctgcagtgaatctctctcggtaacatctccaataccaggtagaccagatatttgagccatattagcttccttcagattaaggacctgaagatgactggtcagagaagactctgccaagaaaccagatattcccttttggccattagctgatcccatatctgctggtgtacttccagggaaatcaggagtcgggtctgtcaaagctccaggagctgctcctagagcaataagcgcaactacagtccgctctcggccacaaatcgcagcccaatggagtgcagtccacccatgaacatctctgaaattaatactcacgccagcagcaagtgtcggcctt

SEQ ID NO: 1311 - DNA, 1710 bp, Zea mays
  misc_feature (359)..(359): n is a, c, g, or t
aggagtggggaggggggaggtagagggcgggggaggggggggtggcggggggggggggtagggggggggtgggtggggggaggggggggtaggggcggagggaggagggggtggggggagagggaggggggggggggggggaaggggaggcgacgggatggcgggccgtggaggaggggggggggggggtgtagcggggatggcgcggagtcacgagaggggcggggtgctctctcggaaaggttgccgccggagagttgttatttccgcgcaggagcctgagtagcgtttggaacagggcgcaaggaatgtccactgggaggctgcggggaatctctctcggtaacatctgcaatccnaggtagaccagatatttgagccatattagcttccttcagattaaggacctgaagatgactggtcagagaacactctgccaagaaaccagatattcccttttgaccattagaagatgcaagatctgctggtgtacttccagggaaatcgggagttgggtctgtcaaagctccaggagctgctcccagtgcaataagcgcaactacagtactctctcggccacaaaaggcagcccaatggagtgcagtccagccatgaatatctctgaaattaatattcacgccagcagcaagtgttggccttatagcccaatcatatccaagtgcagctgctaagtgaagcacgccctgcccttcatcatctaacacactgggtcccttgccacccataccaactttatttagaagccagatatgcaattttccctttatcaagttttcagcaaactgatcctgctgatcagcagtagaaggctcattatcaacagccaactttagcaagttggaccactcatcgttgctcgccatcagtgaacttatcttcctgcttaagtcaaccatctccagagtaggattagatacagttgcctggtactcatccggtccaagggataacaacttgtcaaggcgtatctggaaataaactttgtttgtttcaccatgtggactaggagcatccatgtactgggagacagttggtcgaaattcaaactctcgcacttcactgcaggccaacctgttggagcaggtgatataaaaaggtactcgaccaggtttatgctgcggtgagtaacagatgagagtaccatctgctaaaatatttgctggaacttcaacttctccaaacatacatgaccacttggatctctcggtgatttgactgtcattcaggatgttaccagcaactaaaatcttagtctttgaacctacatatgtccagtttggagaaaagtcaactatactaaagagctggtcctgcgagagcatcggggaaacagtgaactgatccagtgcctcatggtttgatgcttcgatgatattatttgcttcttcactgctccagaacgccccagaactagattgaatttgagaatcttccacttcaggaagctctttgctcatccatcttgtaaaactgtcagttttcttaaagctgtcttttaagatatcagatagattggatgactgtgtcttcaaaaatggatagccaatggctgcctcctccagagaaccatcattttgttgagggaggctgttctctgttgcagacaaatcaccagtagcactagagaactgcagatatgacttcccatgagatacctactgcaccaatatcgttgagactgagttaatc

SEQ ID NO: 1312 - DNA, 1287 bp, Glycine max
ccggattcccgggtcgacccacgcgtccgctcttcccttcttaactttcacctctgcccgaggttttccggtgccttcgcgtcgctctgaatgtcatcggcggcgagaactcccggtggcgaggagggaaagcactaccctgctccactcgcccctcacgagggcgtcgtgaaggactccactctcttctgggacactctaaggcgctttcactttgttatgggtaccaaatttatgattcctgtgattggagggaaggagctggatttgcacgttctttacgtggaagttacgagaagaagtggctacgagaaggtagttgcagagaagaagtggagggaagttggtagtgttttcaagttcgcagctaccaccaccagcgcttcttttgtactcaggaaacactactttagtcttctttatcattatgaacaagttcacttctttaaagctcggggtcctatctacactccatcagcagatgcattttccggcaacagcccttcgtggagacctgaattagctattgtggaatattcgcctaagcctatggataatagtcctgaatctcgtgctgaagatacttcatgcctttcaggaaatggaaccatcgagggaaaatttgactgtggttatttagtgtccgtgaagcttggttcggaggttcttagaggggtgctttaccatcctgagcaattggttcctccaccatcgattccaaaacatgagagtgccattgtaccaatcaaccgcaaacctcaccgttctggtcgtaggaagaaaaacaaaagaaggtgggaccccaattatccaaagccgaataggagtggctataacttcttctttgctgaaaagcattacactctcaaaactctctacccaaacagagaaagggagtttaccaaaatgattggccagtcatggaacagtcttagcccagaagaaagaatggtttatcagaacattggcttaagagacaaagaaaggtacaagagagaattgacggagtacaaagagaagatgaagcttaggcagacctcagaagttggacgtccatagaatctcattggtacccgtttgtggaggcgaaagaatggcttagaaaatttttataatctgttgacttttacgtgcatattgttgtggataatggtccactggactgtggtctacagaactattgtttttttcttttcaaaagagaaaactagtgtctattgttagtcagagaccctttcatttcgtttaatcaattaattatcctcccaagtttgttctccggtagaa

SEQ ID NO: 1313 - DNA, 506 bp, Zea mays
attcggctcgagtcaaccgcaaacctcaccggtctggtcgtaggaagaaaaacagaagaaggtgggaccccaattatccaaagccgaataggagtggctataacttcttctttgctgaaaagcattacactctcaaaactctctacccaaacagagaaagggagtttaccaaaatgattggccagtcatggaacagtcttagcccagaagaaagaatggtttatcagaacattggcttaagagacacagaaaggtacaagagagaattgacggagtacaaagagaagatgaagcttaggcagacctcagaagttggacgtccatagaatctcattggtacccgtttgtggaggcgaaagaatggcttagaaaatttttataatctgttgacttttacgtgcatattgttgtggataatggtccactggactgtggtctacagaactattgtttttttcttttcaaaagagaaaactagtgtctattgttagtcagagaccctttca

SEQ ID NO: 1314 - DNA, 449 bp, Glycine max
ctaacaagtcttcaccatcattatggttgccttgttttcccctccagtgttctcaaccaagggatggctcttagaagaggatccattaagctatgatgtgtcctctgagtactcatttccctatcaattttattcaccacagacacagattcagctcgacattgaaaggtccacttctccatcccctgaagaccctgccatggtcaaaaagcttagccacaacgctagtgaacgtgatcgccgcaagaaggtcaatcacttggtttcttcacttcgttcacttcttccagtggctgatcaaacgaaaaaaatgagcattccgactacagtttcgcgagtcataaaatacatacccgagttacaacagcaagtggaagcactatctaagaaaaaagaggatcttttgtgcagaatttctcggcaattgcaaggagatgcagtgaacaaag

SEQ ID NO: 1315 - protein, 248 aa, Oryza sativa
MEQLFVDDPAFASSMSSLEADIFSGAGQLPSSPWLDLDLDDDVQDLSMAPTTANAVSSGYGSGGSGSHRKLSHNAYERDRRKQLNELYSSLRALLPDADHTKKLSIPTTVSRVLKYIPELQKQVENLERKKKELTTTSTTNCKPGVLGSQLMSEGMAPIVSATCINDMEIMVQVSLLSNVAGSVLPLSKCIKVLENEGLHFISSSTSSGFGNRTFYSIHLQRSEGTINEECPAFCERLEKVVRNKAKL

SEQ ID NO: 1316 - DNA, 1240 bp, Zea mays
aaatctactctcgctccataaaccaaccctcccaccatcaccaaagatatatactattactacatagttaacaaactttatctgcctcctgtcctgctaatctatatatcccctctccactactgctaccttctctcgcgcgtctctgctcaaagaataatgtcagcgtagcctagctagctcatagggattcctctttcatccctcctgagatcgacgatctcaccaattaagaacacacgcgcacacagcagctacgtacgtacctagctagctagcatgatggaccatcagctgttcgacgaccccttcgggagcagcatctcgtcgctggaggcggaaatcttctccgccgccgcccagctgccgccgtcgccgccgtggccagacatcgacctcgacgacgactacgacatccacgacctctccgcgccggccgccaacgccgctacgtcctcgggcggcggctacggctccggcggctccggcggccacaggaagctcagccacaacgcgtacgagcgcggccgccggaagcagctcaacgagctctactcctccctccgctccctgctcccggacgccgaccaaactaagaagctgagcatccccaccaccgtgtcccgagttctcaagtacatcccggagctgcagaagcaggtggacaacctggagaggaggaagaaggagctgaccaacgccaactgcaagccgggagttctgaaaaccaccaaggccgtaactcccattgtttctgctacctgcctcaacgacacggagatcatggttcaggtcagcctgcacagcgatgtggccgccacagctctccctctctccaagtgcatcaaggtgctagagaacgaaggccttcatctcgtcagctcatcaacctactcctccgcctttgagaacaagacattctacagcctccatcttcagagaagtcaaagaacgatgaaggaggagtgcccggcattctgcgagcaactggagaagatcgtcaggaagaaagcaggggcgtagccagctgcagcctgcaggaggagtgtgctggcgcatgcgttcaccattcctctgcgtgctactccagccataagcacacacagctagctaattaaggtattttagtctgtaaataatggactgtgtagtcgtgtgtgtgtgtgtgtgtcgtaactgtgaaagtcgccgatggatgcataatatatatgtggtttttcccttaaaaaaagaacaaaac

SEQ ID NO: 1317 - protein, 454 aa, Oryza sativa
MAGGGRCSSLLRGFVSLFFLLFIHIGHAGCCFSTGSSTQTLEEDDTGHGADGRGGGGGGSKRRKISPLAFSPSVSSSTVADERSRARRRQVSSLATSVRFYLHRIFSYSSGAKNGAGAPAAEEEDEAVTTTVSSPLAQSSSCLPQRQASSSVVLSTPSSPCASPFLSPLSPQSLSITPAVPSSPHNRQIPQATTRQSSFRSFAARGDVFPCKVCGEVLSKPQQLELHQAMKHSLSELSSLDSSMNIIRMIFLAGWKPAVMPGAGEPPSVRRILRIHHNPRVLTRFEEYRDLVRARAARRCAGAGAAAVEERCVADGNERLRFYCSTMLCTLGAGVCGSPYCCTCSILRHGFAGKQADVDGIATYSSGRAAHASLPDDVEREFAFLQVRRAMLVCRVVAGRVGRGAADDKVAYDSMVPLLPTSSFAAATRGDDDVELLVFNPRAVLPCFVIIYSC

SEQ ID NO: 1318 - DNA, 1317 bp, Glycine max
agaatattaactgtttccaacaagttgtattgtaaggaaatgtttctgaaaacaggtactctaaaactgagagaaaaaagaaactggtgagaattcacgtctttctttgtagttcaacttgtcacaaaaattctggtttggattcctcaaatttagtacatatacctagtttattttaaaaaaattcaatatggattgtggttatatttaggtagctgatgaacttgtggccgaatttgctgatccaatcaatggtgtttcaactcctgatcagcaacaatatgatgagaaaaacattcgtcgaagggtgtatgatgctctgaatgttctcatggcaatggatattatttctaaggataaaaaggaaattcaatggaagggtctccctcgtactagtctaagtgatattgaagagctaaagtcggagcgtcttgggctaaggaatagaattgaaaagaaagcagcctatttgcaagagcttgaggagcaatacataggtcttcagaaacttatacaacgaaatgagcaactatatagctcaggaaatgctcccaatggaggtgtatctttgcccttcattctggtgcagacacgcccccatgcaactgttgaagtggaaatatcagaagatatgcagcttgtgcattttgatttcaatagcactccctttgagctgcatgatgataactatgttctcaaggcaatgaaattttgtgagagatctcagaatgataatacaacagataatcctacagatggcggtgaaggttctagcatatatgcacaggttcctacttctgtttcaaaccctccaaataggcctccttcatctccaccactccctggaatattaaaggcaagagttaagaacgagcattgatatgcaattttgtactgcatcgccttatttaagcatgtttgtatatttttgtaaagtaatttgtcagtaattaattgtccttcataatagttaatcagtacagccaattcactcagtaggttagaagcgaaccagtgtgcttgagtctatattcttctgggttgattttggcaaattctttgctaaccatatccattatttactaccttaagaccttaactgatttttttccccacattttctgtgtatttgcccttttgtacttataatagagaaattggtttgcaccagcccatagagatcatggaatgttatacatcagcgtaggattaattttggatttctcggatatttagtgtaaattattccgtcttatcatcttatgtcaatcttgatgggtgggccatgtgatttttggttgatgaataatttctttt

SEQ ID NO: 1319 - DNA, 1443 bp, Glycine max
  misc_feature (1435)..(1438): n is a, c, g, or t
  misc_feature (1440)..(1440): n is a, c, g, or t
aattcggctcgaggcgaaagcgcagcattacgtattgctgtgttgtgtggtgtgactgagataagatcagatctgggcaattgtagaatcgtgccctaggcctggctatgggaggagacgaagaggaggaggaggtgctcggttcgggccaatccgcctccaccaacaacagcttgccacctcccgtcgataaaactattctcaaattgaaccatctcgacgtacatgctgatgatgctggatcacacgcttctcttgctggcaagaagaaaaagagaggcggtcaacgggctgttggacctgataagagtggaagaggtctccgccaatttagtatgaaagtgtgtgagaaggtagaaagcaggggaagaaccacatacaatgaggtggcggatgagcttgttgctgaattttctgaaccaagcaatagtgaattgccccctgatcagcaacaatatgatgaaaaaaacatccgccgaagggtctatgatgctctgaacgttctcatggcaatggatattatttccaaggacaaaaaggaaattcaatggaggggccttcctcgtactactgtgaatgatattgaagaactaaagacagagcggcttgggctcaggaatagaattgaaaagaaaacagcctatctgcaggagcttgaggagcaattcgtaggtcttcagaaccttattcaacgaaatgagcagttatatagctcaggaaatcctcccagtggaggtgtatctttaccctttattttggtacagacacgtcctcatgcaactgtggaagtggaaatatcagaagatatgcagcttgttcattttgatttcaatagcactccttttgagctgcatgacgacaattatgttctcaaggcaatgaaatttggtgagagaccactggaagataatatgacacataatcttactgatggaggtgaaggttctagcatgtcaggcttgtgtcagccgcaggctcctacaattctaaatgtgtcaaacaggcctccaacatcacctcctctccctggcatactaaaggcaagagttaagcaagagcattaatctgtaaggttatcatattatgttgtcttatgtaaaagcatgtttgtatattttgtagagaaatttgctgcagttgatagaccgtcataatagttattcatcagttcagccaagtcattctgtaggttagaagcagatcggtatatcttctttgttaggggtagactttggcacattctttgcctatcatccgtcatttattaccgtaaaatttttaattttttgttttcccacatattttcactgtaactctccccccctttgtagtgaaagaaatcggtttgtgatagttaatagatcatggaacggaatccagaagcataggattaatttttggaagtgaactgatctgtagtgtacagttttccagnnnngngtg

SEQ ID NO: 1320 - DNA, 914 bp, Glycine max
ggttatttggctcttaatggtattgcaatttaatcattctcatatttctagccttttaattaaaactgtagacacgccctcatgcaactgtggaagtggaaatatcagaagatatgcagcttgttcattttgatttcaatagcactccttttgagctgcatgacgacaattatgttctcaaggcaatgaaatttggtgagagaccacaagatgataatatgacacacaatcttactgacggaggtgaagtttctagcatgtcaggcttgtgtcagccacagactcctacaaatcttaatgtgtcaaattagacctccaacatcacctcctctccctggcatactaaaggcaagagttaagcaagagcattaattgtaaggttatcatatttatgttgccttatgtaaaagcatgtttgtatattttgtagagaaatttgctgcagttgatagcccgtcataatagttattcatcagtacagccaagtcattctctaggttagaagcagactgctatgtcctctttgttaggggtagacttcggcacattctttgcctatcatccttcatttactaccttaatttttcttttttgttttcccacatattttcactgtaacctttccccccctctgtagtgagagaaatcggtttgtaatagtccatagatcatggaacggaaatacggaatccagcagcataggattaatcttggaagtcaccgatttatagtgtactggtctcccgcttgacataccttgtttcggacgtcaagaacacaagaggaccaaggacatcacacaatggagatcataataaaataattgtggtgggcggcggtcaccaatacgcctaattgtgtttatctaccccccccacgcacgcgtttacaaacaaagaagtagaaaaacccgg

SEQ ID NO: 1321 - DNA, 767 bp, Glycine max
cggctcgagtacggctgcgagaagacgacagaagggggtacacgcaaacacttgttccggtggtccctacgcaaacacttgttccggtgtccctctctctttcgcttcatcttcaacattaggtcttctctgactctgtggttgtcactgttcaacgtctttgagagtttatgctgagtagttcggctttacctcaaaagtcctgatcaattgaattcagtttccattggtaggatttattgccgggccttgaggtaatcagcttaccaacatgggaacacaaccccagcaaacatttcgggaggaagaggaggaggagatgcaaggccatggaactacgatgtcaggtcaatcaatgtcaacaagcagaagtgtcgggtctccatccagccggagtgagcagacaatggcaacacctgctagtgatagcacttttcttaggttaaacccatcttgacatacatggtgatgatgctggatcacaggcccccgccgcccacaagaaaaagaggggccaacgggctgttggaggtgataagagtggaagaggtctccgtcaattcagtatgaaagtgtgtgagaaggtagaaagcaagggcagaacaacttacaatgaggtagctgatgaacttgtggccgaatttgctgatccaatcaatggtgtttcaactcctgatcagcaacaatatgatgagaaaaacattcgtcgaagggtgtatgatgctttgaatgttctcatggcaatggatattatttctaaggataaa

SEQ ID NO: 1322 - DNA, 579 bp, Glycine max
gtccggaggtcccggcatgcgcctcggggtgaaaatgaattttggagcgaaaccccattacgtattgttgtgttgtgtggtgtgactgggatcagatctgcccctttctctgtgcaattagcgtgccctaggcctggccatgggagacgaagaagaggaggaggtgctcggttcgggtcaatcagcctccaccaacagcttgccacctcccgccgatagcacactcctcaaattgaaccatctcgacatacatgctgatgatgctgtatcacacgcttctcttgctgccaagaagaaaaagagaggcggccaacgggctgttggacctgataagagtggaagaggtctccgccaatttagtatgaaagtgtgtgagaaggtagaaagcaggggaagaacaacatacaatgaggtggcagatgagcttgttgccgaattttctgaaccaagcaacagtgaattgccccctgatcagcaacaatatgatgagaaaaacatccgccgaagggtctatgatgctctgaacgttctcatggcaatggatacttatttctaaggacaaaaaagaaattcatggag

SEQ ID NO: 1323 - DNA, 639 bp, Glycine max
cggctcgagtacggctgcgagaagacgacagaagggggtacacgcaaacacttgttccggtggtccctctctctttcgcttcatcttcaacattaggtcttctctgactctgtagtcgtcactgctcaacgtctttgagagttcatactgagtagtttggctttacgtcaactcctgttcaattgaattcagtttcccttggtaggatttattgccaggccttgaggtaagcaacttaccaacatgggaacacaaccccagcaaacattttgggaggaagaggatgaggagatgcaaggccgtggaaccactatctcaggtcaatcaatgtcaacaagcagaagtttggggtctccatccagccggagtgaacagacaatggcaacacctgctagtgatagcacttttcttaggttaaaccatcttgacatacatggtgatgatgctggatcacagggtgcagttgctagcaagaagaaaaagaggggccaacgtgctattggaggtgataagagtggaagaggtctccgccaatttagtatgaaagtgtgtgagaaggtagaaagcaagggaagaacaacttacaatgaggtaactgatgaacttgtggctgaatttgctgatccaatcaatggtgtt

SEQ ID NO: 1324 - DNA, 440 bp, Glycine max
cgcaaacacttgttccggtgtccctctctctttcgcttcatcttcaacattaggtcttctctgactctgtggttgtcactgttcaacgtctttggatttattgccgggccttgaggtaatcagcttaccaacatgggaacacaaccccagcaaacatttcgggaggaagaggaggaggagatgcaaggccatggaactacgatgtcaggtcaatcaatgtcaacaagcagaagtgtcgggtctccatccagccggagtgagcagacaatggcaacacctgctagtgatagcacttttcttaggttaaaccatcttgacatacatggtgatgatgctggatcacagggcaccgttgccaagaagaaaaagaggggccaacgggctgttggaagtgataagagtggaagaggtctccgtcaattcagtatgaaagtgtgtga

SEQ ID NO: 1325 - DNA, 469 bp, Glycine max
gtgaaaccgaattttgtagcgaaaccccattacgtattggtgcgttgagacgcgggactgggatgagaactggccctttctctgtgcagatagcgtgccctaagcctgaccatggcacacgcagaaaacgaggaggtgctcgggtcgggtcagtctgcctccaccaaccgctcgccacctgccgccaatagcacactactcaaattgaaccctcccgacatacatgctgatgaagctgcatcacacgcctctcttgctgcctagaataaaaagagaggcggccaacggtctgttggacctgataagagtgggagaggtctccgccaatgtagtatgaaagagtgtgagacggtataaagcacgcgaagaacagcacactaggaggtggcagatgagcttgttgccgaatttgttgaaccaagcaatactgtactgcccactgatcagcatcaatatgatgagaaaaaca

SEQ ID NO: 1326 - DNA, 733 bp, Glycine max
  misc_feature (582)..(582): n is a, c, g, or t
ggaagaggatgaggagatgcaaggccgtggaaccactatctcccaaaatgtttgctggggttgtgttcccatgttggtaagttgcttacctcaaggcctggcaataaatcctaccaagggaaactgaattcaattgaacaggagttgacgtaaagccaaactactcagtatgaactctctgcacaaaccattcgagtttcgagcttattctcagaaatcagcatgagataaaatgtaaaaaaaggtgtaaaaggatgaggagatgcaaggccgtggaaccactatctcaggtcaatcaatgtcaacaagcagaagtttggggtctccatccagccggagtgaacagacaatggcaacacctgctagtgatagcacttttcttaggttaaaccatcttgacatacatggtgatgatgctggatcacaggtgcagttgctagcaagaagaaaaagaggggccaacgtgctattggaggtgataagagtggaaagaggtctccgccaatttagtatgaaagtgtgtgagaaggtagaaagcaagggaagaacaacttacaatgaggctttagcaaatgaacactnacctgtagatatgccttcagttgggaagcacccagcagcttcctttatataataattcagagagagatttcatgtagctgatgaacttgtgggctgatttgctgatccatccattggtgttcaactcctgatcagcaacattatgatgaga

SEQ ID NO: 1327 - DNA, 690 bp, Oryza sativa
gttagaagatcaatttgtaggtcttcaaaacttggcacagcgaaacgagcagctttatggttcatgaaatgctccttcaggaggagtggcattgccatttatattggtgcatacacgtcctcatgctacagtagaagtggagatatcagaagatatgcagctggtgcattttgatttcaatagcactccatttgaactgcatgacgattcctttgtactgaaagcattggggttctctggcaaagaaccagatgatacgcaagcctgggttggaaatggaggtgagtgctcaaccacacctatctatcatcaatcaccccaagttgcgaggccaaacggagttagactaccaacatcgccccctattcccggtatacttaaagggcgtgtcaagcatgaacattaggggttactatgatttgttgatggtgtgaggtacttggtttatttgttactccccaattttccctttttgtaactttacatgtagaaagagcctgtacattagatcaatgggggaaaaatggcgggtctagtttagtttccctggtagaagatcgatgggcatgttgaccaaccatatgcctaacttaacttgtaggattcagctttctggtttttagtaaactcaatattgtactaatgtaattgtgaaggactgtctcatcaatagtcatcttatttaggatg

SEQ ID NO: 1328 - DNA, 893 bp, Glycine max
gccttttttttgggtccaaagtcaggaatagcattaagtggaagagtacagatcagagacaactttgtctttcttctttcccaatacaaagaaaaaagaaaagtaaagcaaattaattaaaccacattcattcaataatcagctgcgattcggaactaaagcaaagtgaaaaatgatagataaatggtcaatcaaactcaaaccccttcatctgccttccgggtgcaatggaaaaagctccagagttctatgttcctcttgttcacaaggtgatgacatgttttgttcttccaagcagtcaaatacccatctcctgcacttcttcttgtacggactatcttcctcgtgatctctctctaccacttccccccttgttgtctccaaagtaacaacactgtgaattgtgggagttcgaggactatgagaagatgcaaggctgctgcgcttctgcttttgtctctcgcgtgctttgtgattctgaaaccaatagaacacgttcttcccttcgatcttgccgtactttccaagctggacagtgatctgctctatctgttgagcattcggagttcgcatccctcctttgtacaacatctccaatatgcctatctgttcttgcgtaggattccaccgtgtccctcctgggtgcgtttcaatctggccttggggtgaaggtggatccttcttagtgtcgtcagaggaaacgggttttctggggccactttcgggcctgatgaagctcttgagatcgaaaggggtagtgatagttttggtgttgggaagcttgggagcaagagggcgtaatctcttgcagccaagtgtgaggaaaggttcgtgctcccagattaatccacgtgtgaactgatgcaccttcatgctgcccactcgagccgaat

SEQ ID NO: 1329 - DNA, 929 bp, Glycine max
atttggtctcaaagagggaacagtacacatttgtagacgactttgtgttttcttctttcccaacacaaccaaagaagaaagtgatgaaaaactaaaccaaactaattaaagcacatacattccaatcagcctgaagggttcagaaacaattaattaaaagctaaaaatatttctcgttaaattggtcaaacaattaaaacaaaccccttcatctgccttccgggtgcaatgggaaaagctccagagttctatgttcctcctctctttggtcttccaagtactcaaacgcccagctcctacacttcttcaacgggctatcttcctcctctctttctactacttccccccgttttgtggtgtccatagtggtaattacacaacaactaaaggggggtgaagtggtgagagtagtacgaggactatgagcaaggcctaggttgttacgcttctgcttctgtctctcgcgtgctttgtggttttggaaccaatagaacacgttcttcccttcgatcttgccgtacttgctaagctgtgctgtgatctgctctatttgttgagcattcggagttcgcatccctcctctgtacagcatctccaatatccctatttgttcttgagtcggattccaccgtgtccctcctggaatatgcgtttcagcctggccctggggtgaagatgggtctctcttattagtattatcatcggaggatccaattccaagttttctggaggcactttcaggtttgatgaagctcttgaggtcgaaggttgtaacaggatgatgaggtggagaaatggtgtcggtgttggaaagcttgggggcaagggggcgtaagcgtttgcacccgagtgtgagggagggttcgtgctcccagaatccacgtgcgaactgatgcaccttcatgcttaattttagttacctcgagccg

SEQ ID NO: 1330 - DNA, 918 bp, Glycine max
ggggccaatgtcaggaatatagcattatgtgggagagtacagatcagagccaattaactttgtcttctttcccgatccacaggaaaaagaaaagtaatgcaaattaacccacatcgagccattcaataatcagctgcgattttcggaactaaagcaaagcgcaaaacgatggatattaaatgatcaatcaaactcaaaccccttcatccgccttccgggtgcaatgggaaaagctccagagttctatgctcctcttgctcacacgctgatgacatgttttgttcttccaagcactcaaatacccatctcctacacttcttcttgtacggactatcttcctcgtgatctctctctactacttccccccttgttgtctccaaagtaacaatactatgaattgtgtgagttcgaggactatgagaaaaggcaaggctgttgcgcttctgcttttgtctctcgcgtgctttgtggttctgaaaccaatagaacacgtttttcccttcgatcttaccgtactttccaagctggacagtgatctgctctatctgttgagcatttggagttcgtatccctcctttgtacaacatctccaatatgcctatctgttcttgagtaggattccaccgtgttcctcctggatgcgtttcaacctggccttggggtgaaggtggatccttcttactgtcgtcagaggaaacgggttttctggggccactttcaggcctgatgaagctcttgagatcgaaaggaacagaaggggtggtagggatagtattagtttgggtgttgggaagcttgggagcaagagggcgtaatctcttgcagccaagtgtgaggaaaggttcgtgctcccagcagaatccacgtgtgaactgatgcaccttcatgctgcccatccccttctgtcgtcttctcgca

SEQ ID NO: 1331 - protein, 236 aa, Oryza sativa
MRLHHLHVAYLDHKASSSSSSPAPPSISPSSIPGSAAFPAFSFKCLRPLAPKISLPEPRKMIAPPDFVVPRARNASKLLNYTVQVPAAGTTRWNPSAEQIKVLEMLYRGGMRTPNSVQIERITEELGKYGRIEGKNVFYWFQNHKARERQKQKRAALLTLSTLDPSLLPATANETKEAPEKKEKDVEDGLASCKRRCKAWGDGAGDGDAVVATEAAGGCTDEVTLELFPLHPQGKA

SEQ ID NO: 1332 - protein, 211 aa, Oryza sativa
MRLHHLHVAYLDHKASSSSSSPAPPSISPSSIPGSAAFPAFSFKCLRPLAPKISLPEPRKMIAPPDFVVPRARNASKLLNYTVQVPAAGTTRWNPSAEQIKVLEMLYRGGMRTPNSVQIERITEELGKYGRIEGKNVFYWFQNHKARERQKQKRAALLTLSTLDPSLLPATANETKVINQQINRILIIHESVDISARIIGELFPLHPQGKA

SEQ ID NO: 1333 - protein, 262 aa, Oryza sativa
MRLHHLHVAYLDHKASSSSSSPAPPSISPSSIPGSAAFPAFSFKCLRPLAPKISLPEPRKMIAPPDFVVPRARNASKLLNYTVRHIKPYLFLIDRSIRFMIVYIFGLQVQVPAAGTTRWNPSAEQIKVLEMLYRGGMRTPNSVQIERITEELGKYGRIEGKNVFYWFQNHKARERQKQKRAALLTLSTLDPSLLPATANETKEAPEKKEKDVEDGLASCKRRCKAWGDGAGDGDAVVATEAAGGCTDEVTLELFPLHPQGKA

SEQ ID NO: 1334 - protein, 2068 aa, Oryza sativa
MDPPPPFDHPLHRRHYSDHHHFPPGGSGGSGGAASAAARSRYEYGGGGYESHSHHQYHLPDHHHHHHHHHPPPRVQHHHHHHHQQLPAPTPPPPPPPPLPQHRLEPPPPHYGFPPRGHPDAYSPPPYHDPSPHHHYHRHGGDDFLPADEIRRVGGGHHHHHHHPQLQQLLPWEEAEEERRRYGGATQQLRLSPSGPRKRQRCAVHDADVESTSSSGPPPRRQRQQPHPDYALDDSFVDRNNAHPGYMVHEGFSIHSDSKVSRKIQMPTQMALPGSPHGTSAGYARRAPQKVAPSRVSVWHRIEENPAMYEPSSPPPHMPKEVHVSPCKSNNVAPASKELASVISVDCRGKSADGNDGDSNTGTKKNPVKKNEKVLASVLVKPPMEPKEKEVAAKKMLKKPDKVQKNAVHSNIRSLVSTPCPGAGAKKVKKIVIKKIVRKINGKGNQNSTPVVSEKRDGIDANACEKEEGEITTSSFEKDVISAHDPIAVSDTAGFGNAVNDQKQKNTDFTNPSGRNAASANGSMEIPDPPNGSGSAHPGKEEVLSPKNPVDNSNASLVVEPIEVLEKSGTEHPRKEHDMSSIGSGVNDAFADANNHTQKEVGEMNVAVAINSVRVSDAREVPRCDDSSMEESKVPKDVDANIAVCMDGVASNCDTTEVCGNEDARRECGKKLIGINDEKAFLLNNSARSSSTSDTCMTAVEGAQKKEGIILTGSSEKSIGFLGDSVGTHRTTEFGASKDAPNEGDDMPSHPSEKDFMSLNSCGGLNYTEVSEKEDIQEKEDRVPMESIVACTSSGNEDIQVNEGRKPMELSEANAFSGSGDSQGKECRIPMGSSETNTSSVNHVNASNEKDFSLSEDTQKKESHRPIESCENTTFEIMHHEEAPSTEEVITGVSLGRKVAEGPTRSNERCSGARGNSATTLKFGLACATEDNQMEDLLNNRTALNETDDPLDAEDSPVFVPPSSRNVESTYASPLYDPMEDSTSDGILNIGLGRNTTSKAAELLDLHRDHISSENDSLIHSRGTSSVSGNREQSVPTALTLGSNIYFSSAETDDRPEERHELVVEGQQGLTVETTSKLDSPGKIEVLNGAGFISTGIQNWLSLPPSINSMEMSGQFLNNGFTVSKGRLGLDQSMDDATSVSQDHDIAQDMDQRGSEDAFFSQDHSIRLCGSNLPHSHLLAPKESSMNGEDQSGIVLTGLHPSSSVNVLGHYGYQTDDIPVDNLNKLPSALESSDAMDADQVSSQVCVNPDHTNDSNTENAGVESNAKQDLLSSWIEAIVSEAKKEHPPCKSTPLTVGLPDKLLEPKDSDRKTLLETVVPSAVKSPQINFASSTLQKVAPKQVTLPSSSREPTRANQNARHRTWHRGNIASSSSSLHASQPLGLPPKLPPKKNDKAQNSYIRKGNALIRNPSNGNHPHSSTGHDTQNKLNKPVVRRSMNFVRKADTKDLANSNISVERPKTPPLPLHTKSSCPTTLLEPLSQTLQKQHGHEAEKEDLTGQPKSGVDNSSIKSAQKSEPSDPSKVVYVRPKSNQLVAAQRQHPIDLVNSPTDKILSLQAPIAYDLYLKKRKNQIVLSSCSPSDGLSTKETLPAENSNSEEKKDLMIACSISGIPGVKDRPQKALQTTNNVGRFSHVWTLNGQQPQRKGFMGSSHMNAFPRILPWKRKIFCKNFRSSHMSNVSSIRIVRKLLQTRKRDMIYTVSTDGFSLRKSGVLSVGGSSLKWSRSLEKRSQKVNKEATLALAEVERRKREKRKRQSLHDKGDHQFESVTGNQLRNSRQSSSDLRKPSTCNEYVRVSKGNQLVRNPKNVIRMLASDKVRWSLHTVRSRLAKKQQYCQFFTRFGECKKPRGKCPYIHDRAKVTICTKFLKGLCSNTSCKLTHKVLPERMPDCSYFLRGLCTNIACPYRHVKVNLNAPVCEDFLKGYCAYGDECHKKHSYVCPVFEATGECPQGSRCKLHHPKSKVKSKSRRPDFLQNSSWGRYFDASIDHQDETRKVSLDEDEREKPQRVFTDGDLGFISLDDDADEDVTALDASDDIPLMELDSGDLSVQTDNLDALIKPLRIMRTARV

SEQ ID NO: 1335 - DNA, 451 bp, Zea mays
  misc_feature (346)..(346): n is a, c, g, or t
  misc_feature (368)..(368): n is a, c, g, or t
  misc_feature (377)..(377): n is a, c, g, or t
  misc_feature (417)..(417): n is a, c, g, or t
gccaggtggaggtggaggcgcaggcaggggaggaagacatacacacagacacaggctccccccccgcacgcgggcgtcagggaagggaccagccccaccaccgggctacttggttgggtcgggagacgcaagacatgatggatcaactgagcctggtgccctacgatggggtcggcggcgacgccccgggcgggaagtacaaggagtgcatgcgcaaccaccccgggggcatgggcgggcaagcgttcgaacgctggggggagtacattgggttcttgccggacacacttaagtgcgcacagtgcgggtgccaccgcagatttcaccgccgcgcgcttgcggcggngagcccctgcgcgccgcccgtnttttttcgnccgccgccgccgcccgcgctgtccgcgccgccgcagaagnacttttaccaccaccaccaccaacagggcgcgct

SEQ ID NO: 1336 - DNA, 1603 bp, Zea mays
ggggcccccaaaaaaaaaataataccttggaaggacggggaaggaaaattgggatctttaaaaggggcgcccccttttttttttttttttttttttttttttttttttttttttttttttttttttttttttttttttttttttttttttttttttttttttttttttttttttttgttttttttttttggttttctaggcatggcgcacagcggcatgctttttcttggggttaatttcttagtagatggcaagaggtctaaacaaaaaaaaaacgagtgatcactgaaattaagctacatgtttctctccctctccgctctcccttcccttccccctcctctcttctcccttctctagttcaagcggagtgcggcgacgaagctccgttggcgttgtccgtggtgtagtcggtggcgacggtgggcgccgaggaggcggcgccgttgatgttgaagccggtggcggccgtcggggacgaggtgaggacgggagggggaggggtgatcctggacgggttgaatgacggtgctgcagcagcgccggcgccggcgccggcggctggggtttggagcgacgcggcggcgggggcgggggcgggcgaggaggcgctgcggcgggcgctgtgcccgcccaggaagttgtgcttgttgttgtgcatccagaccttgaagacgcccttgccgacgccgatgtcgcggcaccactcgtcgacgatggcctcgtcgcgcttctgcagccgccacccgagccgctccgacagctcctgcatccgctgcttctgctcggcggtgaacttggtgcggaaccgcttcctgggcatgggcatcgcgcccccggcgtggggcggcgcgctggacggcgtcagctgggtcggggccagcctctgcgccggggataccgccaccgcgggcccgggcacgccggaaccgagcgagagcaccatgtgcggcgccgtcgggaagtaggacggtggcgggggctgctgcgccaccggcgccggcagcaggtggtgcggcggcggcggcggggacaccgaccgctcctcgtcgtactccgagccttccgagtcggaatcggagtcgtcggcgtcgacgacccccgggtggcggtcctcgggcgtctcctcccgggcgcggtgcggctggccgtgcatcacgctcggcggaggcgggagcgccagcggcgcgggcgcgggcggcggaggggaaccctccagcgtccggcggtggaagttgcggtggcacccgcacgccgcgcacttgagcgacgtcgggtcggcggggttggcccccggcgagggcatgaactcgccgcaaccgtcgacggcgtgcccgcccaggctcgcggcgtggttcttgaggcactcccggtacagcggctccccggccagcgccacggccgccgccggcttcggcttcttgaggccggcgccgttggggaacatgacgggcttgtacttgacgtccatggcttccatgcggcgcccccacgcccactggggagtggccgcgggggagagagattacctctagctcctaaccctgggcttttagcatgggacgacgggtcagggcccggccagagcccggccgccttcgag

SEQ ID NO: 1337 - DNA, 992 bp, Glycine max
cccccttccttaacctcggagtgcggctcgagcagaggtcctacaagggaaggcattgtaagaagttttacacggaggaagggtgcccctatggagatagttgcacctttcttcacgatgagcaatcgaagaatcgcgagagtgttgctataagtttgggccctggtggttacggtggcggcggcggcggcggcggcggtgttggtggtggtgccagtggtggtaatggtggtgctaatgctgctgggaatgggcctaattcgaagccctctaattggaaaaccaggatttgcaataagtgggagatgacagggtattgcccctttggcaataagtgtcattttgctcatggtgccacagaattgcacagatatggaggcgggcttatggagggagaaaatagagatgctgcttctgcagttgctggtgacacaaataagggagtgccttcaaaagcttctgccgataatgtggttgcagcagttactcttgtcgctcattctgatgtgtatcatattggagtcccttcacaaaggccttcttccatggtgattcagaggccaggacagagagcacatcagaagtggaaaggtccagataaaatcagtaggatatatggtgattggattgatgacatcgaatagagttttaatcccattcatggaaacgactgatgagggcttatgtactatcaaaacgcaatatttttcattcacatgttaatttttcttaagatccttaacttccaacgggaatagcattttagatcgtttcattgataactgttttgtaggtttatgcttggtggtgtattcaccttccttaatacgttgattctctggtgtctaaatgtagcaacatcttcccttgtatttgcatccgatagtatcccataatttttattttagcaagaacttattcatcaggccccttttgctaccgcgtaggatctggttgtcctgatgcaatgaaaacccctttacgattttctg

SEQ ID NO: 1338 - DNA, 620 bp, Glycine max
acagggtattgcccctttggcaataagtgtcattttgctcatggtgccacagaattgcacagatatggaggcggtcttatggagggtgaaaatagagatgctgcttctggccggcccggccgcgccaataagggagggccttcaaaagcttccgccgataatgtggttgcagcagttactctggctcctatttctgatgtgtatcatattggagtcccttcacaaaggccttcttccatggctattcagaggccaggacagagagcacatcagaagtggaaaggtccagataaaatcagtaggatatatggtgattggatcgaagacattgaatagagttataatctcccattcatggaaacgactgatgaggagggcttatgtaccatcaaaacgcaagaattttcattcacacgctattttattcggtaatttatcttaagatccttaacttccaacgggaatagcactttagatcgtttcatgtataactgttttttacgtttatgtttggtggtgtattccccttctccttaatacggtggttctctggcgtctgaatgtagcgacagcttcttcccctgtatttgcatatgatagtatcccataattgttttagc

SEQ ID NO: 1339 - DNA, 605 bp, Oryza sativa
  misc_feature (378)..(378): n is a, c, g, or t
  misc_feature (469)..(469): n is a, c, g, or t
  misc_feature (475)..(476): n is a, c, g, or t
  misc_feature (584)..(584): n is a, c, g, or t
  misc_feature (586)..(587): n is a, c, g, or t
actcatctcctcggcgggatagcgctgccgccttcgccgccggcgccgccgttcgccatcaccgagcaagcaagtgacctcgctgttcgtctctcccacctcctccttcttccgctgccttcgattcttggtagcgggtgatggattacaccaacgccatccacatcatcccggacgcggcgggccccgacgcctgggcgaacgcggcggcgcagggcggggacgccgggatatgggccaccgaggacgactacaacagccagtggaacgccgacggcggcggcggcggctcctcgagggccgggagcgagcagccacctccgggcaagaaatcccgcggcggcggcggcggcgaaggcggcgggaacacgagcaagncgcgggcgatcgggaagatgttcttcaagacgaagctgtgctgcaagttcagggcggggacctgcccctacgtcaccaactgcaacttcgnccaagnnatggaggagctccgcaaggcggcgcccaaccggcaggaagaacgacgcggagccaccaagaagacaccgaaggggaggaaaggaaaacaagaacaccatcagggacgncnncaaaaaccaacaccggac

SEQ ID NO: 1340 - DNA, 1509 bp, Oryza sativa
ctcgagttttttttttttggtgctccccccctttttttttttttttttttttttttttttttgacaggtaaacaggcagttcatactttcagataaccatatctaactttccaggtacaggtattgcaaccatgacttcatatcatgtaagcaccatacatgatatcaggtattgcaacagacagcacaacataaaattcagtctaacaacccgcagactatgtcttgactctgaccaggtttccacatggctaatctaaatgtcttgagaccaggattccaaaatggctaactaattgacatctccttttcgctcaagacaatggtttttcccaatggctaactatagcatcttgttttcgccttcaggtggtggcgacgaaagatcaaaggtttgatttcgcctactcggtttcgtctatccagtcaccatagatcctgctgatcttgtcagggcccttccatttctgaatgggcctctgtacctgcccagacctttggccggcaatggtagaacgctgcgcctgcacgcctagatggtacacgtctgcatgagggagcactgtggtggatgcagcagcggtctctgctggagctttcgcagataccacagcttgcttggagtcgggagttgctgcagcatccctgctgtctatgtcaacaagtcccccaccatacttgtggagttcagctgctccatgagcgaagtggcatttgctgccaaaggggcagtacccagtcatctcccacttgttacagatcctcgtcttccagttcgacggcttctgcatcggcccattccccgccgcggcggaggcggaggcggccgcggcggccgcagaattgtagctcccgccaccgccgccgccgccgacgctcggcgagaggctgatcgcgacgctctccctggccttggactgctcgtcgtggaggaacgtgcacgcgtcgccgtaggggcatccctcgtcggtgtagaacttcttgcagtgcctccccttgtaggccctcccggagccgccgccgccgccgccgccgcagcccgcgtcgccgccggcggtgggtcccgacgacgtcatgatggggatctggtgctcctccctcgcctccgtggcctcctcgtgcgccgcgacgatctcctgccagttgggcggcggcttgcggagctcctccatgccgtgggcgaagttgcagttggtgacgtaggggcaggtccccgccctgaacttgcagcacagcttcgtcttgaagaacatcttcccgatcgcccgcgacttgctcgtgttcccgccgccttcgccgccgccgccgccgcgggatttcttgcccggaggtggctgctcgctcccggccctcgaggagccgccgccgccgccgtcggcgttccactggctgttgtagtcgtcctcggtggcccatatcccggcgtccccgccctgcgccgccgcgttcgcccaggcgtcggggcccgccgcgtccgggatgatgtggatggcgttggtgtaatccatc

SEQ ID NO: 1341 - DNA, 372 bp, Zea mays
gtgtgtgatcagtaggagtgggtgggagtcagggtgggtgggcatgaggcttgggcagagagcacgcgtacggcagctaatcgtatcggctcgaggatgagcacgctaaggcacgtgagagcgtggccatcagtctgtcgcacaacgggggaggcgggggatacaatgctgcctccgccaacggaatgatggtgcagaagccgtccaactggaagacaaggatctgtaacaagcgggagatgactggatactgcccatttgggagcaaatgccactttgctcatgggtctgaccgaacttcacaagtacggagggggcctcgtggacatcgacggcagggacatcttgtccactcctgattcgaagcaagcc

SEQ ID NO: 1342 - DNA, 1708 bp, Zea mays
gctgatttggttgcggatttcttagatgtggggtcttactgaccgaattatccatccacgggtggtctgtttgattaggttccctctcttctccgcgcatgcgtgcggggtcgaaaggtagggttcataccccaaagtttgtcattggggacaacaccagcggcggcgatggactacaccaacgccatccacatcatcccggacccatgccgcggcccccgacgcctgggccaacgcggcgtcggccgcgggcgccgacgccagcatctgggccaccgaggacgactaccgccagtggagcgccgaaccaggctacggcgaccggaacccctcgtcgcgggcggggagcgagcagccgccgccgggcaagaaggctcgcggcgggggcggcggcagcgatagcggcggcggtggcagcacgagcaagtcgcgcgccattggcaagatgttcttcaagaccaagctctgctgcaagttccgggccgggacctgtccctacgtcaccaactgcaacttcgcgcatggcatggaggagctccggaagccaccgcccaactggcaggagatcgtggccgcccacgaggaggccacggagcagcgggaggagcaccagatccccatcatgacatctggaagtgttgtagctggagacggcggcggtggcagtggtggcggctcgcaggggggcagggcattcaagggccgtcactgcaagaagttctacactgaagagggctgcccctatggtgacacatgcaccttcctgcatgatgagcagtctaaggcacgggagagcgtggccatcagtctctcgcccaccgttggtggtgggggatacaatgctgcctccgccaacggagtgatggtgcagaagccgtccaactggaagacaaggatctgtaacaagtgggagatgactggatactgcccatttgggagcaaatgccactttgctcatggttctaccgaacttcacaagtacggagggggcctcgtggacatcgacggcagggacatcttgtccactcctgattcgaagcaagccggtggctctgctaaagctcctctagagtctgctgctgcgtccactgcgttgccccctcatgcagacgtgtaccatctcggcatccagtcgcagcgctcggccatcgccagccagaggtctggacagctgcaaaggcccatccagaaatggaagggccctgacaagatcagcaggatctatggagactggatagatgagaacgaatagaagaaggatcttctacggtgggccgaagggaagctgttacttggtatccgtccgactccacatcagctggtggaagctttacctggcttagaagatctcgttagcgctgcaaaaccagagtcaagatcatctttgcaagacctgtattggggagataaactgctggaacatagtgccgctttcttccgttgaactcagtagcattgctatgcttgtgtaatttgtgtgttggatggaggagcataatagcatatagcgagtcatggtgcaccctgtacagggtggctgagctgcatcctgaaggctggttgttcaggtgcgtccgtgactgtctgttggttcttgttttcgggctattattattgggccggatatttctagccttactctttggcccattgagcagtgcgctgtgtaccaagcagttaagcccaataaacagggtattttttcccc

SEQ ID NO: 1343 - DNA, 1091 bp, Zea mays
ccggaccggaatggggcggcccacgcgtccgcccacgcgtccgcggacgcgtgggcagtctaaggcacgggagagcgtggccatcagtctctcgcccaccgttgggggggggggatacaatgctgcctccgccaacggagtgatggtgcagaagccgtccaactggaagacaaggatctgtaacaagtgggagatgactggatactgcccatttgggagcaaatgccactttgctcatggttctaccgaacttcacaagtacggagggggcctcgtggacatcgacggcagggacatcttgtccactcctgattcgaagcaagccggtggctctgctaaagctcctctagagtctgctgctgcgtccactgcgttgccccctcatgcagacgtgtaccatctcggcatccagtcgcagcgctcggccatcgccagccagaggtctggacagctgcaaaggcccatccagaaatggaagggccctgacaagatcagcaggatctatggagactggatagatgagaacgaatagaagaaggatcttctacggtgggccgaagggaagctgttacttggtatccgtccgactccacatcagctggtggaagctttacctggcttagaagatctcgttagcgctgcaaaaccagagtcaagatcatctttgcaagacctgtattggggagataaactgctggaacatagtgccgctttcttccgttgaactcagtagcattgctatgcttgtgtaatttgtgtgttggatggaggagcataatagcatatagcgagtcatggtgcaccctgtacagggtggctgagctgcatcctgaaggctggttgttcaggtgcgtccgtgactgtctgttggttcttgttttcgggctattattattgggccggatatttctagccttactctttggcccattgagcagtgcgctgtgtaccaagcagttaagcccaataaacagggtattttttccccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 1344 - DNA, 737 bp, Zea mays
  misc_feature (339)..(339): n is a, c, g, or t
ccgcccggggctcgtccggttcagttcagtggcgccgtcgtgcctcgacgacggcgggagacgccgcaagcaggtgagagtgagacgggcggtgactagcgggcgcttaggccgacatcggccccgcagcggcggggtagggtgcgtcgacacgcgggactgcgacttgggggggatcgattcccttcgctgttctctcttctccggcgcgtgcgcgcgggatcgaaggtagggtttgggccccaaagttcgtgtctttggggacagcggcggcgatggactacaccaacgccatcctcatcatcccggacgccgcgggccccgacgcctgggccaacngcggcgtcggccgcgggcgccgacgccagcatctgggccaccgaggacgactaccgccattggcaagatgttcttcaagaccaagctctgctgcaagttccgggccgggacctgtccctacgtcaccaactgcaacttcgcgcatggcatggaggagctccggaagccaccgcccaactggcaggagatcgtggccgcccacgaggaggccacggagcagcgggaggagcaccagatccccatcatgacatctggaagtgttgtagctggagacggcggcggtggcagtggtggcggctcgcaggggggcagggcattcaagggccgtcactgcaaggagttctacactgaagagggctgcccctatggtgacacatgcaccttcctgcatgatgagc

SEQ ID NO: 1345 - DNA, 644 bp, Zea mays
caagtcagcgccatcgcaagatgttcttcaagaccaagctctgttgcaagttctgggccaggacctgcccctacgtcaccaattgcaacttcgcccatggcatggaggagctctgcaagccgccgcccaactggcaggagattgtggccacccacgaggatgccaccacgaagcagggagaggagcaccagatccccattatgacatccagaagtgtcatcgctggagacgatggcggcggcggcagggcatacaagggtcgccactgcaagaagttctacactgaagagggctgcccctatggcgacacatgcaccttcctgcacgatgagcagtccaaggcacgggagagcgtcgccatcagtctcttgccgacgattggtggtggcggatacaatgctgcctctgccagcggatcgatggcgcaaaattcttccaattggaagacaaggatctgtaacaagtgggagatgactggatactgtccgtttgggagcaaatgccactttgctcatggatctactgtaatacccaatttgtaaacaatctaaagagagtagatctcattatgtgtttttgccctatgctctttgtaacctggtgataaccatatatataaagagaacaaataactaataacacct

SEQ ID NO: 1346 - DNA, 377 bp, Oryza sativa
ggcattgccatgagagtgatttgggatcgagtgccagttcttctggtgcaacaaaggaaggggaggagtactttgccagaagaggtcttaggatcacttattactggtgacatgtcactgcctttcacagaccattttagtttgcctcagggtgttccttgtcgtggatgtgaggaagaacgctactgcagccaatcatgtgctgattccgactgggaaacttatcactctttgctgtgtactggatctaagactgaaccatcccagagatctgctcttcagaaattcatagaacatgcaaatgggtccaatgatatttttcttgttgctgccaaggctatcactttcactctgctgaggtacaagaaactcaaaac

SEQ ID NO: 1347 - DNA, 1923 bp, Glycine max
atttttcatcttttctcttgaaccttccttcgcccatcttctccaccactccacacaaccttaaatccaaacccaaaccaaacgaaaaacacacacacacacaccccaagagaaggattccgagaagttggtgtgatctgatgcgagtgttaagaagataatctgaggagaaaaaagaaagaaaaaaaagtttcattttttttttcaatggagtcagatcttcagcagcaccctcccatgtttttggatcaccaccagcagcagatgaattcagggttgacacgttaccgatcggcgccaagttcgtatttttcgagcatcattgaccatgagttctacgagcacgttttcaatcgaccctctagccccgaaacagagcgaatgttgacacgctttgtgaatagtcttggtgggggtgatgctgatgcagaggattcacttgctactactcagaatcccccaactgttgttgcggttaaggaagaggttaatcagcaacctccggatgttacatccatgaataatgaaccacttgttctccaacaacaacagcagcagcagcaacaacaacaacaaagtaataatatgtataattatggctcttctggtactcagaatttttaccaaagcactggacgaccacctttgccaaaccagatgaagactggtcatggaagtagttctaatcttatcagacatggtagctcacctgctggattgttttcaaacattaacattgatattactggctatgctgctgttgtaaggggcatgggaactatgggagctgctgctaataacaccagcgaggaagcaaacttttcaccagcaacaaggatgaagaataatgcaccaaacttctcttcaggactaatgtcatcaagggctgaagttggaaacaagagcaatacacagaacaataatgcagaaaatgaagggtttgctgaaagccagggcaatgagtttatccctgcaggtttccccgttggtccgtggaatgattctgcaatcatgtctgacaacgtgacaggtctgaagagatttagagatgaagatgtgaaaccattttctggtggtttaaatgcacctgaaagtcagaatgaaactggaggccaacaaccttcttcttctgctttggctcatcaattgagtttgccaaatacttctgcagaaatggcagccattgagaagtttctgcagctctcagattctgttccttgcaaaattcgtgccaaacggggctgtgccactcacccaagaagcattgcagagagggttagaagaactaaaattagtgagcgaatgaggaagctacaagatctcgttcccaacatggataagcaaacaaacacagctgacatgttggacttggctgttgagtacattaaagaccttcaaaaccaagttcagactctttcggacaatcgggcaaagtgtacgtgttcacacaagaagcagcaataacgcaaaaggaggaggatacccgcgtcattacgtgtacagcttagtaataatttggtctagaaactagtgcacctttccgataattatgtagccacatcttcagcggttgtttgggagtggttgtgggaaaatcagcttataaaagttgactttatatatcatcaaaatcaaaatttgatgccacatattcaaagcatggtgtacaaaattttctgatatattacaagtctatttgcctttaatctttaggggcccccattttcggggatggaggatggggtgaggtggaaaatggaaattttcatttttgctttttcaatgttccccaataacgttttaaaaaaggatgttatgtatgggttattgggtttggtttcccattcaatgacatgggaaacatggggggccgaatttgttggttatatatacccttgtatgagtagtgtgttttcctttttt

SEQ ID NO: 1348 - DNA, 2098 bp, Glycine max
  misc_feature (520)..(520): n is a, c, g, or t
actagatggaatgttattttataatccttctccatcttttctcttgagccttccttcccacaccaatcttctccaccacttcacacaaccttaaatccaacccaaaaccaaaagaaacacacacactcagaaacaccaagagaaggattccgagaagttggtgtgatctgatgctagtgtttcgaagataatctgagaagaacaaaaagagaaaaaagtttgattgttttctttttccaatggagtcagatcttcggcagcaccctcccatgtttttggatcaccaccaccaccagcagcagatgaattctgggttgacacggtaccgatcggcgccaagttcgtatttttcgagcatcattgaccgtgagttctacgaacacgttttcaatcgaccctctagccccgaaacagagcgaatgttgacacgctttgtggatagtcttggtggaggtgatgctgctgatgctgatgcagaggactcacttgctaatactcagaatcccccaacaactgttgnttgcggttaagggaagaggttaatcatcaacctcaggatgtgacatccatgaataatgaaccacttgttctccaacaacaacagcagcaacaaagtaataatatgaataattatggctcttctggtactcagaatttttaccaaagcactggacgaccacctttgccaaaccagatgaaaactggtcgtggaagtagttccagtcttatcagacatggtagctcacctgctggattgttttcaaacattaacattgatactggctatgctgctgttagaggcatgggaactatgggagctgctgctgctaataacaccaccgaggaagcaaacttttcacccgcaacaaggatgaagaatgcaacaaacttctcttcaggactaatgtcatcaaggcctggaattggaaacaagagcaacacacagaacaatgcagaaaatgaagggtttgctgaaagccagggcaatgaatttatccctgcaggtttccccgttggtccgtgggatgattctgcaatcatgtctgacaatatgacaggtctgaagagatttagagatgaagatgtgaaaccattttctggtttaaatgcacctgaaagtcagaatgaaactggaggccaacaaccttcttcttctgctttggctcatcaattgagtttgccaaacacttctgcagaaatggcagccattgagaagtttcttcagctctcggattctgttccttgcaaaattcgtgccaagcggggctgtgccactcaccctagaagcattgcagagagggttagaagaactaaaattagtgagcgaatgaggaagctacaagatctggtccccaacatggataagcaaacaaacacagcagacatgttggacttggctgttgagtacattaaagaccttcaaaaccaagttgaggcactttcggacaatcgggcaaagtgtacgtgtttacacaagaagcagcaataacggaaaaggaggagggtacccgcgtcattccctgtacagcttagtaataatttggtctagaaactagcgcacctttccgataattatctagctacatcacttcttctgcgcttgtttgggagtgtggtggcaaaagttgagtttatatatgatcgatcaatatttgatgcccacatattcaaggcatggtgtacaaaattttctgatatgtaagtctatttgcctttactcttaggggccccccatttacggggatgatggaggatggggtgagttggaaaattgaaattttcatttttgcatcttcaaggttcagccataacgttaaaaaaaagagagagagagagagagaatgttatgtatgggtttggtttcacattcaaggacatgggaaacatggggggaccgaagccaacatagttttgttggttatatatatacttggatgcctattgagtagtgtgtgtttgtacttttattttttttctttttttttatttttgggtatgattttaatgcgaagtagttgtcattaaaaagtatgacacatcttgaatacatatgagtatttttttttatagacttttttttatattcgaagagtcaatt

SEQ ID NO: 1349 - DNA, 957 bp, Arabidopsis thaliana
cggacgcgtgggcaaatattaaaataaaaagtgtcggtgaattctcaatctttgtcttctttcgtcgtctctttaaaactcctccgtccctccttattatgtaaccgtctcgccgtcaaattttcaaaatctctccctccgttcataaacccagatcgaaatttatggttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgtttgtctttaagatgcgctgttgccgctaacatgcgctttcgattttagtgttaaacatgcgcctccattgtttttgggttttgttttcgtcgtcgataatcaaagattttaaaacacaattctcaaatttttcacttgttacaaactagatttgcatgatctttgtattaacgaataacgattaagtcctaaa

SEQ ID NO: 1350 - protein, 176 aa, Arabidopsis thaliana
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 1351 - DNA, 1025 bp, Arabidopsis thaliana
cctcttcaattctctgtttcctccaaaatggctacaccaaacgaagtatcagctcttttcctcatcaagaagtatctcctcgacgaattgtctccgttgcctactactgccaccaccaatcgatggatgaacgatttcacgtcatttgatcaaaccggtttcgagttttctgaatttgaaaccaaaccggaaataatcgatctcgtcactcccaaaccggagatttttgatttcgatgtgaaatctgaaattccatctgaatcgaacgattccttcacgttccaatcgaatcctcctcgcgttactgttcaatccaatcgaaaaccgccgttgaagatcgcaccaccgaaccgaaccaagtggattcaattcgcaaccggaaatcctaaaccggaacttcccgtaccggttgtagcagcagaggagaagaggcattacagaggagtgaggatgaggccgtgggggaaattcgcggcggagattcgagacccgactcgtcgtggaactcgtgtttggctcgggacgtttgagacggcgatcgaagcggctagagcttacgacaaagaagcgtttagactacgaggatcaaaggcgattctgaatttcccgcttgaagttgacaagtggaatccacgcgctgaagatggtcgtggcctgtacaacaaacggaagagagacggcgaggaggaggaagtgacggtggttgagaaagtgctaaagacggaggagagttacgacgttagcggcggcgagaatgttgagtcaggtttgacggcgatagatgactgggatttgacggagtttctgagcatgccgcttttatcgccgttatctccacacccaccgtttggttatccacaattgaccgttgtttgaattctatttttctgtttgggtcagcttgttgtatgctgacgtggaattatgctatatcttttgcttattttatgttcacattcgagcaaaatttattcattcgtttatttgttttttaatacaactcttgatatttctaaattctaacc

SEQ ID NO: 1352 - protein, 282 aa, Arabidopsis thaliana
MATPNEVSALFLIKKYLLDELSPLPTTATTNRWMNDFTSFDQTGFEFSEFETKPEIIDLVTPKPEIFDFDVKSEIPSESNDSFTFQSNPPRVTVQSNRKPPLKIAPPNRTKWIQFATGNPKPELPVPVVAAEEKRHYRGVRMRPWGKFAAEIRDPTRRGTRVWLGTFETAIEAARAYDKEAFRLRGSKAILNFPLEVDKWNPRAEDGRGLYNKRKRDGEEEEVTVVEKVLKTEESYDVSGGENVESGLTAIDDWDLTEFLSMPLLSPLSPHPPFGYPQLTVV

SEQ ID NO: 1353 - DNA, 553 bp, Arabidopsis thaliana; identical to SEQ ID NO: 7

SEQ ID NO: 1354 - protein, 133 aa, Arabidopsis thaliana; identical to SEQ ID NO: 8

SEQ ID NO: 1355 - DNA, 909 bp, Arabidopsis thaliana
ctcctgtcttgtctaaagaaaaaagagagaggaagaaatggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaatgggggaatagtgatgtttaattagtatatataggttaatatcttaagtatgtgaagcatcatgtatagagccaagaacctgttagactagtgtactgaaaagaactcttgcaaaatatgtactaaagagttcctgtaacaatggaacttctgcgttttctcttgtcttaaagagcttaaggttctagaaacaaagttcttgtcctttcggtttaaaaaaaaaaaaaaaaaaaaaaaaaaaaaaaaaaaaaaaaaaaaaaaaaaaa

SEQ ID NO: 1356 - protein, 201 aa, Arabidopsis thaliana
METFEESSDLDVIQKHLFEDLMIPDGFIEDFVFDDTAFVSGLWSLEPFNPVPKLEPSSPVLDPDSYVQEILQMEAESSSSSSTTTSPEVETVSNRKKTKRFEETRHYRGVRRRPWGKFAAEIRDPAKKGSRIWLGTFESDIDAARAYDYAAFKLRGRKAVLNFPLDAGKYDAPVNSCRKRRRTDVPQPQGTTTSTSSSSSN

SEQ ID NO: 1357 - DNA, 1057 bp, Arabidopsis thaliana; identical to SEQ ID NO: 15

SEQ ID NO: 1358 - protein, 256 aa, Arabidopsis thaliana; identical to SEQ ID NO: 16

SEQ ID NO: 1359 - DNA, 820 bp, Arabidopsis thaliana; identical to SEQ ID NO: 21

SEQ ID NO: 1360 - protein, 255 aa, Arabidopsis thaliana; identical to SEQ ID NO: 22

SEQ ID NO: 1361 - DNA, 1093 bp, Arabidopsis thaliana; identical to SEQ ID NO: 33

SEQ ID NO: 1362 - protein, 252 aa, Arabidopsis thaliana; identical to SEQ ID NO: 34

SEQ ID NO: 1363 - DNA, 820 bp, Arabidopsis thaliana
gagtggaaaatcaaaatactgttgttgattagggttaattaaattagaagaatggtgaggggaaagacagagatgaagaggatagagaacgcaacgagcaggcaagtgactttctcaaaaagaagaaatggacttttgaagaaagcttttgaattatcagtcctttgtgatgctgaagttgccctaatcatcttctctcctagaggcaaactctatgagttctctagctcctccagtatacctaaaacagtagaaagatatcaaaagcgaatacaagatctcgggtctaaccataagagaaatgataattcacagcaatcgaaggacgaaacctatggcttggcgagaaagatcgaacatttggagatttcgacacgaaaaatgatgggagaaggacttgacgcatcttctatagaagagttacaacaattggagaaccagttggacagaagcttaatgaaaataagagccaaaaagtaccagttattacgagaagaaactgagaaattaaaagaaaaggagaggaacctcattgcagaaaataaaatgctgatggagaagtgtgagatgcaaggaagaggaataataggaagaatatcatcatcatcatcaacatcagaactggatatagatgacaatgaaatggaagtggtgactgatttgttcattggacctcctgagactcgacacttcaaaaagtttcctccttcaaactaacatatatagtacaatgcttatatagatattatgtagggaattacttttttccctgaagaaaaattgatgttacttactgaatttagcagttgcataaaaaaaa

SEQ ID NO: 1364 - protein, 221 aa, Arabidopsis thaliana
MVRGKTEMKRIENATSRQVTFSKRRNGLLKKAFELSVLCDAEVALIIFSPRGKLYEFSSSSSIPKTVERYQKRIQDLGSNHKRNDNSQQSKDETYGLARKIEHLEISTRKMMGEGLDASSIEELQQLENQLDRSLMKIRAKKYQLLREETEKLKEKERNLIAENKMLMEKCEMQGRGIIGRISSSSSTSELDIDDNEMEVVTDLFIGPPETRHFKKFPPSN

SEQ ID NO: 1365 - DNA, 959 bp, Arabidopsis thaliana
cctagaacgcaccaagatctaaaggaagatcaaaatagggtttaaattaatggggagagggaagattgtgatccagaagatcgatgattccacgagtagacaagtcactttctccaaaagaagaaagggtctcatcaagaaagctaaagaacttgctattctctgcgacgccgaggtctgtctcatcattttctccaacactgacaagctctatgactttgccagctccagtgtgaaatctactattgaacgattcaatacggctaagatggaggagcaagaactaatgaaccctgcatcagaagttaagttttggcagagagaggctgaaactctaaggcaagaattgcactcattgcaagaaaattatcggcaactaacgggagtggaattaaatggtttgagcgttaaggagttacaaaacatagagagtcaacttgaaatgagtttacgtggaattcgtatgaaaagggaacaaattttgaccaatgaaattaaagagctaaccagaaagaggaatcttgttcatcatgaaaacctcgaattgtcgagaaaagtacaaaggattcatcaagaaaatgtcgaactatacaagaaggcttatggaacgtcgaacacaaatggattgggacatcatgagctagtagatgcagtttatgaatcccatgcacaggttaggctgcagctaagccagcctgagcagtcccattataagacatcttcaaacagctaagatcatataagagatatataacaaattgttcgttcttgattatctcaaaaccctttcaaatatatatacgtgcatattatatatgaagactcgtttgactatgtcaatatatatgttttcatgcaggagtaagtgtgagtgtaatcatgtcggagagcaaaccaaaggtttgatttgtacgatatatacttatatatggtctcaagtgaaagcaatggaacagctt

SEQ ID NO: 1366 - protein, 227 aa, Arabidopsis thaliana
MGRGKIVIQKIDDSTSRQVTFSKRRKGLIKKAKELAILCDAEVCLIIFSNTDKLYDFASSSVKSTIERFNTAKMEEQELMNPASEVKFWQREAETLRQELHSLQENYRQLTGVELNGLSVKELQNIESQLEMSLRGIRMKREQILTNEIKELTRKRNLVHHENLELSRKVQRIHQENVELYKKAYGTSNTNGLGHHELVDAVYESHAQVRLQLSQPEQSHYKTSSNS

SEQ ID NO: 1367 - DNA, 985 bp, Arabidopsis thaliana
ctctacctatacatacacaaaccctttatcctcgaaagcttcctcctggttaggtttttatcaaacccttttagccaatcgggaaattaactaaagaagaagatatggtgaggggcaaaactcagatgaagagaatagagaatgcaacaagcagacaagtgactttctccaaaagaaggaatggtttgttgaagaaagcctttgagctctcagtgctttgtgatgctgaagtttctcttatcatcttctctcctaaaggcaaactttatgaattcgccagctccaatatgcaagataccatagatcgttatctgaggcatactaaggatcgagtcagcaccaaaccggtttctgaagaaaatatgcagcatttgaaatatgaagcagcaaacatgatgaagaaaattgaacaactcgaagcttctaaacgtaaactcttgggagaaggcataggaacatgctcaatcgaggagctgcaacagattgagcaacagcttgagaaaagtgtcaaatgtattcgagcaagaaagactcaagtgtttaaggaacaaattgagcagctcaagcaaaaggagaaagctctagctgcagaaaacgagaagctctctgaaaagtggggatctcatgaaagcgaagtttggtcaaataagaatcaagaaagtactggaagaggtgatgaagagagtagcccaagttctgaagtagagacgcaattgttcattgggttaccttgttcttcaagaaagtgatctccactcaacaaaaaaaacaaaaaaacaaactaagtaaaaacaggtttagcagtactgagagtgtataaggacaagtaacaaaactctaaagctgcttctctcttgttgtcttatttctctctcactctctctctctcagtcacttctttaatgattctgaactgcttgtgttatgtatctatgttcttacacttgcctctctagaatgtaattttgattatgttttgttttca

SEQ ID NO: 1368 - protein, 214 aa, Arabidopsis thaliana
MVRGKTQMKRIENATSRQVTFSKRRNGLLKKAFELSVLCDAEVSLIIFSPKGKLYEFASSNMQDTIDRYLRHTKDRVSTKPVSEENMQHLKYEAANMMKKIEQLEASKRKLLGEGIGTCSIEELQQIEQQLEKSVKCIRARKTQVFKEQIEQLKQKEKALAAENEKLSEKWGSHESEVWSNKNQESTGRGDEESSPSSEVETQLFIGLPCSSRK

SEQ ID NO: 1369 - DNA, 1974 bp, Arabidopsis thaliana
tgaattctagcctttttgtaggcgaatcatctggaccggtaagagactctctcatcgataataaccacataatttaatcaaactctttctctctctttctaagatcttttgctttgctcttttcctttttgatcttcctatatatggagaagcaccaaaacggtacttactatacgatactgtacggatccatcaaactggattaattatcaaaacgtacatttttatcttacctggcaagttacattcctagggttttggagaatccaatcaacaacaaagaaaataatcatcgttacaataatcagtatcacgcacagacttagatgttccggtttccagtgagtctaggcggttcacgtgacgaagaccgtcacgatcagatcacaccgttggatgaccatcgtgtggtggttgatgaggttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgagaacgcacaactacaagaagagctcaagaagatgaaaatagagaatcaaaggctaagagatatgttgagccaagcgacgaccaacttcaatgccttacaaatgcaacttgttgccgtcatgaggcaacaagaacaacgtaactcttcacaagatcatctcctggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaataagagttttcattttgatggtcgatttttttttttgggg

SEQ ID NO: 1370 - protein, 536 aa, Arabidopsis thaliana
MFRFPVSLGGSRDEDRHDQITPLDDHRVVVDEVDFFSEKRDRVSRENINDDDDEGNKVLIKMEGSRVEENDRSRDVNIGLNLLTANTGSDESTVDDGLSMDMEDKRAKIENAQLQEELKKMKIENQRLRDMLSQATTNFNALQMQLVAVMRQQEQRNSSQDHLLESKAEGRKRQELQIMVPRQFMDLGPSSGAAEHGAEVSSEERTTVRSGSPPSLLESSNPRENGKRLLGREESSEESESNAWGNPNKVPKHNPSSSNSNGNRNGNVIDQSAAEATMRKARVSVRARSEAAMISDGCQWRKYGQKMAKGNPCPRAYYRCTMAGGCPVRKQVQRCAEDRSILITTYEGNHNHPLPPAATAMASTTTAAASMLLSGSMSSQDGLMNPTNLLARAILPCSSSMATISASAPFPTITLDLTNSPNGNNPNMTTNNPLMQFAQRPGFNPAVLPQVVGQAMYNNQQQSKFSGLQLPAQPLQIAATSSVAESVSAASAAIASDPNFAAALAAAITSIMNGSSHQNNNTNNNNVATSNNDSRQ

SEQ ID NO: 1371 - DNA, 1931 bp, Arabidopsis thaliana
ctttcaaccaaacccctaaacaaaaaaaaaatacattttctgatctctctaaaaatctttctccttcgttaatctcgtgatctctttctttttctatatatggacagaggatggtctggtctcactcttgattcatcttctcttgatcttttaaaccctaatcgtatttctcataagaatcaccgacgtttctcaaatcctttggcgatgtctagaattgacgaagaagatgatcagaagacgagaatatcaaccaacggtagtgaatttaggtttccggtgagtctctcaggtattcgtgatcgtgaagatgaagatttttcatctggcgttgctggagataatgaccgtgaagttcccggcgaagtggatttcttctccgacaagaaatctagggtttgtcgtgaagacgacgaaggatttcgtgtgaagaaggaagaacaagatgatcgaacggacgtaaataccggtttgaatcttcgaacaactggtaatacaaagagtgatgagtcaatgatcgatgatggagaatcttccgaaatggaagataagcgtgcgaaaaatgagttggtgaaattacaagatgagttgaagaaaatgacaatggataatcaaaagcttagagaattgcttacacaagttagcaacagttacacttcacttcagatgcatcttgtttcactaatgcagcaacagcaacaacagaacaataaggtaatagaagctgctgagaagcctgaggagacgatagtaccaaggcaatttattgatttaggccctacgagagcagtaggtgaggccgaggatgtgtcaaattcttcatccgaagatagaactcgttcggggggttcttctgcagccgagaggcgtagtaacgggaagagacttgggcgtgaagaaagccccgaaactgagtccaacaaaattcagaaggtgaattctactaccccgacgacatttgatcaaaccgctgaagctacgatgaggaaagcccgtgtctccgttcgtgcccgatcggaagctccgatgataagcgatggatgtcaatggagaaaatatggccagaagatggccaaagggaatccttgtccgcgggcatattaccgctgcacgatggccacgggctgtcccgttcgcaaacaagttcaacgttgcgcggaagacagatcaattctgattacaacctacgagggaaaccataaccatccgttgccgccagccgcggtagccatggcttctaccaccacggcggcggctaacatgttgctatccgggtcaatgtctagtcacgacgggatgatgaaccctacaaatttactagctagggctgttcttccttgctccacaagcatggcaacaatctcagcctccgcgccgtttccaaccgtcacattagacctcacccactcacctccgcctcctaatggttccaatccttcctcttccgcggctaccaacaacaaccacaactcactgatgcagcggccgcaacaacaacaacagcaaatgacgaacttacctccgggaatgctacctcatgtaataggccaggcattgtataaccaatccaagttctcggggctgcagttctctggtggctctccctcgacggcagcgttttctcagtcacacgcggtggctgatacaataacggcactcacagctgacccgaatttcacggcggctcttgcagccgttatttcttctatgatcaatggtacgaaccaccacgacggcgaaggaaacaacaaaaatcaatagaaaaatattacattttttttttgggtatctacattttttttccaactgggttataggaaacagagagtttatttcattgattcacatttgttctgtttcgtaccaaaatcccagtaaatatacaaaagcaaactatactcaagttcatattcgtaaacactataaatagt

SEQ ID NO: 1372 - protein, 553 aa, Arabidopsis thaliana
MDRGWSGLTLDSSSLDLLNPNRISHKNHRRFSNPLAMSRIDEEDDQKTRISTNGSEFRFPVSLSGIRDREDEDFSSGVAGDNDREVPGEVDFFSDKKSRVCREDDEGFRVKKEEQDDRTDVNTGLNLRTTGNTKSDESMIDDGESSEMEDKRAKNELVKLQDELKKMTMDNQKLRELLTQVSNSYTSLQMHLVSLMQQQQQQNNKVIEAAEKPEETIVPRQFIDLGPTRAVGEAEDVSNSSSEDRTRSGGSSAAERRSNGKRLGREESPETESNKIQKVNSTTPTTFDQTAEATMRKARVSVRARSEAPMISDGCQWRKYGQKMAKGNPCPRAYYRCTMATGCPVRKQVQRCAEDRSILITTYEGNHNHPLPPAAVAMASTTTAAANMLLSGSMSSHDGMMNPTNLLARAVLPCSTSMATISASAPFPTVTLDLTHSPPPPNGSNPSSSAATNNNHNSLMQRPQQQQQQMTNLPPGMLPHVIGQALYNQSKFSGLQFSGGSPSTAAFSQSHAVADTITALTADPNFTAALAAVISSMINGTNHHDGEGNNKNQ

SEQ ID NO: 1373 - DNA, 900 bp, Arabidopsis thaliana
atgggtgcaccaaagcagaagtggacaccggaagaagaagcagctcttaaagctggagttcttaagcatgggactgggaagtggcgtaccatactctcggatactgagtttagtttaatccttaagtctcgctctaatgttgatcttaaggacaaatggagaaatataagcgtgacagctttatggggttcaaggaagaaggctaaacttgcgcttaagaggactccaccaggtactaaacaggatgataacaacacagctcttaccattgtggctttgactaatgatgatgaacgtgcaaaaccaacttcccccggaggttctggtggtggatcaccacgcacttgtgcttctaagagatcaattacaagtttggataagatcatctttgaggcaattaccaacttgagggaactacgcggttctgacagaacatcaatctttctgtatatagaggagaatttcaagactccaccgaatatgaaaaggcatgtcgcagtacgattaaagcatttatcatcgaatggaacattagttaagataaagcacaagtacaggttttcttctaattttattcccgcaggtgcaagacagaaggctcctcaactctttctggaaggaaacaacaagaaagacccaacaaaacccgaggagaacggtgccaacagtctcactaaattccgagtagacggtgaattatatatgataaaaggcatgacagctcaagaagctgcagaggctgcagcaagagcagttgcagaggcagaatttgctatcacagaggctgaacaagcagcaaaagaggcagaaagagcagaagcagaagctgaagctgctcagatatttgcaaaggcagccatgaaagctttgaagttcaggatccgtaatcatccttggtga

SEQ ID NO: 1374 - protein, 299 aa, Arabidopsis thaliana
MGAPKQKWTPEEEAALKAGVLKHGTGKWRTILSDTEFSLILKSRSNVDLKDKWRNISVTALWGSRKKAKLALKRTPPGTKQDDNNTALTIVALTNDDERAKPTSPGGSGGGSPRTCASKRSITSLDKIIFEAITNLRELRGSDRTSIFLYIEENFKTPPNMKRHVAVRLKHLSSNGTLVKIKHKYRFSSNFIPAGARQKAPQLFLEGNNKKDPTKPEENGANSLTKFRVDGELYMIKGMTAQEAAEAAARAVAEAEFAITEAEQAAKEAERAEAEAEAAQIFAKAAMKALKFRIRNHPW

SEQ ID NO: 1375 - DNA, 584 bp, Arabidopsis thaliana
ctctctctctcactcttttcttttccgagaacccaacaaaaaaaaagctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattactattttggaatgtataattatctatatatataagaagaaaaaattgcttaggaattt

SEQ ID NO: 1376 - protein, 94 aa, Arabidopsis thaliana
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 1377 - DNA, 407 bp, Arabidopsis thaliana
ccagtagttatggataataccaaccgtcttcgtcttcgtcgcggtcccagtcttaggcaaactaagttcactcgatcccgatatgactctgaagaagtgagtagcatcgaatgggagtttatcagtatgaccgaacaagaagaagatctcatctctcgaatgtacagacttgtcggtaataggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctca

SEQ ID NO: 1378 - protein, 112 aa, Arabidopsis thaliana
MDNTNRLRLRRGPSLRQTKFTRSRYDSEEVSSIEWEFISMTEQEEDLISRMYRLVGNRWDLIAGRVVGRKANEIERYWIMRNSDYFSHKRRRLNNSPFFSTSPLNLQENLKL

SEQ ID NO: 1379 - DNA, 727 bp, Arabidopsis thaliana
accaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttcatagagtgtaatcttttctttctgtaaaaatatattttacttgtagcaaa

SEQ ID NO: 1380 - protein, 162 aa, Arabidopsis thaliana
MVAISEIKSTVDVTAANCLMLLSRVGQENVDGGDQKRVFTCKTCLKQFHSFQALGGHRASHKKPNNDALSSGLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 1381 - DNA, 628 bp, Arabidopsis thaliana
cctagaagtcactaagtcgattcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaagtttttgggttgtatacagtttcacatgattttgtaatctttgttgatccaattatcgtaccgatcgatgtgaatattattttgatacaataaaa

SEQ ID NO: 1382 - protein, 168 aa, Arabidopsis thaliana
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKVSGSLVTRSFLPETTTVTALKKFSSGKRVACLDLDLDSMESLVNWKLELGRTISWS

SEQ ID NO: 1383 - DNA, 922 bp, Arabidopsis thaliana
tctgtctctctctctctctttgtaaatatacatatatagataagctcacatatatggcgactgaaacatcttctttgaagctcttcggtataaacctacttgaaacgacgtcggttcaaaaccagtcatcggaaccaagacccggatccggatcaggatccgagtcacgtaagtacgagtgtcaatactgttgtagagagtttgctaactctcaagctcttggtggtcaccaaaacgctcacaagaaagagcgtcagcttcttaaacgtgcacagatgttagctactcgtggtttgccacgtcatcataattttcaccctcataccaatccgcttctctccgccttcgcgccgctgcctcacctcctctctcagccgcatcctccgccgcatatgatgctctctccttcttcttcgagttctaagtggctttacggtgaacacatgtcgtcacaaaacgccgttgggtactttcatggtggaaggggactttacggaggtggcatggagtctatggccggagaagtaaagactcatggtggttctttgccggagatgaggaggttcgccggagatagtgatcggagtagcggaattaagttagagaatggtattgggctggacctccatttaagccttgggccatgaatgattataattttggcccagtaaagatctgtaaaatactactaggatttcatttttatagagtatgtttttttccttaatttcggttgaaattggtgaatatttttatctcttacttaccaaatctcatatttctatgtatgcgtttgctttcactttttttttttatataattcttcttgtaaaaaatgcaatgtgagttttcttccctatcattctgtcaagctttggttcaattatttagtaatcgaataatataggaatagtgttgaaag

SEQ ID NO: 1384 - protein, 197 aa, Arabidopsis thaliana
MATETSSLKLFGINLLETTSVQNQSSEPRPGSGSGSESRKYECQYCCREFANSQALGGHQNAHKKERQLLKRAQMLATRGLPRHHNFHPHTNPLLSAFAPLPHLLSQPHPPPHMMLSPSSSSSKWLYGEHMSSQNAVGYFHGGRGLYGGGMESMAGEVKTHGGSLPEMRRFAGDSDRSSGIKLENGIGLDLHLSLGP

SEQ ID NO: 1385 - DNA, 977 bp, Arabidopsis thaliana
ataaaaaacccttcatacaatataaaatttctttagacatacaatatattatactattacagatgcaatgcatcattagttacaaactattaaactaaatatcccccgtctctctcttgctatataaagaagatcatttacacatctccttaagcaaattaaacccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaattaaagagagatatatgattaagattatatgtactatagtggcgtatttcattgggatcatgaaggggaaaaaacgagacatatagtattcttgatgcaatttgagttttgtaatttatttaggtttatgtatgttttcgaag

SEQ ID NO: 1386 - protein, 211 aa, Arabidopsis thaliana
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 1387 - DNA, 774 bp, Arabidopsis thaliana; identical to SEQ ID NO: 83

SEQ ID NO: 1388 - protein, 257 aa, Arabidopsis thaliana; identical to SEQ ID NO: 84

SEQ ID NO: 1389 - DNA, 2526 bp, Arabidopsis thaliana
atgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgcttctgggacgaccacagacaacagctgtgagtctgtggtcgtgagtggtcagcaacgtcagcagcaaaacccaacacatcagcatcctcagcgtgatgttaacaacccagctaatcttctctcgattgcggaggagaccttggcggagttcctttgcaaggctacaggaactgctgtcgactgggtccagatgattgggatgaagcctggtccggattctattggtatcgtagctgtttcacgcaactgcagtggaatagcagcacgtgcctgtggcctcgtgagtttagaacccatgaaggtcgctgaaatcctcaaagatcgtccatcttggttccgtgactgtcgatgtgtcgagactctgaatgttatacccactggaaatggtggtactatcgagcttgtcaacactcagatttatgctcctacaacattagcagcagctcgtgacttttggacgctgagatatagtacaagtctagaagatggaagctatgtggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtctcaagtgttcctgaagtcctcaggcctctttatgagtcttccaaaatccttgctcaaaaaatgactgtcgctgctctgagacatgtgcgccaaattgctcaagagactagtggagaagtccagtatagtggtggacgccagcctgcagttttaaggactttcagccagagactctgccggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagagtttctcgaagtggttagacttggaggtcatgcttactcacctgaagacatgggcttatcccgggatatgtatttactgcagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccgaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacagtattcatacaggtgcagatctgtttggagctgattctcagtcctgtggaggagacacattgcttaagcaactctgggaccatagtgatgccatattgtgctgctccctgaaaactaatgcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttga

SEQ ID NO: 1390 - protein, 841 aa, Arabidopsis thaliana
MMAHHSMDDRDSPDKGFDSGKYVRYTPEQVEALERVYAECPKPSSLRRQQLIRECPILCNIEPRQIKVWFQNRRCREKQRKESARLQTVNRKLSAMNKLLMEENDRLQKQVSNLVYENGFMKHRIHTASGTTTDNSCESVVVSGQQRQQQNPTHQHPQRDVNNPANLLSIAEETLAEFLCKATGTAVDWVQMIGMKPGPDSIGIVAVSRNCSGIAARACGLVSLEPMKVAEILKDRPSWFRDCRCVETLNVIPTGNGGTIELVNTQIYAPTTLAAARDFWTLRYSTSLEDGSYVVCERSLTSATGGPNGPLSSSFVRAKMLSSGFLIRPCDGGGSIIHIVDHVDLDVSSVPEVLRPLYESSKILAQKMTVAALRHVRQIAQETSGEVQYSGGRQPAVLRTFSQRLCRGFNDAVNGFVDDGWSPMSSDGGEDITIMINSSSAKFAGSQYGSSFLPSFGSGVLCAKASMLLQNVPPLVLIRFLREHRAEWADYGVDAYSAASLRATPYAVPCVRTGGFPSNQVILPLAQTLEHEEFLEVVRLGGHAYSPEDMGLSRDMYLLQLCSGVDENVVGGCAQLVFAPIDESFADDAPLLPSGFRVIPLDQKTNPNDHQSASRTRDLASSLDGSTKTDSETNSRLVLTIAFQFTFDNHSRDNVATMARQYVRNVVGSIQRVALAITPRPGSMQLPTSPEALTLVRWITRSYSIHTGADLFGADSQSCGGDTLLKQLWDHSDAILCCSLKTNASPVFTFANQAGLDMLETTLVALQDIMLDKTLDDSGRRALCSEFAKIMQQGYANLPAGICVSSMGRPVSYEQATVWKVVDDNESNHCLAFTLVSWSFV

SEQ ID NO: 1391 - DNA, 2559 bp, Arabidopsis thaliana
atgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttga

SEQ ID NO: 1392 - protein, 852 aa, Arabidopsis thaliana
MMMVHSMSRDMMNRESPDKGLDSGKYVRYTPEQVEALERVYTECPKPSSLRRQQLIRECPILSNIEPKQIKVWFQNRRCREKQRKEAARLQTVNRKLNAMNKLLMEENDRLQKQVSNLVYENGHMKHQLHTASGTTTDNSCESVVVSGQQHQQQNPNPQHQQRDANNPAGLLSIAEEALAEFLSKATGTAVDWVQMIGMKPGPDSIGIVAISRNCSGIAARACGLVSLEPMKVAEILKDRPSWLRDCRSVDTLSVIPAGNGGTIELIYTQMYAPTTLAAARDFWTLRYSTCLEDGSYVVCERSLTSATGGPTGPPSSNFVRAEMKPSGFLIRPCDGGGSILHIVDHVDLDAWSVPEVMRPLYESSKILAQKMTVAALRHVRQIAQETSGEVQYGGGRQPAVLRTFSQRLCRGFNDAVNGFVDDGWSPMGSDGAEDVTVMINLSPGKFGGSQYGNSFLPSFGSGVLCAKASMLLQNVPPAVLVRFLREHRSEWADYGVDAYAAASLRASPFAVPCARAGGFPSNQVILPLAQTVEHEESLEVVRLEGHAYSPEDMGLARDMYLLQLCSGVDENVVGGCAQLVFAPIDESFADDAPLLPSGFRIIPLEQKSTPNGASANRTLDLASALEGSTRQAGEADPNGCNFRSVLTIAFQFTFDNHSRDSVASMARQYVRSIVGSIQRVALAIAPRPGSNISPISVPTSPEALTLVRWISRSYSLHTGADLFGSDSQTSGDTLLHQLWNHSDAILCCSLKTNASPVFTFANQTGLDMLETTLVALQDIMLDKTLDEPGRKALCSEFPKIMQQGYAHLPAGVCASSMGRMVSYEQATVWKVLEDDESNHCLAFMFVNWSFV

SEQ ID NO: 1393 - DNA, 2502 bp, Arabidopsis thaliana
atgggaggaggaagcaataatagtcacaatatggacaacgggaagtacgtgaggtacactcctgaacaagtggaagctctggagagactctacaatgactgtcctaaaccgagctctatgcgccgccaacagctaatccgcgaatgtcctatcctctccaacatcgagcctaaacagataaaagtctggttccagaaccgcaggtgtagagaaaaacagcgaaaagaggcgtcacgacttcaagctgtgaataggaagctaacggcaatgaacaagcttttgatggaagagaatgaccgcttgcaaaagcaagtgtctcacttggtttatgagaacagctattttcgccaacatcctcaaaaccaggggaatttggctaccacagatactagctgtgagtcagtggtgacgagtggtcaacaccacttgacccctcaacatcagcctcgtgatgctagtcctgctggattattgtccattgcggatgaaactttaacagagttcatttccaaggcgactggaaccgctgtcgagtgggtccaaatgcctgggatgaagcctggtccggattccataggaatcgttgctatttctcatggatgcacgggaatcgctgctcgtgcttgcggccttgtgggtcttgatcccacaagggtcgcggagatcctaaaggataagccttgttggttgcgtgattgcagatctctggatatagttaacgtactatccactgcaaatggtggaacccttgaactaatctacatgcagctttatgcgccgacaacactggcaccagctcgtgacttctggatgctacgttacacatctgtaatggaagacgggagccttgtgatatgcgaacgatcactgaacaatacacaaaacgggccaagtatgcctccgtctcctcatttcgttagggcagagattttaccaagtggttacctcattagaccttgcgaaggaggtggatccattcttcacattgtcgatcatttcgatcttgagccatggagtgtgccagaagttcttcgttctctctatgagtcctccactttactcgcccaaagaactacaatggccgctctgcgctatttgaggcaaatatctcaagagatttcacaacctaacgtaacaggttggggaagaagaccagcggctcttagagcacttagccaaaggcttagcaaaggattcaacgaagcagtgaatgggttcagcgatgaaggatggtccatcctagagagtgatggtatcgatgatgtcactcttcttgtgaactcctctcccacaaagatgatgatgacttcaagtctcccatttgccaatggctacacttctatgcctagcgcggtcttatgtgccaaagcttccatgttattacaaaatgttccaccttcgattctgctgcggttcttgagggaacatagacaagaatgggcagacaatagcatcgatgcatattcggccgcagccatcaaagcaggcccttgtagcttaccaatccctcgcccagggagctttggtggtcaagtcattcttcctctagctcacactatagagaatgaagagtttatggaagtcattaagcttgagagcttggggcactaccaagaagacatgatgatgcctgctgatatcttccttctgcaaatgtgcagtggggtggatgagaacgcagttgaatcatgcgcagagcttatatttgcaccaatcgacgcatctttctctgatgatgcaccaatcattccttccggtttccgcatcattcctctagattccaaatcagaggggttgagtcctaaccgaacgctagacctagcgtcggctctagacgtagggagcagaacagccggagattcatgtggaagcagaggaaactcaaagtccgttatgactatagcgtttcagctagcttttgagatgcatatgcaagagaatgtagcctcaatggctagacagtatgtaagaagtgtgatcgcgtcggttcaacgggtcgcacttgctctctctccttcttctcatcagctaagtggcttgcgtcctccacccgcgtcacccgaagctcacactctcgctcgctggatctctcactcttatagatgttaccttggcgttgatcttctcaaacctcatggaactgatcttctcaagtctctttggcaccatcctgacgctgtcatgtgttgctcactcaaggccttatctccggtattcacatttgcgaaccaagctggtttagacatgctggagacgacgttggtggcacttcaagatatcactctcgacaagatcttcgacaacaacaacgggaagaagactttatcctccgaattccctcagatcatgcaacaggggtttatgtgtatggatggaggaatatgcatgtcgagcatgggaagagcagtaacgtacgagaaggctgttgggtggaaagtgttgaacgacgacgaagatcctcattgtatctgcttcatgttcctcaactggtcttttatatga

SEQ ID NO: 1394 - protein, 833 aa, Arabidopsis thaliana
MGGGSNNSHNMDNGKYVRYTPEQVEALERLYNDCPKPSSMRRQQLIRECPILSNIEPKQIKVWFQNRRCREKQRKEASRLQAVNRKLTAMNKLLMEENDRLQKQVSHLVYENSYFRQHPQNQGNLATTDTSCESVVTSGQHHLTPQHQPRDASPAGLLSIADETLTEFISKATGTAVEWVQMPGMKPGPDSIGIVAISHGCTGIAARACGLVGLDPTRVAEILKDKPCWLRDCRSLDIVNVLSTANGGTLELIYMQLYAPTTLAPARDFWMLRYTSVMEDGSLVICERSLNNTQNGPSMPPSPHFVRAEILPSGYLIRPCEGGGSILHIVDHFDLEPWSVPEVLRSLYESSTLLAQRTTMAALRYLRQISQEISQPNVTGWGRRPAALRALSQRLSKGFNEAVNGFSDEGWSILESDGIDDVTLLVNSSPTKMMMTSSLPFANGYTSMPSAVLCAKASMLLQNVPPSILLRFLREHRQEWADNSIDAYSAAAIKAGPCSLPIPRPGSFGGQVILPLAHTIENEEFMEVIKLESLGHYQEDMMMPADIFLLQMCSGVDENAVESCAELIFAPIDASFSDDAPIIPSGFRIIPLDSKSEGLSPNRTLDLASALDVGSRTAGDSCGSRGNSKSVMTIAFQLAFEMHMQENVASMARQYVRSVIASVQRVALALSPSSHQLSGLRPPPASPEAHTLARWISHSYRCYLGVDLLKPHGTDLLKSLWHHPDAVMCCSLKALSPVFTFANQAGLDMLETTLVALQDITLDKIFDNNNGKKTLSSEFPQIMQQGFMCMDGGICMSSMGRAVTYEKAVGWKVLNDDEDPHCICFMFLNWSFI

SEQ ID NO: 1395 - DNA, 832 bp, Arabidopsis thaliana
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 1396 - protein, 141 aa, Arabidopsis thaliana
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 1397 - DNA, 1065 bp, Arabidopsis thaliana
tcgacccacgcgtccggacacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaaaaaaaaaaaaaaaa

SEQ ID NO: 1398 - protein, 190 aa, Arabidopsis thaliana
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 1399 - DNA, 913 bp, Arabidopsis thaliana
gtttcttgttgttaaaaatatcgtacaaaaatggccgatgaggtcacaatcgggtttcgcttctatcccacggaagaagaactggtttcgttctacctacgaaaccagctcgaaggaaggagtgatgactcaatgcatcgtgtcattcccgtacttgacgtctttgaggtcgagcctagtcatcttccaaatgttgctggagtgagatgtcgaggagacgctgagcaatggttcttcttcgtgccacgacaagaacgcgaagcaagaggaggcagaccgagtagaactactggttcaggatactggaaagcaactggatcacctggtccagtcttttccaaagacaacaaaatgattggagcaaagaaaactatggttttctacactggaaaagcacccacaggaagaaaaactaaatggaaaatgaatgagtaccacgccgttgacgaaacagtcaacgcttccacaatccctaagctgagacgtgagttcagtttatgtcgagtctacataacaacaggaagctccagagcttttgatagacgtcctgagggagttttgcagacagagagaatgctaacaagtgatgttgcagtagctgagacatcgttccgtgtggaaagctcactggaaacttcgatttcaggaggagaacatattgatgtctctatgaacacagagtttgttgatggactatcagaaccgatgtgggactgggaacagctgacttggccttgaagctatatagattttataatcaagcaaatttaaacttgtttcaattgcttattgttagtttgaattttatgacccgaaagattctttttctttctttaccttgtaacgtgagaatttgagaaataataaatgacctagacagtgacatttgaaaaaaaaaaaaaaaaaaaaaaaa

SEQ ID NO: 1400 - protein, 235 aa, Arabidopsis thaliana
MADEVTIGFRFYPTEEELVSFYLRNQLEGRSDDSMHRVIPVLDVFEVEPSHLPNVAGVRCRGDAEQWFFFVPRQEREARGGRPSRTTGSGYWKATGSPGPVFSKDNKMIGAKKTMVFYTGKAPTGRKTKWKMNEYHAVDETVNASTIPKLRREFSLCRVYITTGSSRAFDRRPEGVLQTERMLTSDVAVAETSFRVESSLETSISGGEHIDVSMNTEFVDGLSEPMWDWEQLTWP

SEQ ID NO: 1401 - DNA, 1285 bp, Arabidopsis thaliana
aaagctccctgagcaagtgagaagagaccacactgagaagaaaaatccttcaggttatcgaaaattcccggattttactctttgggcggtggccgatttcttacgcgctctttttgtggcgactgttgtatacgcgcgagccttcatggacacgaaggcggttggagtttctaaggatacggcggcgtcgatggaagcgtcgacggtgtttcctgggtttaaattctcgccgacggatgtggagttgatttcgtattacctgaagcggaagatggatggcttggagaggtccgttgaggttataccggaccttgagatttacaatttcgagccttgggatttacccgataagtcgattgtgaaatctgatagcgagtggttcttcttctgtgcgcgtgggaaaaagtatccacatggttcacagaacaggagagcaacgaagatgggatactggaaagcaactgggaaagagcgtgatgtgaagtctggttctgaggtcattggaacaaagaggacgcttgttttccatattggtcgtgcaccaaaaggcgaaagaactgactggattatgcacgagtactgcgtgaaaggagtatctctggatgatgctatggttgtttgccgggttaggaggaacaaagaatacaatagtggtacaagtcagaaggcaccaaagccaaattcatcagccgagaagcatgcgaaagtccaaaatggcgctacgagttcagggagcccgtctgattgggacaacttggttgatttttacctagcaggtgaatcaggggagaaactactcgctgagatggcagagtcatcagaaaatctacaggtggataatgacgaggatttctttgcggatatcctaagagacgaaatcatcaatctcgatgaagcggtgatgacagggaacacaccaaacgaagtgccaacactagaatcagcatcaatggagataagggtacttcctttaccaaacatgatagacaaacaaatgtcatcactgttagaggaaagaccatcacagaagaagaaaggaaaagacgccacggaatcattgtcgagctgcttcgtgggtttatactcgatcaaatcagtgaacaaggcacgatgggatgttattataggtgtagtggctctgatagcaatgttgttttatctagaataagaggcttatggaagtagcgaaaaacagtgtcctagctatgtttgtatcatcttttctcggacattgacaaggattatatgatgtttttgtgtaaaaaaaaaaaaaaaaaaaaaaaaa

SEQ ID NO: 1402 - protein, 340 aa, Arabidopsis thaliana
MDTKAVGVSKDTAASMEASTVFPGFKFSPTDVELISYYLKRKMDGLERSVEVIPDLEIYNFEPWDLPDKSIVKSDSEWFFFCARGKKYPHGSQNRRATKMGYWKATGKERDVKSGSEVIGTKRTLVFHIGRAPKGERTDWIMHEYCVKGVSLDDAMVVCRVRRNKEYNSGTSQKAPKPNSSAEKHAKVQNGATSSGSPSDWDNLVDFYLAGESGEKLLAEMAESSENLQVDNDEDFFADILRDEIINLDEAVMTGNTPNEVPTLESASMEIRVLPLPNMIDKQMSSLLEERPSQKKKGKDATESLSSCFVGLYSIKSVNKARWDVIIGVVALIAMLFYLE

SEQ ID NO: 1403 - DNA, 1380 bp, Arabidopsis thaliana; identical to SEQ ID NO: 117

SEQ ID NO: 1404 - protein, 459 aa, Arabidopsis thaliana; identical to SEQ ID NO: 118

SEQ ID NO: 1405 - DNA, 1242 bp, Arabidopsis thaliana
cagatctgttctttacaccaaattgagtactgaagatcttgttgagtgaattaaagagatgagatcaggagaatgtgatgaagaggagattcaagcaaagcaagaaagagatcaaaatcaaaatcatcaagtaaacttaaaccacatgttgcaacaacaacagccgagttcggtatcatcttcaaggcaatggacttcagcttttaggaatccaagaatcgttcgagtctcaagaacattcggtggcaaagacagacacagcaaagtatgtacagtccgtggtcttcgagaccggaggataaggttgtccgtacctacagctattcaactctacgaccttcaagatcgattagggctgagtcagccaagcaaagtcattgattggttactcgaagcagcaaaagatgacgtagacaagctacctcctctacaattcccacatggatttaaccagatgtatccaaatctcatcttcggaaactccgggtttggagaatctccatcttcaactacatcaacaacgtttccaggaaccaatctcgggttcttggaaaattgggatcttggtggttcttcaagaacaagagcaagattaaccgatacaactacgacccaaagagaaagttttgatcttgataaaggaaaatggatcaaaaacgacgagaatagtaatcaagatcatcaagggtttaacaccaatcatcaacaacaatttcctctgaccaatccgtacaacaacacttcagcttattacaaccttggacatcttcaacaatcgttagaccaatctggtaataacgttactgtcgcaatatctaatgttgctgctaataataacaataatctcaatttgcatcctccttcctcgtctgccggagatggatctcagctttttttcggtcctactcctccggcaatgagctctctattcccgacatacccttcgtttcttggagcttctcatcatcatcatgtcgtcgatggagccggtcatcttcagctctttagctcgaattcaaataccgcatcgcagcaacacatgatgccgggtaatacgagtttgattagaccatttcatcatttgatgagctcgaatcatgatacggatcatcatagtagcgataatgaatcagattcttgaatgattttatatatctacactatacattgaaaatgttatatgtatacgtattcttctatattttgatatatatgcgtattgttggattggtttatgtatct

SEQ ID NO: 1406 - protein, 360 aa, Arabidopsis thaliana
MRSGECDEEEIQAKQERDQNQNHQVNLNHMLQQQQPSSVSSSRQWTSAFRNPRIVRVSRTFGGKDRHSKVCTVRGLRDRRIRLSVPTAIQLYDLQDRLGLSQPSKVIDWLLEAAKDDVDKLPPLQFPHGFNQMYPNLIFGNSGFGESPSSTTSTTFPGTNLGFLENWDLGGSSRTRARLTDTTTTQRESFDLDKGKWIKNDENSNQDHQGFNTNHQQQFPLTNPYNNTSAYYNLGHLQQSLDQSGNNVTVAISNVAANNNNNLNLHPPSSSAGDGSQLFFGPTPPAMSSLFPTYPSFLGASHHHHVVDGAGHLQLFSSNSNTASQQHMMPGNTSLIRPFHHLMSSNHDTDHHSSDNESDS

SEQ ID NO: 1407 - DNA, 228 bp, Arabidopsis thaliana
atggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattga

SEQ ID NO: 1408 - protein, 75 aa, Arabidopsis thaliana
MDNHRRTKQPKTNSIVTSSSEEVSSLEWEVVNMSQEEEDLVSRMHKLVGDRWELIAGRIPGRTAGEIERFWVMKN

SEQ ID NO: 1409 - DNA, 1882 bp, Arabidopsis thaliana
atacaactttttgtctctttctctactaataataataatccgaactttgtttgttcttctacttcaattcataatctttgacggcgatgactatggagcaagaaattgaagtcttggaccagtttccggttgggatgagagttcttgctgttgacgatgaccagacttgtctccgtattctccagactttgcttcagcgctgccaatatcacgttacaacaacgaatcaggcacagaccgcattggagttgttgagggagaacaagaataagtttgatcttgttattagcgatgtcgacatgccagacatggatggtttcaagctgcttgagcttgttggtcttgaaatggacttacctgtcataatgttatctgcgcatagcgatccaaagtatgtgatgaaaggagtcaagcacggtgcctgtgattatctgcttaaaccggttcgaattgaggagcttaagaacatatggcaacatgttgtgagaaagagcaaacttaagaagaataagagcaatgtgagtaatggttcaggaaactgtgataaagcaaacagaaaacgtaaagaacagtatgaagaggaggaagaggaagaaagagggaatgataatgatgatccaacggcgcagaagaagcctcgtgttctttggacgcatgagctgcacaataaattcctagcagctgttgatcatttaggcgttgagagagctgttccaaaaaagattctagatctgatgaatgttgacaaactcactagagagaatgttgcaagccaccttcagaaattccgcgttgctctgaagaaggtgtctgatgacgccattcaacaagctaacagggcggctattgactcacattttatgcaaatgaattctcagaaaggacttggtggcttctaccaccaccaccgcggaatacctgttggatccggtcagttccatggtggaaccacaatgatgaggcattactcttcaaataggaatcttggtcgtctgaattcccttggagcaggaatgttccaaccagtctcatcatcgtttcctcgtaaccataatgatggaggaaacatacttcagggtttgccgctagaagagcttcagatcaacaacaacatcaacagggcttttccaagctttacttcacaacaaaactctccaatggtagctcccagtaatctgttacttctcgagggtaacccgcagtcatcatctttaccctcaaacccgggtttttctcctcatttcgagatcagcaagcgtctagaacattggtcaaacgctgcattgtcaaccaacattccacagagtgatgttcattcaaaacctgacaccttggaatggaatgcgttctgcgactcagctagtccgctagtaaacccaaacctggatacaaatccggcatctctctgcagaaacacgggttttggatccacaaatgctgcacaaacagacttcttttatccattacagatgaatcagcagcctgcaaacaactcaggtccagtgacagaagctcaactgtttagaagtagcaatccaaacgaaggtttactcatgggacaacagaagcttcagagtggtttgatggcttctgatgctggttccttagatgatatagtcaattccttaatgacacaggaacagagccaatctgatttctcggaaggtgattgggatttggatggtttagctcactcggaacatgcatacgagaaactccattttcccttttctttgtcagcttgagaaacctgttttattcagacacaatcaattattattatcttttggttctgtctcttctctcttctctgtaatgaaagtgtaagctattgtttaccgctcccccactggtttgagcaacttaggaagatccaaatcca

SEQ ID NO: 1410 - protein, 552 aa, Arabidopsis thaliana
MTMEQEIEVLDQFPVGMRVLAVDDDQTCLRILQTLLQRCQYHVTTTNQAQTALELLRENKNKFDLVISDVDMPDMDGFKLLELVGLEMDLPVIMLSAHSDPKYVMKGVKHGACDYLLKPVRIEELKNIWQHVVRKSKLKKNKSNVSNGSGNCDKANRKRKEQYEEEEEEERGNDNDDPTAQKKPRVLWTHELHNKFLAAVDHLGVERAVPKKILDLMNVDKLTRENVASHLQKFRVALKKVSDDAIQQANRAAIDSHFMQMNSQKGLGGFYHHHRGIPVGSGQFHGGTTMMRHYSSNRNLGRLNSLGAGMFQPVSSSFPRNHNDGGNILQGLPLEELQINNNINRAFPSFTSQQNSPMVAPSNLLLLEGNPQSSSLPSNPGFSPHFEISKRLEHWSNAALSTNIPQSDVHSKPDTLEWNAFCDSASPLVNPNLDTNPASLCRNTGFGSTNAAQTDFFYPLQMNQQPANNSGPVTEAQLFRSSNPNEGLLMGQQKLQSGLMASDAGSLDDIVNSLMTQEQSQSDFSEGDWDLDGLAHSEHAYEKLHFPFSLSA

SEQ ID NO: 1411 - DNA, 513 bp, Arabidopsis thaliana
atggcgactcaagattctcaagggattaaactctttggcaaaactattgcatttaacactcgaacaataaaaaatgaagaagagacacacccgccggagcaagaagccacaatagccgttagatcatcatcatcatcggatctgacggccgagaagcgtccggataagatcatagcatgtccaagatgcaagagcatggagacaaagttctgttacttcaacaactacaacggtaatcagcctcgacacttttgtaaaggctgccaccgttactggaccgccggtggtgcactccggaacgttcccgtcggcgccggtcgtcggaagtccaaaccacctggtcgtgtcgtggttggtatgcttggagatggaaatggtgttcgccaagtcgagcttataaatggcttgctcgttgaggagtggcagcatgccgcagccgcagctcacggtagtttccggcatgattttcccatgaagcggctccggtgttactccgacggtcaatcgtgctga

SEQ ID NO: 1412 - protein, 170 aa, Arabidopsis thaliana
MATQDSQGIKLFGKTIAFNTRTIKNEEETHPPEQEATIAVRSSSSSDLTAEKRPDKIIACPRCKSMETKFCYFNNYNGNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 1413 - DNA, 1212 bp, Arabidopsis thaliana
aaaaaatatgggtatccaagaaactgacccgttaacgcaattgagtttaccaccgggtttccgattttacccgaccgatgaagagcttatggttcaatatctctgtagaaaagcagctggttacgatttctctcttcagctcatcgccgaaatagatctttacaaattcgatccatgggttttaccaaataaagcattatttggagaaaaagaatggtatttttttagtcctagggatagaaaatatccaaacgggtcaagacctaaccgggttgccggatcgggttattggaaagctacgggtacggataaaataatctcgacggaaggacaaagagttggtattaaaaaagctttggtgttttacatcggaaaagctcctaaaggtactaaaaccaattggatcatgcatgagtatcgtctcattgaaccttctcgtagaaacggaagcactaagttggatgattgggttctatgtcgaatatacaagaagcaatcaagtgcacaaaaacaagtttacgataatggaatcgcgaatgctagagaattcagcaacaacggtacttcgtccacgacgtcgtcttcttctcactttgaagacgttcttgattcgtttcatcaagagatcgacaacagaaatttccagttttctaacccaaaccgcatctcgtcgctcagaccggacttaaccgaacagaaaaccgggttccacggtcttgcggatacttctaacttcgattgggctagttttgccggtaatgttgagcataataactcggtaccggaactcggaatgagtcatgttgttcctaatctcgagtacaactgtggctacctgaagacggaggaggaagtcgagagcagtcacgggtttaataactcgggcgagttagctcaaaagggttatggtgttgactcgtttgggtattcggggcaagttggtgggtttgggtttatgtgatgatgaaatgctgacgcaataaaaataagtcgttaatttttgtcccgtggcaaatcttatatgtatttgaatttcaattcttttgggttaagagggagactcatagatttagatgtagatttgtaatctttcatgcatagaaaatttgacgaatagatttcgtaactttattttgttgctgtttggttatctttgtattggtataaatttagtggattgaaattgcatattgaaaaaaaaaaaaaaaaaaa

SEQ ID NO: 1414 - protein, 317 aa, Arabidopsis thaliana
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 1415 - DNA, 1324 bp, Arabidopsis thaliana
tccgggcaggtcttcaatctcagaaggcaaaaaagaaaatcaaagaagatagttttgtgattgttttctataaaaagtgcagatattttctttgtcctagagaaagaggtgataggaaaaatgggtctccaagagcttgacccgttagcccaattgagcttaccgccgggttttcggttttatccgactgacgaagagctgatggttgaatatctctgtagaaaagccgccggtcacgacttctctctccagctcatagctgaaatcgatctctacaagtttgatccatgggttttaccaagtaaggcgttattcggtgaaaaagaatggtattttttcagcccgagggataggaagtatccaaacgggtcaagacctaatcgggttgccgggtcgggttattggaaagccaccggtacggataaagttatctcgacggagggaagaagagttggtatcaagaaagctttggtgttttacattggaaaagctccaaaaggaaccaaaaccaattggattatgcatgagtaccgtctcatcgaaccctctcgtcgaaatggaagcaccaagcttgatgattgggttttatgtcgaatatacaaaaagcaaacaagcgcacaaaaacaagcttacaataatctaatgacgagtggtcgtgaatacagcaacaatggttcgtcgacatcttcttcgtctcatcaatacgacgacgttctcgagtcgttgcatgagattgacaacagaagtttggggtttgccgccggttcatcaaacgcgctgcctcatagtcatagaccggttttaaccaatcataaaaccgggtttcagggtttagccagggagccaagttttgattgggcgaatttgattggacagaactcggtcccggaactcggactgagtcataacgttccgagtattcgttacggtgacggtggaacgcagcaacaaactgaggggattcctcggtttaataataactcggacgtctcggctaatcagggttttagtgttgacccggttaacggatttgggtactcgggtcaacaatctagtgggttcgggtttatttgattgtgtaatggtaacgtaataagaaaaacatatttttattttttgtccgtgtcagattagttaattaatatagcgtagaattcgaactctagggttagatttaggttctacgacttgtattgtatattcgtcgtcatttgtcctgacatttacatttttgtaaacttttatagctggaacttttgtattgatcaattatttattagaaaaacagatattgcattggatctataaaaaaaaaaaaaaaaaa

SEQ ID NO: 1416 - protein, 317 aa, Arabidopsis thaliana
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 1417 - DNA, 1730 bp, Arabidopsis thaliana
cggagtagtgaatctcggaattgttgaagaagacggtacaccggaatcaattgcgattttgatttatgggaacggtttgcgaatctgtagcgacggcgaaatcttcgacggcggtgatgagctccattccgccttttctgagcaaaacgtacgatatggttgacgatccattgacggacgacgtggtgtcttggagcagcggaaacaacagcttcgtggtttggaacgtgcctgagttcgccaaacagtttctaccaaagtatttcaagcacaacaatttctccagcttcgtcagacagctcaatacttatggttttagaaaagttgatccagaccgctgggagtttgcaaacgagggctttttaagaggccaaaagcaaatactaaagagtattgtccggcgaaaacctgcacaagtgcagcctccacaacaacctcaagttcagcactcatctgtgggtgcgtgcgttgaagtgggcaaatttggactcgaagaggaagtggaaagacttcagcgcgataagaacgtccttatgcaggaacttgtaaggttgaggcagcaacaacaagttaccgaacatcatctgcagaatgtggggcagaaagttcatgtgatggagcagaggcagcaacagatgatgtcctttctagcaaaggctgtccaaagtccaggtttcttaaaccaattttctcagcagagtaatgaagcaaaccaacacatttctgaaagcaacaaaaagaggaggctacctgttgaggaccagatgaattctggcagtcatggggttaatggtcttagccgccagattgtgagatatcagtcatcgatgaacgatgcaacaaacactatgcttcaacagatacagcagatgagtaatgcacctagccatgaatctctctcaagcaataatggtagctttcttttgggcgatgttccaaattctaacatttcagacaatgggagctcctcaaatggatcacctgaagttacattggcagatgtttcatccattcctgcaggcttctatcctgcaatgaagtaccacgagccttgtgaaacaaatcaagtcatggagaccaatttgcctttttctcaaggtgatctcttacctccaacgcaaggagcagcagcttctgggagctcaagttcggatcttgttggatgcgagacagataatggagagtgtttggatccaataatggctgttttggatggcgcactcgaactagaagctgataccttaaatgagttgcttcctgaagtccaagattctttttgggaacagttcattggtgagagcccagtgattggtgagacagatgagttaatctcaggatcagtggaaaatgaactgatattggagcaactagagttacaatcaaccctgagtaatgtgtggagcaagaatcaacaaatgaaccatcttactgaacagatgggacttctcacatcagatgctctcagaaaatgagattgccacaggccacaatctttcctcacgagatgggttaagattttgtggagccgcaacaacaaaaagaatatgaccaaaggaggtactatgtatgtatgtatcaaactgttgtaactctaattcttgtcaatgtataataaaataagagaaatattgccttaaaagatttttgcattgcaatatctttgtttgttactgacagaatgaaaaggagatgcttcaaagtgagagatattcttctgttcttgtgtatgt

SEQ ID NO: 1418 - protein, 468 aa, Arabidopsis thaliana
MGTVCESVATAKSSTAVMSSIPPFLSKTYDMVDDPLTDDVVSWSSGNNSFVVWNVPEFAKQFLPKYFKHNNFSSFVRQLNTYGFRKVDPDRWEFANEGFLRGQKQILKSIVRRKPAQVQPPQQPQVQHSSVGACVEVGKFGLEEEVERLQRDKNVLMQELVRLRQQQQVTEHHLQNVGQKVHVMEQRQQQMMSFLAKAVQSPGFLNQFSQQSNEANQHISESNKKRRLPVEDQMNSGSHGVNGLSRQIVRYQSSMNDATNTMLQQIQQMSNAPSHESLSSNNGSFLLGDVPNSNISDNGSSSNGSPEVTLADVSSIPAGFYPAMKYHEPCETNQVMETNLPFSQGDLLPPTQGAAASGSSSSDLVGCETDNGECLDPIMAVLDGALELEADTLNELLPEVQDSFWEQFIGESPVIGETDELISGSVENELILEQLELQSTLSNVWSKNQQMNHLTEQMGLLTSDALRK

SEQ ID NO: 1419 - DNA, 1210 bp, Arabidopsis thaliana
  misc_feature (1194)..(1196): n is a, c, g, or t
acaaaaccacatctctgaactgaaccaatttctcttctcccccttccggttatcggattaccagatctcgtttcccgcgatctagtttattctttgaaaaagtgatagaagcagaaatgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataatataattcggtgtgccaacacacttatgttgacctcgtcggaatcatatcacaattcactgtgtcagcttgcctctgcataagcgaaaataaaaacataaacatgatcagtttgcattccatatctatcaaacaccagctttgtaacttttaaaactttttctccgtgcaaagacctttggtttggcgcttaagcatgtagtttgatgatcaaaggaaatgggtgttttagcataaagttgtcacccttccgttgcattttagcttcccatccaaatcaatttgtaaaatgtgagttagtttgcagcatgaaagctgattaaatatcagtcccgttatcacaagaggtaaaaaannnaaaaaaaaaaaaaa

SEQ ID NO: 1420 - protein, 240 aa, Arabidopsis thaliana
MGRGKIAIKRINNSTSRQVTFSKRRNGLLKKAKELAILCDAEVGVIIFSSTGRLYDFSSSSMKSVIERYSDAKGETSSENDPASEIQFWQKEAAILKRQLHNLQENHRQMMGEELSGLSVEALQNLENQLELSLRGVRMKKDQMLIEEIQVLNREGNLVHQENLDLHKKVNLMHQQNMELHEKVSEVEGVKIANKNSLLTNGLDMRDTSNEHVHLQLSQPQHDHETHSKAIQLNYFSFIA

SEQ ID NO: 1421 - DNA, 1077 bp, Arabidopsis thaliana; identical to SEQ ID NO: 157

SEQ ID NO: 1422 - protein, 358 aa, Arabidopsis thaliana; identical to SEQ ID NO: 158

SEQ ID NO: 1423 - DNA, 3832 bp, Arabidopsis thaliana
gtaaaatttagcagagagaagaatgaaacaaataattatagcaccgtcacgtcgccgccgtatttcgttaccggaaaaaaaaaaatcattcttcaacataaaaataaaaacagtctctttctttctatctttgtctatctttgattattctctgtgtacccatgttctgcaacagttgagcaagtgcatgccccatatctctctgtttctcatttcccgatctttgcattaatcatatacttcgcctgagatctcgattaagccagcttatagaagaagaaacggcaccagcttctgtcgttttagttagctcgagatctgtgtttctttttttcttggcttctgagcttttggcggtggtgggtttttctggagaaacccaaacgactatcaaagttttgttttttacaattttaagtgggagttatgagtggggtggattaagtaagttacaagtatgaaggagttgaagattcgaagaagcggttttgaagtcggcgagaccaagattgcgagcttatttggctgatgatttatttcagggaagaagaaataaatctgttttttttagggtttttagatttggttggtgaatgggtgggaggtggagggaaacagttaaaaaagttatgcttttagtgtctcttcttcataattacatttgggcatcttgaaatctttggatctttgaagaaacaaagttgtgttttttttttgttctttgttgtttgctttttaagttagaataaaaaatgagattatcttcagctgggtttaatcctcaacctcatgaaggagagaaaagagttcttaattctgagctctggcatgcttgtgctggtcctcttgtctcactacctcctgttggaagcagagttgtgtattttcctcaaggtcacagtgaacaggttgctgcttcgaccaacaaagaagtagatgctcatataccaaattatccgagcttgcatccgcagcttatctgtcagcttcataatgttacaatgcatgctgatgtggagactgatgaagtctatgcacagatgactttgcaaccgttgaatgcgcaagagcaaaaagatccttaccttcccgcggaattaggtgtcccaagtagacagcctacaaactatttctgtaaaactctgactgctagtgatacaagcactcacggaggtttttctgtacctcgccgagctgctgagaaagttttccctcccttggattactcgcagcagccaccagctcaagagttaatggcgagggatctgcatgataatgaatggaagttcaggcatattttccgaggccaaccaaagagacatctccttaccacgggttggagcgtatttgtgagtgctaaaaggcttgttgctggtgactctgttcttttcatctggaacgataagaatcaattacttcttggtataagacgagccaaccgaccacaaactgtcatgccttcatctgttttgtcaagtgacagtatgcatttaggccttcttgctgcagcagctcatgctgccgctacaaacagccgattcaccatcttctataacccgagggcgagtccatcagagtttgttatacccctggctaagtatgtgaaagcggtttatcacactcgcgtctctgttggtatgcggtttaggatgctgtttgaaactgaagaatctagtgttcgtcggtacatgggtacaataactggcatttgtgatctagatcctactcgttgggctaattcgcattggcgatctgtcaaggttgggtgggacgaatctactgcaggagagagacagccaagggtttcattgtgggagattgagcctttaacaacattccctatgtatccatctccttttcctctcaggcttaaacggccgtggcctcctggtctcccatctttccatggccttaaagaagatgatatgggtatgagtatgagttcaccgcttatgtgggatcgaggactccaatctctaaactttcaaggtatgggagtaaacccgtggatgcagccgagacttgatacgtcgggcttgcttggtatgcaaaatgatgtgtaccaagcaatggctgcagctgcccttcaagacatgagaggcattgatcctgcaaaagctgctgcttcacttcttcagttccaaaattcgccggggttctcaatgcaatctccgtccttagtgcagccgcagatgctgcagcagcaactctctcagcagcagcaacaactctctcagcagcagcagcagcagcaacagctctcccaacagcagcagcaacagctctctcaacagcagcagcagcagctctctcaacagcagcagcaacaactctctcagcagcagcagcaacaggcgtatcttggcgttcctgaaacccaccagcctcagtctcaggctcaatcacagtcaaacaatcatctttctcagcagcagcagcaagtagtggataatcataatccgtctgcgtccagtgctgctgttgtttccgctatgtctcaatttggttctgcttctcagcccaacacgtcaccactccagtccatgacctctctgtgtcatcagcaaagcttctccgataccaacggaggaaacaatcctatttctccacttcacactcttctcagtaacttctctcaagacgaatcttctcaactgctccacctcactagaacaaactctgcaatgacttcatccggttggccatcaaagcgtcctgcagttgattcatcgttccagcactctggagccggtaataataacactcaatccgtattggagcaactgggacagtcccacacaagcaacgttcctccaaacgctgtctcgttgcctccatttcccggtggtagagagtgctcgatcgagcaagaaggaagcgcctcagacccgcatagccatcttctctttggagtcaatatagattcatcttctcttttgatgccgaacggaatgtcaaaccttagaagcattggtattgaaggtggtgactccacgactttacccttcacatcatctaatttcaacaatgatttctcgggtaatcttgcaatgacaacaccttctagttgcatagatgaatcgggttttctacaatcctcagaaaacctcggttccgagaacccacaatctaacacctttgtgaaggtgtacaagtcagggtcttttggaagatcgttagatatatcaaagtttagcagctaccacgagctgcgaagcgagcttgctcgcatgtttggcctcgaaggccaattagaagaccctgtgagatcaggctggcagcttgtatttgttgaccgagagaacgacgttcttctcctcggcgatgacccttggccggagtttgtgagcagcgtgtggtgcattaagatactgtcaccacaagaagtgcaacaaatgggaaaaagaggccttgagcttctcaactccgcgccatcttccaacaatgtcgataagctcccgagcaacgggaactgtgacgactttgggaaccggtcagacccgaggaatctcggtaacggtatcgcatcagttgggggttcattcaactactagaagtagatggaaacctccctttttattcaagttaagtttcaatcttataaattagtagtgagatcatcttagtttaattactagcaaaaatctctctttattacttataaaaaagggagatttgcctttgcctttgatggaaacaaaaactatataatccctctgtcgactcgtaatactgtaattataagatcttttggtctttttcttatatgaatatttttactgaactctatatatgtcactttccttaaaaaaaaaaaaaaaaaaaaaaaaaa

SEQ ID NO: 1424 - protein, 933 aa, Arabidopsis thaliana
MRLSSAGFNPQPHEGEKRVLNSELWHACAGPLVSLPPVGSRVVYFPQGHSEQVAASTNKEVDAHIPNYPSLHPQLICQLHNVTMHADVETDEVYAQMTLQPLNAQEQKDPYLPAELGVPSRQPTNYFCKTLTASDTSTHGGFSVPRRAAEKVFPPLDYSQQPPAQELMARDLHDNEWKFRHIFRGQPKRHLLTTGWSVFVSAKRLVAGDSVLFIWNDKNQLLLGIRRANRPQTVMPSSVLSSDSMHLGLLAAAAHAAATNSRFTIFYNPRASPSEFVIPLAKYVKAVYHTRVSVGMRFRMLFETEESSVRRYMGTITGICDLDPTRWANSHWRSVKVGWDESTAGERQPRVSLWEIEPLTTFPMYPSPFPLRLKRPWPPGLPSFHGLKEDDMGMSMSSPLMWDRGLQSLNFQGMGVNPWMQPRLDTSGLLGMQNDVYQAMAAAALQDMRGIDPAKAAASLLQFQNSPGFSMQSPSLVQPQMLQQQLSQQQQQLSQQQQQQQQLSQQQQQQLSQQQQQQLSQQQQQQLSQQQQQQAYLGVPETHQPQSQAQSQSNNHLSQQQQQVVDNHNPSASSAAVVSAMSQFGSASQPNTSPLQSMTSLCHQQSFSDTNGGNNPISPLHTLLSNFSQDESSQLLHLTRTNSAMTSSGWPSKRPAVDSSFQHSGAGNNNTQSVLEQLGQSHTSNVPPNAVSLPPFPGGRECSIEQEGSASDPHSHLLFGVNIDSSSLLMPNGMSNLRSIGIEGGDSTTLPFTSSNFNNDFSGNLAMTTPSSCIDESGFLQSSENLGSENPQSNTFVKVYKSGSFGRSLDISKFSSYHELRSELARMFGLEGQLEDPVRSGWQLVFVDRENDVLLLGDDPWPEFVSSVWCIKILSPQEVQQMGKRGLELLNSAPSSNNVDKLPSNGNCDDFGNRSDPRNLGNGIASVGGSFNY

SEQ ID NO: 1425 - DNA, 1059 bp, Arabidopsis thaliana
atggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttctatcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttgattagttttttttgagtttttgaacgatgtgtatgctgacgtggacgtacacgtaggtgcatgcgatgaaaaaaacatctatttgttcatatttttgcgtttttctatttgttcattctttttcacaattcacaatacattatttcagttaatgatc

SEQ ID NO: 1426 - protein, 300 aa, Arabidopsis thaliana
MATPNEVSALWFIEKHLLDEASPVATDPWMKHESSSATESSSDSSSIIFGSSSSSFAPIDFSESVCKPEIIDLDTPRSMEFLSIPFEFDSEVSVSDFDFKPSNQNQNQFEPELKSQIRKPPLKISLPAKTEWIQFAAENTKPEVTKPVSEEEKKHYRGVRQRPWGKFAAEIRDPNKRGSRVWLGTFDTAIEAARAYDEAAFRLRGSKAILNFPLEVGKWKPRADEGEKKRKRDDDEKVTVVEKVLKTEQSVDVNGGETFPFVTSNLTELCDWDLTGFLNFPLLSPLSPHPPFGYSQLTVV

SEQ ID NO: 1427 - DNA, 2126 bp, Arabidopsis thaliana; identical to SEQ ID NO: 167

SEQ ID NO: 1428 - protein, 693 aa, Arabidopsis thaliana; identical to SEQ ID NO: 168

SEQ ID NO: 1429 - DNA, 2054 bp, Arabidopsis thaliana
catctgttctgagattgtcttcttcttcttgaaatctttttcatttgtgcaatgattttgaagactacccatctattcagttctttctcttatgatttaagtttcatttagtttttttttctcatccgccattttcgttgactttttgaagcatttctcgaattgactttgttcttcacattgattcattagaatgttctttcataaagtttggatcttttcttcagggcttgattaatttcatatctatgatcttctctgtattgtttttgatccaatcacttctcaaaatttgatccttgtcattggatttagatttagggtttttgtatccttggggatttgaagatcaaaaacagagtctttgagtgatacttctggggaacaaaatggctgcaactgcaatagagccatcttcatctataagtttcacatcttctcacttatcaaacccttctcctgttgttactacttatcactcagctgctaatcttgaagagctcagctctaacttggagcagcttctcactaatccagattgcgattacactgacgcagagatcatcattgaagaagaagctaaccctcggaagcttcgtaactatgttgagaagtcactagtagagaatgttcttcctatcctcttagttgcgtttcattgtgatttgacacagcttcttgatcaatgcattgagagagtggcgagatcagacttagacagattctgtatcgaaaaggagcttcctttagaagtattggaaaaaatcaaacagcttcgagttaagtcggtgaacatacccgaggtggaggataaatcgatagagagaacagggaaagtactcaaggcattggattcagatgatgtagaactcgtgaagcttcttttgactgagtcagatataactctagaccaagccaatggtctacattatgcagtggcatacagtgatccgaaagttgtgacacaggttcttgatctagatatggctgatgttaatttcagaaattccagggggtatacggttcttcatattgctgctatgcgtagagagccaacaattatcataccacttattcaaaaaggagctaatgcttcagatttcacgtttgatggacgcagtgcggtaaatatatgtaggagactcactaggccgaaagattatcataccaaaacctcaaggaaagaacctagtaaataccgcttatgcatcgatatcttggaaagggaaattagaaggaatccattggttagtggggatacacccacttgttcccattcgatgcccgaggatctccaaatgaggttgttatacttagaaaagcgagtgggacttgctcagttgttcttcccagcagaagccaatgtggctatggacgttgctaatgttgaagggacaagcgagtgcacaggtcttctaactccacctccatcaaatgatacaactgaaaacttgggtaaagtcgatttaaatgaaacgccttatgtgcaaacgaaaagaatgcttacacgtatgaaagccctcatgaaaacagttgagacaggtcggagatacttcccatcttgttatgaggttctggataagtacatggatcagtatatggacgaagaaatccctgatatgtcgtatcccgagaaaggcactgtgaaagagagaagacagaagaggatgagatataacgagctgaagaacgacgttaaaaaagcatatagcaaagacaaagtcgcgcggtcttgtctttcttcttcatcaccagcttcttctcttagagaagccttagagaatccaacatgatcttgtcccagataagtaatgctactagagatagttccttggaagaaattagctattttataggttttggtttagaaaacagtggagatcccattttggtattcaggtttattacatggtttaggtttgattttgtattaaaggagatggatttttgaaatgtataaagcaaaacctttcctttttgctttgcttctttctttaaaaaaaaaattgtaatatatggaagtgaaatcgaagcaacgattgagcaaaaaaaaa

SEQ ID NO: 1430 - protein, 467 aa, Arabidopsis thaliana
MAATAIEPSSSISFTSSHLSNPSPVVTTYHSAANLEELSSNLEQLLTNPDCDYTDAEIIIEEEANPRKLRNYVEKSLVENVLPILLVAFHCDLTQLLDQCIERVARSDLDRFCIEKELPLEVLEKIKQLRVKSVNIPEVEDKSIERTGKVLKALDSDDVELVKLLLTESDITLDQANGLHYAVAYSDPKVVTQVLDLDMADVNFRNSRGYTVLHIAAMRREPTIIIPLIQKGANASDFTFDGRSAVNICRRLTRPKDYHTKTSRKEPSKYRLCIDILEREIRRNPLVSGDTPTCSHSMPEDLQMRLLYLEKRVGLAQLFFPAEANVAMDVANVEGTSECTGLLTPPPSNDTTENLGKVDLNETPYVQTKRMLTRMKALMKTVETGRRYFPSCYEVLDKYMDQYMDEEIPDMSYPEKGTVKERRQKRMRYNELKNDVKKAYSKDKVARSCLSSSSPASSLREALENPT

SEQ ID NO: 1431 - DNA, 2909 bp, Arabidopsis thaliana
gggttgtccaggaagaactcttctgtgtttgtttgatttgagctaatcagaaaggtgaaattgagaaaatggagggtgaagttgctactaacggagtgattctcaagcataatggtgtaaaggatatttctttagaaacttgttggccagagaagaagaaaccggttgaggcaacgagtcttagcagtggttcatcagacatagaagaagagattagtgtggaatgtcctaagcgagtggctaatcaaagacggaaacggtctaaagctgatgagattaaaacgaaatcttcaagaaagaggaaatgtgatgatgagaacaagtgtgaagagaatgagaagaagcagaggagctctgttaaaaagagagcaactacatggaaagaagaagaagttgttgttgatgatgaaaagaaatgcgaacaacaactccaactagttccttccagcaaggcaacatctcgaagcaggagcaagaaatcagtcagtgtggatacttggttggttaacaacgagattgatgttagcgctttgagttcgcgttctgagtctgaactttcggattcttatctgaaaaccgagtactttaatgactgcagaagcatgacaaggagtttaaaggcaaatttgggagagcttgcaatttgccatcaatgctctaaaggggaaagaagatatcttttcatttgcaccttttgtgaagtgaggttgtattgttttccatgcataaagaaatggtatccccatttgtccacggatgatatccttgaaaaatgtcccttttgccgaggaacttgcaactgctgcacatgtttgcactctagtggtttaatcgagacatctaagagaaagctcgataaatacgaaagattttatcatcttcgcttcttgattgtggcgatgcttcctttcctgaaaaagttatgcaaagcacaagatcaagaaatcgaaaccgaggctaaggttcaagattcaatggcttctcaagttgatatatccgagagtctatgctcaaatgaagagcgtgtcttctgtaaccactgtgcaacatcaattgttgacttgcatcgaagctgtccaaagtgttcatatgaattgtgtctgaactgttgccaagagatccgtggaggttggctttctgaccgcccggaatgtcagctacaattcgagtacagagggacccggtatatacatggcgaagctgcagaaccgagctcttcttctgtttccgaggatgaaactaaaactccatccatcaagtggaatgctgatgaaaatggaagcatacggtgtgcgccaaaagagctaggaggttgcggggactctgtgctggagcttaagcgaatcttaccagtgacttggatgtcagatttggagcaaaaggcagaaacattcttagcctcttatagtatcaaaccgccaatgtcatattgtagatgttcttctgatatgagtagtatgaagaggaaggcagcttcgagggacggatctagtgacaattacctttattctcctgattctttggatgtcctgaagcaagaagaacttctgcatttccaagagcattggtccaaaggtgaaccagtgattgttcgaaatgctcttaacaacacagctggtttaagctgggagccaatggtgatgtggcgggctttatgtgagaatgttgattcagcaattagctctaatatgtctgatgtcaaagctatcgattgtttagctaattgtgaggtgaagataaatactctatgtttctttgaaggatatagcaaaggaagaacatatgaaaacttctggcctgagatgctgaagctgaaggattggcctccttcagacaagtttgaaaaccttttacctcgtcactgcgatgagttcatttccgcattaccatttcaagaatacagcgatcctagatcaggaattctcaacattgctacaaaacttcctgaaggacttcttaaaccagatcttggtccaaaaacttatgttgcatatgggacttcagatgagctcggtagaggagattcagtcactaagcttcactgtgatatgtcagatgctgttaatattctgatgcatactgctgaagtaacactaagtgaggagcaaaggtctgcaattgcagatttgaaacagaaacataagcaacagaatgagaaagagcttcaggagcaaaatggtttagaggaagaagaggttatgagtgatgagattgtggtttatgatgaaacaagtggtgcactttgggacatctttaaaagagaagatgttcctaagcttgaagagtatctaaggaagcattgcatagaattcagacatacttattgctctcgtgttacaaaggtgtatcatccaatacatgatcagtcatatttcttaaccgtggagcataaaagaaaactcaaggcagaatttgggattgagccatggacatttgtgcaaaagctaggagaagcagtgtttattccagcaggttgtcctcatcaagttcggaatctcaagtcgtgcacaaaggtagctgttgattttgtttcccctgaaaacatcgatgagtgtctccgtttgactgatgagtttcgacaactccctaagaaccataaagccagagaagacaaacttgagataaaaaagatggtgatctatgcagttgaacaagctctgaaagaagtggagacattattgctagatcgcagctaaaagctctatagctttgttgttgtaggattaacagcagattttgtagaattgttaaagccatggctattgtagttggcttttgctgtgatatatgtatgtaaaagagacaagtgtctcttgaaaagaatgatttcctttttttcaaatgggattttgatgtaacttttccttttccggtctgttttggcatatgaatgaatatttgatgtaagc

SEQ ID NO: 1432 - protein, 875 aa, Arabidopsis thaliana
MEGEVATNGVILKHNGVKDISLETCWPEKKKPVEATSLSSGSSDIEEEISVECPKRVANQRRKRSKADEIKTKSSRKRKCDDENKCEENEKKQRSSVKKRATTWKEEEVVVDDEKKCEQQLQLVPSSKATSRSRSKKSVSVDTWLVNNEIDVSALSSRSESELSDSYLKTEYFNDCRSMTRSLKANLGELAICHQCSKGERRYLFICTFCEVRLYCFPCIKKWYPHLSTDDILEKCPFCRGTCNCCTCLHSSGLIETSKRKLDKYERFYHLRFLIVAMLPFLKKLCKAQDQEIETEAKVQDSMASQVDISESLCSNEERVFCNHCATSIVDLHRSCPKCSYELCLNCCQEIRGGWLSDRPECQLQFEYRGTRYIHGEAAEPSSSSVSEDETKTPSIKWNADENGSIRCAPKELGGCGDSVLELKRILPVTWMSDLEQKAETFLASYSIKPPMSYCRCSSDMSSMKRKAASRDGSSDNYLYSPDSLDVLKQEELLHFQEHWSKGEPVIVRNALNNTAGLSWEPMVMWRALCENVDSAISSNMSDVKAIDCLANCEVKINTLCFFEGYSKGRTYENFWPEMLKLKDWPPSDKFENLLPRHCDEFISALPFQEYSDPRSGILNIATKLPEGLLKPDLGPKTYVAYGTSDELGRGDSVTKLHCDMSDAVNILMHTAEVTLSEEQRSAIADLKQKHKQQNEKELQEQNGLEEEEVMSDEIVVYDETSGALWDIFKREDVPKLEEYLRKHCIEFRHTYCSRVTKVYHPIHDQSYFLTVEHKRKLKAEFGIEPWTFVQKLGEAVFIPAGCPHQVRNLKSCTKVAVDFVSPENIDECLRLTDEFRQLPKNHKAREDKLEIKKMVIYAVEQALKEVETLLLDRS

SEQ ID NO: 1433 - DNA, 1662 bp, Arabidopsis thaliana
atgagttacacgacggcgactgctgatagtgatgatggtatgcactccagcatccataatgaatcaccagctcctgatagtattagcaatggctgcagaagtagagggaaaagaagtgtcctgaagaaaggaccatggacttcaactgaagacgggattttaattgattatgtaaagaagcacggcgagggtaactggaatgctgtgcagaaacacactagcctggcccgttgtggtaaaagctgtcgtctgagatgggctaatcatctgaggccaaacttgaagaaaggagcatttagccaagaagaagaacagctcattgttgaaatgcacgccaagatgggaaataaatgggcacagatggctgaacatttacctggtcgaacagataatgagataaagaattattggaacactcgtatcaagaggagacaacgagcaggcttaccactttaccctcctgaaatctatgttgatgaccttcattggagcgaagagtatacaaagagtaatatcataagagtagatagaagaagaagacatcaagatttcttgcagttggggaattctaaagataatgtcttatttgacgatctaaattttgctgctagcttgttacctgccgcttctgacctatcagatttggttgcatgcaacatgctaggaactggcgcaagttcttcccggtatgagagctacatgccaccaatattgccttccccaaagcaaatctgggaatctggatctcggtttcccatgtgcagcagtaacataaagcatgaattccaatcgccggaacactttcagaatacggctgtacagaagaatcccagatcttgcagtatctcgccttgtgatgttgatcatcatccttatgaaaaccaacattcgtctcatatgatgatggttcctgatagccatacagttacgtatggcatgcatcctacttctaagcccttgtttggggcagtgaagctggagctcccttcattccaatattcagaaactagtgcatttgatcagtggaagacgactccgtcacctccacactcagatctccttgactctgttgatgcctatattcaatctccaccaccatcgcaggtagaggagtcagattgtttctcttcatgcgacaccggcctactagatatgttacttcatgaggccaagatcaaaactagtgcgaagcacagtttgttgatgtcatcaccccagaagagtttcagttcaactacttgcacgaccaatgttactcagaatgtaccacgtggcagcgaaaacctgatcaaatcaggagaatatgaagattcccaaaagtatttgggtcgctccgagattacaagtccctcgcaacttagtgcaggtggtttttcatcagcttttgcagggaatgttgtaaagacagaagagttggatcaggtttgggaaccaaagagagttgatataacacggcctgatgttttacttgcgtcgagctggcttgaccaaggctgttatggcattgttagtgacacaagcagcatgagtgatgcgcttgcacttcttggtggtgacgacattgggaacagttacgtgactgttgggtcatcatcaggtcaagcaccacgaggcgtcgggtcttatggatggaccaatatgcctcctgtttggtcgctgtaa

SEQ ID NO: 1434 - protein, 553 aa, Arabidopsis thaliana
MSYTTATADSDDGMHSSIHNESPAPDSISNGCRSRGKRSVLKKGPWTSTEDGILIDYVKKHGEGNWNAVQKHTSLARCGKSCRLRWANHLRPNLKKGAFSQEEEQLIVEMHAKMGNKWAQMAEHLPGRTDNEIKNYWNTRIKRRQRAGLPLYPPEIYVDDLHWSEEYTKSNIIRVDRRRRHQDFLQLGNSKDNVLFDDLNFAASLLPAASDLSDLVACNMLGTGASSSRYESYMPPILPSPKQIWESGSRFPMCSSNIKHEFQSPEHFQNTAVQKNPRSCSISPCDVDHHPYENQHSSHMMMVPDSHTVTYGMHPTSKPLFGAVKLELPSFQYSETSAFDQWKTTPSPPHSDLLDSVDAYIQSPPPSQVEESDCFSSCDTGLLDMLLHEAKIKTSAKHSLLMSSPQKSFSSTTCTTNVTQNVPRGSENLIKSGEYEDSQKYLGRSEITSPSQLSAGGFSSAFAGNVVKTEELDQVWEPKRVDITRPDVLLASSWLDQGCYGIVSDTSSMSDALALLGGDDIGNSYVTVGSSSGQAPRGVGSYGWTNMPPVWSL

SEQ ID NO: 1435 - DNA, 965 bp, Arabidopsis thaliana
tttttttttaaaagatttagagagaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcaaaaaaaa

SEQ ID NO: 1436 - protein, 203 aa, Arabidopsis thaliana
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 1437 - DNA, 1008 bp, Arabidopsis thaliana; identical to SEQ ID NO: 207

SEQ ID NO: 1438 - protein, 335 aa, Arabidopsis thaliana; identical to SEQ ID NO: 208

SEQ ID NO: 1439 - DNA, 537 bp, Arabidopsis thaliana
atggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagggtgacacaaagggatcagcaaaaggtggggatccaaatgcaaagaaagatgggcaatcaagccaaaatggccagttctcgcagcttgctcaccaaggtccttatgggaactctcaagtaacttttcctctcttctcttcacactcaagcaatacgcatcattctcttctaatttgttaa

SEQ ID NO: 1440 - protein, 178 aa, Arabidopsis thaliana
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREGDTKGSAKGGDPNAKKDGQSSQNGQFSQLAHQGPYGNSQVTFPLFSSHSSNTHHSLLIC

SEQ ID NO: 1441 - DNA, 839 bp, Arabidopsis thaliana
ctctgcctctctctctctctcaaaacccatctcgaaagtctttctctttcgagggtttagatcctccatggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaaaaatatatagtttggagcggtggctgttgctaacgtacgccaacggcttgcttctacgaatcattagcgccgtttatgatttttttttttttttttttcattatctgaaaatttagggctttttagttattaatttttgttttgtttttttcctttcttgcgagttttgcggtttatggaattttaggctattgcttaacgaaaaaaaaaaaaaaaa

SEQ ID NO: 1442 - protein, 184 aa, Arabidopsis thaliana
MEGGGVADVAVPGTRKRDRPYKGIRMRKWGKWVAEIREPNKRSRLWLGSYSTPEAAARAYDTAVFYLRGPTARLNFPELLPGEKFSDEDMSAATIRKKATEVGAQVDALGTAVQNNRHRVFGQNRDSDVDNKNFHRNYQNGEREEEEEDEDDKRLRSGGRLLDRVDLNKLPDPESSDEEWESKH

SEQ ID NO: 1443 - DNA, 844 bp, Arabidopsis thaliana
tctctctcccactctcactttctctcctattcttagttcgtgtcagaaacacacagagaaattaagaaccctaatttaaaacagaagaatggtacattcgaagaagttccgaggtgtccgccagcgtcagtggggttcttgggtttctgagattcgtcatcctctcttgaagagaagagtgtggctaggaacattcgacacggcggaaacagcggctagagcctacgaccaagccgcggttctaatgaacggccagagcgcgaagactaacttccccgtcatcaaatcgaacggttcaaattccttggagattaactctgcgttaaggtctcccaaatcattatcggaactattgaacgctaagctaaggaagaactgtaaagaccagacaccgtatctgacgtgtctccgcctcgacaacgacagctcacacatcggcgtctggcagaaacgcgccgggtcaaaaacgagtccaaactgggtcaagcttgttgaactaggtgacaaagttaacgcacgtcccggtggtgatattgagactaataagatgaaggtacgaaacgaagacgttcaggaagatgatcaaatggcgatgcagatgatcgaggagttgcttaactggacctgtcctggatctggatccattgcacaggtctaaaggagaatcattgaattatatgatcaagataataatatagttgagggttaataataatcgagggtaagtaatttacgtgtagctaataattaatataattttcgaacatatatatgaatatatgatagctctagaaatgagtacgtatatatacgtaaacatttttcctcaaatatagtatatgtg

SEQ ID NO: 1444 - protein, 189 aa, Arabidopsis thaliana
MVHSKKFRGVRQRQWGSWVSEIRHPLLKRRVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQV

SEQ ID NO: 1445 - DNA, 1674 bp, Arabidopsis thaliana
aggtcgaattttctgaaattaagattcattcctccatggaagaagctctgtttttattctctttagcttagcttagcttctactgatctgtttttgctacaaaatcccatctttttctttaaaactctttatctctgaatcttgagtttcttgtagaagaagaagcaattttgaatctttcgtaatcataaagattcgtggaggatctctactgatttgtcggaatctctcactacagaatcacttgatcttatgtccggatggaggagagagaaggaaccaacatcaacaacaacatcactagcagtttcggcttgaagcagcaacatgaagctgctgcttctgatggtggttactcaatggacccaccaccaagacccgaaaaccctaacccgtttttagtcccacccactactgtccccgcggccgccaccgtagcagcagctgttactgagaatgcggctactccgtttagcttaacaatgccgacggagaacacttcagctgagcagctgaaaaagaagagaggtaggccgagaaagtataatcccgatgggactcttgtcgtgactttatcgccgatgccaatctcgtcctctgttccgttgacgtcggagtttcctccaaggaaacgaggaagaggacgtggcaagtctaatcgatggctcaagaagtctcaaatgttccaattcgatagaagtcctgttgataccaatttggcaggtgtaggaactgctgattttgttggtgccaactttacacctcatgtactgatcgtcaacgccggagaggatgtgacgatgaagataatgacattctctcaacaaggatctcgtgctatctgcatcctttcagctaatggtcccatctccaatgttacgcttcgtcaatctatgacatccggtggtactctaacttatgagggtcgttttgagattctctctttgacgggttcgtttatgcaaaatgactctggaggaactcgaagtagagctggtggtatgagtgtttgccttgcaggaccagatggtcgtgtctttggtggaggactcgctggtctctttcttgctgctggtcctgtccaggtaatggtagggacttttatagctggtcaagagcagtcacagctggagctagcaaaagaaagacggctaagatttggggctcaaccatcttctatctcctttaacatatccgcagaagaacggaaggcgagattcgagaggcttaacaagtctgttgctattcctgcaccaaccacttcatacacgcatgtaaacacaacaaatgcggttcacagttactatacaaactcggttaaccatgtcaaggatcccttctcgtctatcccagtaggaggaggaggaggtggagaggtaggagaagaagagggtgaagaagatgatgatgaattagaaggtgaagacgaagaattcggaggcgatagccaatctgacaacgagattccgagctgatgatgatcatacggtttcttttcgcggatttgttaggtttgatggatttcagattttggttgattgtttttattaacacagaatgtttagaagctgctatctttaggttcccatcctcttgtgattgttgagtatccttgttagaaacaaacttactgttgcaaaactctcttcaaaaaagtttcactttgctttccca

SEQ ID NO: 1446 - protein, 404 aa, Arabidopsis thaliana
MEEREGTNINNNITSSFGLKQQHEAAASDGGYSMDPPPRPENPNPFLVPPTTVPAAATVAAAVTENAATPFSLTMPTENTSAEQLKKKRGRPRKYNPDGTLVVTLSPMPISSSVPLTSEFPPRKRGRGRGKSNRWLKKSQMFQFDRSPVDTNLAGVGTADFVGANFTPHVLIVNAGEDVTMKIMTFSQQGSRAICILSANGPISNVTLRQSMTSGGTLTYEGRFEILSLTGSFMQNDSGGTRSRAGGMSVCLAGPDGRVFGGGLAGLFLAAGPVQVMVGTFIAGQEQSQLELAKERRLRFGAQPSSISFNISAEERKARFERLNKSVAIPAPTTSYTHVNTTNAVHSYYTNSVNHVKDPFSSIPVGGGGGGEVGEEEGEEDDDELEGEDEEFGGDSQSDNEIPS

SEQ ID NO: 1447 - DNA, 820 bp, Arabidopsis thaliana
gaagactccaacataattcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttcc

SEQ ID NO: 1448 - protein, 221 aa, Arabidopsis thaliana
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 1449 - DNA, 1281 bp, Arabidopsis thaliana
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 1450 - protein, 298 aa, Arabidopsis thaliana
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 1451 - DNA, 1371 bp, Arabidopsis thaliana; identical to SEQ ID NO: 225

SEQ ID NO: 1452 - protein, 373 aa, Arabidopsis thaliana; identical to SEQ ID NO: 226

SEQ ID NO: 1453 - DNA, 2511 bp, Arabidopsis thaliana
atggcaatgtcttgcaaggatggtaagttgggatgtttggataatgggaagtatgtgaggtatacacctgaacaagttgaagcacttgagaggctttatcatgactgtcctaaaccgagttctattcgccgtcagcagttgatcagagagtgtcctattctctctaacattgagcctaaacagatcaaagtgtggtttcagaaccgaagatgtagagagaaacaaaggaaagaggcttcacggcttcaagctgtgaatcggaagttgacggcaatgaacaagctcttgatggaggagaatgacaggttgcagaagcaagtgtcacagctggtccatgaaaacagctacttccgtcaacatactccaaatccttcactcccagctaaagacacaagctgtgaatcggtggtgacgagtggtcagcaccaattggcatctcaaaatcctcagagagatgctagtcctgcaggacttttgtccattgcagaagaaactttagcagagtttctttcaaaggcaactggaaccgctgttgagtgggttcagatgcctggaatgaagcctggtccggattccattggaatcatcgctatttctcatggttgcactggtgtggcagcacgcgcctgtggcctagtgggtcttgagcctacaagggttgcagagattgtcaaggatcgtccttcgtggttccgcgaatgtcgagctgttgaagttatgaacgtgttgccaactgccaatggtggaaccgttgagctgctttatatgcagctctatgcaccaactacattggccccaccacgcgatttctggctgttacgttacacctctgttttagaagatggcagccttgtggtgtgcgagagatctcttaagagcactcaaaatggtcctagtatgccactggttcagaattttgtgagagcagagatgctttccagtgggtacttgatacggccttgtgatggtggtggctcaatcatacacatagtggatcatatggatttggaggcttgtagcgtgcctgaggtcttgcgcccgctctatgagtcacccaaagtacttgcacagaagacaacaatggcggcactgcgtcagctcaagcaaatagctcaggaggttactcagactaatagtagtgttaatgggtggggacggcgtcctgctgccttaagagctctcagccagaggctaagcagaggcttcaatgaagctgtaaatggtttcactgatgaaggatggtcagtgataggagatagcatggatgatgtcacaatcactgtaaactcttctccagacaagctaatgggtctaaatcttacatttgccaatggctttgctcctgtaagcaatgttgttttatgcgcaaaagcatcaatgcttttacagaatgttcctccggcgatcctgcttcggtttctgagggagcataggtcagaatgggctgacaacaacattgatgcgtatctagcagcagcagttaaagtagggccttgtagtgcccgagttggaggatttggagggcaggttatacttccacttgctcatactattgagcatgaagagtttatggaagtcatcaaattggaaggtcttggtcattcccctgaagatgcaatcgttccaagagatatcttccttcttcaactttgtagcggaatggatgaaaatgctgtaggaacctgtgcggaacttatatttgctccaatcgatgcttcgtttgcggatgatgcacctctgcttccttctggttttcgtattatccctcttgattccgcaaaggaagtatctagcccaaaccgaaccttggatcttgcttcggcactggaaattggttcagctggaacaaaagcctcaactgatcaatcaggaaactccacatgtgcaagatctgtgatgacaatagcatttgagtttggtatcgagagccatatgcaagaacatgtagcatccatggctaggcagtatgttcgaggtatcatatcatcggtgcagagagtagcattggctctttctccttctcatatcagctcacaagttggtctacgcactcctttgggtactcctgaagcccaaacacttgctcgttggatttgccagagttacaggggctacatgggtgttgagctacttaaatcaaacagtgacggcaatgaatctattcttaagaatctttggcatcacactgatgctataatctgctgctcaatgaaggccttgcccgtcttcacatttgcaaaccaggcgggacttgacatgctggagactacattagttgctcttcaagacatctctttagagaagatatttgatgacaatggaagaaagactctttgctctgagttcccacagatcatgcaacagggcttcgcgtgccttcaaggcgggatatgtctctcaagcatggggagaccagtttcgtatgagagagcagttgcttggaaagtactcaatgaagaagaaaatgctcattgcatctgctttgtgttcatcaattggtcctttgtgtga

SEQ ID NO: 1454 - protein, 836 aa, Arabidopsis thaliana
MAMSCKDGKLGCLDNGKYVRYTPEQVEALERLYHDCPKPSSIRRQQLIRECPILSNIEPKQIKVWFQNRRCREKQRKEASRLQAVNRKLTAMNKLLMEENDRLQKQVSQLVHENSYFRQHTPNPSLPAKDTSCESVVTSGQHQLASQNPQRDASPAGLLSIAEETLAEFLSKATGTAVEWVQMPGMKPGPDSIGIIAISHGCTGVAARACGLVGLEPTRVAEIVKDRPSWFRECRAVEVMNVLPTANGGTVELLYMQLYAPTTLAPPRDFWLLRYTSVLEDGSLVVCERSLKSTQNGPSMPLVQNFVRAEMLSSGYLIRPCDGGGSIIHIVDHMDLEACSVPEVLRPLYESPKVLAQKTTMAALRQLKQIAQEVTQTNSSVNGWGRRPAALRALSQRLSRGFNEAVNGFTDEGWSVIGDSMDDVTITVNSSPDKLMGLNLTFANGFAPVSNVVLCAKASMLLQNVPPAILLRFLREHRSEWADNNIDAYLAAAVKVGPCSARVGGFGGQVILPLAHTIEHEEFMEVIKLEGLGHSPEDAIVPRDIFLLQLCSGMDENAVGTCAELIFAPIDASFADDAPLLPSGFRIIPLDSAKEVSSPNRTLDLASALEIGSAGTKASTDQSGNSTCARSVMTIAFEFGIESHMQEHVASMARQYVRGIISSVQRVALALSPSHISSQVGLRTPLGTPEAQTLARWICQSYRGYMGVELLKSNSDGNESILKNLWHHTDAIICCSMKALPVFTFANQAGLDMLETTLVALQDISLEKIFDDNGRKTLCSEFPQIMQQGFACLQGGICLSSMGRPVSYERAVAWKVLNEEENAHCICFVFINWSFV

SEQ ID NO: 1455 - DNA, 1387 bp, Arabidopsis thaliana
agcaagtccaaatctccctctctctctctctatctatctctctatagaagattttttaactaagaagctagcgatcatggccacagcgatgaacgttttctctaccaaatggtcctccgaattggatatagaagaatatagtatcatccaccaattccacatgaactcactcgtcggagatgttccacagtctctctcatctcttgatgataccaccacttgttataaccttgatgcttcttgtaataaaagtttggtagaagaaagaccttcaaagatcctcaagaccactcacatatcaccaaacttacatcctttttcttcttctaatcctcctcctccaaagcaccagccctcttctaggattctttcttttgaaaagacaggtttacatgttatgaatcacaactctccaaacttaatatttagccccaaggacgaagaaattggattaccagagcataagaaagccgagctgataataagagggacaaagagagctcaatccttgactcgaagccaatcaaatgctcaagatcacatactggcagagagaaaacggagagagaagcttactcaaagatttgtagctctttccgcgctaattcctggcctaaagaagatggacaaggcttctgtgttgggagatgcaataaagcatataaagtacctccaagagagtgtgaaagagtatgaggaacaaaagaaggaaaagacaatggaatcagtggttcttgtaaagaagtctagtctggttttagatgaaaatcatcaaccatcatcatcatcttcctcagatggaaatcgcaatagctcgagctcaaatcttccagaaatagaagttagggtttcaggaaaagatgttcttattaagatcctatgcgagaagcaaaagggtaatgtgatcaagattatgggggagattgaaaagcttggtttgtctatcaccaacagcaatgtcttgccctttggacccacttttgacatctctattatcgctcagaagaataacaattttgatatgaaaatcgaggatgttgtgaagaacttgagttttggcttatcaaagctcacttaattggtttcacgttacatacatatacacattcatcatcgatttctccgatcgaagaatccaaaatcagtttttccatgaaagtggttttttagttgttaagtttgttgtatggagattcttaagtcatttaaagatccttgttcttgtgttgttaagtgtgctttaagatgcatatcatcaaatgtttagtaattatttctctccagtttcatttgggacggaatttttttcgcagttgttggatatatatttcctgcgatgtaaagcatttcgttagtttaataaacgtccgatatgtttctttgaaaa

SEQ ID NO: 1456 - protein, 333 aa, Arabidopsis thaliana
MATAMNVFSTKWSSELDIEEYSIIHQFHMNSLVGDVPQSLSSLDDTTTCYNLDASCNKSLVEERPSKILKTTHISPNLHPFSSSNPPPPKHQPSSRILSFEKTGLHVMNHNSPNLIFSPKDEEIGLPEHKKAELIIRGTKRAQSLTRSQSNAQDHILAERKRREKLTQRFVALSALIPGLKKMDKASVLGDAIKHIKYLQESVKEYEEQKKEKTMESVVLVKKSSLVLDENHQPSSSSSSDGNRNSSSSNLPEIEVRVSGKDVLIKILCEKQKGNVIKIMGEIEKLGLSITNSNVLPFGPTFDISIIAQKNNNFDMKIEDVVKNLSFGLSKLT

SEQ ID NO: 1457 - DNA, 755 bp, Arabidopsis thaliana
caacacttctcagtgaccgtgagcaacgaattattttcagttcaacgactccgcggaaatggaaaattcagaaaatgttccctcttacgatcaaaacatcaatttcactcctaatttgacgagagatcaagaacatgtgatcatggtctctgctttgcaacaagtaatatccaacgtcggaggtgacacgaactcgaatgcatgggaagctgatcttccacctttgaacgctggcccttgtcctctttgtagtgtcaccggctgctacggttgcgtcttcccacgacacgaggcgataattaagaaggagaagaagcacaaaggagtgaggaaaaaaccatcaggtaaatgggcggcggagatatgggatccgagtttgaaagtaaggagatggcttggaacgtttccaacagcggagatggcggctaaggcttacaacgatgcggcggctgagtttgtcggaagaagatcagcaagacgtggcacaaagaacggagaggaagcatctaccaagaagacgactgagaaaaattaacggagaaggagcacgtatagaaaggcaggaagaggcatcttacttgcttcacaagtaaatcagaatttttttgaaaagtaaaaacgttattttgtttggtaataaaataaagtaaaacaaaatattgctaacgcaagacttatcaagttcagtcgtgactgtgagtgtgtttttatgtatcttacttcattttttgtctttcaattgtgtgtgtgtgtgt

SEQ ID NO: 1458 - protein, 158 aa, Arabidopsis thaliana
MENSENVPSYDQNINFTPNLTRDQEHVIMVSALQQVISNVGGDTNSNAWEADLPPLNAGPCPLCSVTGCYGCVFPRHEAIIKKEKKHKGVRKKPSGKWAAEIWDPSLKVRRWLGTFPTAEMAAKAYNDAAAEFVGRRSARRGTKNGEEASTKKTTEKN

SEQ ID NO: 1459 - DNA, 1038 bp, Arabidopsis thaliana
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatccaaaaaaaaaaaaaaaaaaaaaaaaaa

SEQ ID NO: 1460 - protein, 228 aa, Arabidopsis thaliana
MGRGKIVIQRIDDSTSRQVTFSKRRKGLIKKAKELAILCDAEVGLIIFSSTGKLYDFASSSMKSVIDRYNKSKIEQQQLLNPASEVKFWQREAAVLRQELHALQENHRQMMGEQLNGLSVNELNSLENQIEISLRGIRMRKEQLLTQEIQELSQKRNLIHQENLDLSRKVQRIHQENVELYKKAYMANTNGFTHREVAVADDESHTQIRLQLSQPEHSDYDTPPRANE

SEQ ID NO: 1461 - DNA, 549 bp, Arabidopsis thaliana
atgtacatgcaaaaacaaaaaccttaaaagctttcatggaacgtatagagtcttataacacgaatgagatgaaatacagaggcgtacgaaagcgtccatggggaaaatatgcggcggagattcgcgactcagctagacacggtgctcgtgtttggcttgggacgtttaacacagcggaagacgcggctcgggcttatgatagagcagctttcggcatgagaggccaaagggccattctcaattttcctcacgagtatcaaatgatgaaggacggtccaaatggcagccacgagaatgcagtggcttcctcgtcgtcgggatatagaggaggaggtggtggtgatgatgggagggaagttattgagttcgagtatttggatgatagtttattggaggagcttttagattatggtgagagatctaaccaagacaattgtaacgacgcaaaccgctagatcatcactacttacttacagtgtaatgtttttggagtaaagagtaataatcaatataatatactttagtttaggaaaaaaaaaaaaaaaaaaa

SEQ ID NO: 1462 - protein, 139 aa, Arabidopsis thaliana
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 1463 - DNA, 696 bp, Arabidopsis thaliana; identical to SEQ ID NO: 277

SEQ ID NO: 1464 - protein, 139 aa, Arabidopsis thaliana; identical to SEQ ID NO: 278

SEQ ID NO: 1465 - DNA, 450 bp, Arabidopsis thaliana
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaa

SEQ ID NO: 1466 - protein, 131 aa, Arabidopsis thaliana
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 1467 - DNA, 615 bp, Arabidopsis thaliana; identical to SEQ ID NO: 281

SEQ ID NO: 1468 - protein, 202 aa, Arabidopsis thaliana; identical to SEQ ID NO: 282

SEQ ID NO: 1469 - DNA, 833 bp, Arabidopsis thaliana; identical to SEQ ID NO: 283

SEQ ID NO: 1470 - protein, 219 aa, Arabidopsis thaliana; identical to SEQ ID NO: 284

SEQ ID NO: 1471 - DNA, 318 bp, Arabidopsis thaliana; identical to SEQ ID NO: 287

SEQ ID NO: 1472 - protein, 105 aa, Arabidopsis thaliana; identical to SEQ ID NO: 288

SEQ ID NO: 1473 - DNA, 765 bp, Arabidopsis thaliana
atcacagttatgtttccattcattggctataaaaaccatgctcactcccttttgttcttcacaccatttgcaggaaaaaatgaatagttgtcagtctaatcccaccaaaatggataattcagaaaatgttctatttaatgatcaaaacgaaaatttcacacttgttgcaccacacccttcttcttcgtacttgacaagagatcaagagcacgagatcatggtctctgctctgcgacaagtgatatctaactccggagctgacgacgcgtcatcatcaaacttgatcatcacaagcgttccgcctccagacgctggcccttgtcctctctgtggcgtcgccggttgctacggctgcacattacaacggccgcaccgagaggtaaagaaggagaagaaatacaaaggagtaaggaaaaaaccatcgggtaaatgggcggcggagatatgggatccgagatcgaaatcaaggaggtggcttggaacgtttcttacggcggagatggcggcacaatcttacaatgatgcggcggctgagtatcgagcaagacgtggtaaaacaaacggagaaggaattaaacggcggtggagatgactgagaaggacatggtcggtgatcatacacggcgaggtggaaatgttatatttactattgaaaactaaattatttattatagagggagatattactctttacgctttcattaagatttatttttataagttttaaagtattttattgttataaaaaaaaaaaaaaaaaaaaaa

SEQ ID NO: 1474 - protein, 184 aa, Arabidopsis thaliana
MLTPFCSSHHLQEKMNSCQSNPTKMDNSENVLFNDQNENFTLVAPHPSSSYLTRDQEHEIMVSALRQVISNSGADDASSSNLIITSVPPPDAGPCPLCGVAGCYGCTLQRPHREVKKEKKYKGVRKKPSGKWAAEIWDPRSKSRRWLGTFLTAEMAAQSYNDAAAEYRARRGKTNGEGIKRRWR

SEQ ID NO: 1475 - DNA, 1316 bp, Arabidopsis thaliana; identical to SEQ ID NO: 303

SEQ ID NO: 1476 - protein, 398 aa, Arabidopsis thaliana; identical to SEQ ID NO: 304

SEQ ID NO: 1477 - DNA, 729 bp, Arabidopsis thaliana
atgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttga

SEQ ID NO: 1478 - protein, 242 aa, Arabidopsis thaliana
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 1479 - DNA, 625 bp, Arabidopsis thaliana
acacgatcaaaactcattattcaacaaagtcttcgtttcatttttcatttttcatttctcaaccaaaaaaaaaaagagtgattttttttttaatcatcagtcaaatggaaaggggaagatcagatatggagatgataaacaacatggcaaattgcttgattcttctatcaaaggcccatcaaaacgacaccaaaagccgtgttttcgcgtgcaagacatgcaacaaagagttcccgtcgttccaagccttgggaggtcaccgagccagccaccggcgatccgcagcgcttgaaggccacgcacctccttctcctaagagagtcaaaccggtgaaacacgagtgtcccatatgtggtgctgagttcgcggtagggcaggccttaggtggtcacatgaggaagcatagaggtggatcaggaggaggaggtggccggagtttggcgccggctacagcgccggtgacgatgaagaaatcaggcggtggtaatggaaaaagagttttgtgtttggacttgaacttgacgcctttagagaacgaagatttgaagttggagcttgggaggtttattttctgatttttgttcgtttttctttttagggtatacttgtgtagggtaagtttatt

SEQ ID NO: 1480 - protein, 156 aa, Arabidopsis thaliana
MERGRSDMEMINNMANCLILLSKAHQNDTKSRVFACKTCNKEFPSFQALGGHRASHRRSAALEGHAPPSPKRVKPVKHECPICGAEFAVGQALGGHMRKHRGGSGGGGGRSLAPATAPVTMKKSGGGNGKRVLCLDLNLTPLENEDLKLELGRFIF

SEQ ID NO: 1481 - DNA, 945 bp, Arabidopsis thaliana
atggagagatacaagtgtagattttgcttcaagagcttcatcaatggaagagctttaggtggtcacatgagatctcacatgcttactctttctgcagaacgttgtgtaataactggtgaagcagaagaagaagtagaggaacggccgagtcaactctgtgacgacgacgacgataccgagtccgatgcttcttcttcttctggtgagtttgataatcaaaagatgaatcgtcttgatgatgaattggagtttgatttcgctgaagacgacgacgttgaaagtgaaaccgagtcgtccaggattaacccaactcggcgacgatctaaacgaactcggaaacttggatcgtttgatttcgactttgagaagctaacaacgagccaacccagtgagttagtggccgagccagagcatcacagctcagcttctgatacaacaacggaggaagatctcgccttttgtctcattatgctgtccagagacaaatggaagcaacagaagaagaagaagcaacgtgtagaagaagatgagacagatcatgacagtgaagattacaaatcaagcaagagcagagggagattcaagtgtgagacttgtggtaaagtgtttaaatcgtatcaagcattaggaggacacagagcaagccacaagaagaacaaggcatgcatgacgaaaacagagcaagttgaaacagagtacgttcttggagtaaaggagaagaaagttcatgaatgtccgatctgttttagggtttttacttcagggcaagcacttggaggtcataagagatctcacggaagtaacatcggagcaggaagaggattgtcagtaagtcaaattgtccaaatcgaagaagaagtatcagtgaaacagaggatgattgatcttaatcttcctgcacctaatgaagaagatgaaacttctttggtgtttgatgaatggtga

SEQ ID NO: 1482 - protein, 314 aa, Arabidopsis thaliana
MERYKCRFCFKSFINGRALGGHMRSHMLTLSAERCVITGEAEEEVEERPSQLCDDDDDTESDASSSSGEFDNQKMNRLDDELEFDFAEDDDVESETESSRINPTRRRSKRTRKLGSFDFDFEKLTTSQPSELVAEPEHHSSASDTTTEEDLAFCLIMLSRDKWKQQKKKKQRVEEDETDHDSEDYKSSKSRGRFKCETCGKVFKSYQALGGHRASHKKNKACMTKTEQVETEYVLGVKEKKVHECPICFRVFTSGQALGGHKRSHGSNIGAGRGLSVSQIVQIEEEVSVKQRMIDLNLPAPNEEDETSLVFDEW

SEQ ID NO: 1483 - DNA, 1323 bp, Arabidopsis thaliana
tcgactttgtccgtcgtagtgatgcagcaaccaccgtcaaacgccgccggagctggacagataccatcaggacaacagcatttgtggatgatgatgcaacagcagcagcagcagcagcagatgcagttgtctgcggcgccactaggtcaacatcagtacggtattggatctcagaatccaggatccgctagcgatgttaagtcgttgtggatcggagacttgcagcaatggatggacgagaactacatcatgagcgtctttgctcagtctggcgaggctacatcagctaaagtcattcgtaataagctgacgggacaatctgaaggttatggattcattgagttcgtcagccactctgtagcagagcgggttttgcagacttacaatggtgctcccatgccgagcactgaacagacgtttaggctcaactgggctcaggctggggctggagagaaacgattccagactgaagggcctgaccataccattttcgtaggtgacttggcacctgaggtgactgactatatgctctcggacacattcaagaatgtgtatgggtctgtcaaaggggctaaagttgtgcttgacaggaccactggaaggtccaaggggtatgggtttgttagggttgcggatgaaaatgagcagatgcgtgccatgactgaaatgaatggtcaatactgctcgacaaggcctatgcgtattggtccggctgccaataagaatgctcttccgatgcaaccagctatgtatcaaaacactcaaggagcaaatgctggagataatgatcctaataacacaacaatttttgttggaggtctggatgctaatgttacagacgatgaattaaagtcaatttttggtcaatttggtgaacttcttcatgtgaaaatacctccaggaaaacgttgtggattcgttcaatatgccaacaaggcgtctgcagagcatgcactttcggtgctgaatggaacacaattaggtggacaaagcatccgtctttcgtggggacgtagtccaaacaagcagtctgatcaagcgcaatggaacggtggtggatactatggataccctccacagccacagggcggctatggttatgcagctcaaccaccaactcaagaccctaatgcgtactatggtggttacactggctatggcaactatcagcagcaacgtcagtgaaacatcaacatcagctatttctaccaatgtcttggaacaaaagatgagcgattgtgtcttattaggacttctagattaaaagtgctctctttttgtttgagttttattttgcaaatgagtcgatcttgaatttgctat

SEQ ID NO: 1484 - protein, 387 aa, Arabidopsis thaliana
MQQPPSNAAGAGQIPSGQQHLWMMMQQQQQQQQMQLSAAPLGQHQYGIGSQNPGSASDVKSLWIGDLQQWMDENYIMSVFAQSGEATSAKVIRNKLTGQSEGYGFIEFVSHSVAERVLQTYNGAPMPSTEQTFRLNWAQAGAGEKRFQTEGPDHTIFVGDLAPEVTDYMLSDTFKNVYGSVKGAKVVLDRTTGRSKGYGFVRVADENEQMRAMTEMNGQYCSTRPMRIGPAANKNALPMQPAMYQNTQGANAGDNDPNNTTIFVGGLDANVTDDELKSIFGQFGELLHVKIPPGKRCGFVQYANKASAEHALSVLNGTQLGGQSIRLSWGRSPNKQSDQAQWNGGGYYGYPPQPQGGYGYAAQPPTQDPNAYYGGYTGYGNYQQQRQ

SEQ ID NO: 1485 - DNA, 867 bp, Arabidopsis thaliana
atggagagttacaagtgcagggtttgctttaagagcttcgttaacggaaaagctttaggtggtcacatgagatctcacatgagtaattcacatgaggaagaacaaaggccgagtcaactcagttatgagactgagtccgatgtttcttcgtctgatccgaagtttgcttttacgagctctgttcttcttgaagacggtgaaagcgagagcgagtcgtcgaggaatgttattaacctgactcggaaacgatccaagcgaactcggaaactcgattcgtttgtaaccaagaaggtgaaaacgagtcaactcggatacaagcctgagtctgatcaagagcctcctcatagctcagcttctgatacaacgacggaggaagatcttgccttttgtctcatgatgctctctcgagataaatggaagaagaacaaaagtaataaagaagtagtggaagagatcgagacagaagaagaatcagaaggttacaacaagattaatcgagcaacaacgaaaggaagatacaagtgtgagacctgcgggaaagtgttcaaatcttatcaagcattaggtgggcatagagcaagtcataagaagaacagagtaagtaacaacaaaacagagcaacgaagcgaaacagagtatgataatgttgttgttgttgctaagagaatccatgaatgtccgatttgtctaagagttttcgcatcgggacaagcacttggaggtcacaaaagatctcacggggtagggaatttatctgtgaatcaacaacgtcgagttcatagaaacgagtctgtgaaacagaggatgatagatcttaatcttcctgcaccaaccgaagaagacgaagtctctgtggtgtttcaatga

SEQ ID NO: 1486 - protein, 288 aa, Arabidopsis thaliana
MESYKCRVCFKSFVNGKALGGHMRSHMSNSHEEEQRPSQLSYETESDVSSSDPKFAFTSSVLLEDGESESESSRNVINLTRKRSKRTRKLDSFVTKKVKTSQLGYKPESDQEPPHSSASDTTTEEDLAFCLMMLSRDKWKKNKSNKEVVEEIETEEESEGYNKINRATTKGRYKCETCGKVFKSYQALGGHRASHKKNRVSNNKTEQRSETEYDNVVVVAKRIHECPICLRVFASGQALGGHKRSHGVGNLSVNQQRRVHRNESVKQRMIDLNLPAPTEEDEVSVVFQ

SEQ ID NO: 1487 - DNA, 513 bp, Arabidopsis thaliana
atggttgctgaaagtgataatcgtgatctgacggtggatacggcggcgagctgtctgatgttgttatcaggaattggagaacacgacggaagaaagaaacgtgttttccgatgcaagacttgtgagagagacttcgattcgttccaagctttaggaggccaccgtgcaagccactcgaaactaaccaacagtgacgataaatcacttcctggatcaccaaagaagaagcctaaaactacgactacgacgacggctcatacttgtccgatttgtggcttggagtttccgatgggacaagctcttggtggtcacatgaggaaacataggaacgagaaagaacgagaaaaggcttctaacgtattggttacgcattctttcatgccggagacgacaacggtgacgactttgaagaaatcgagtagtgggaagagagtggcgtgtttggatttcgacttaacttcggtggagagctttgtcaacacggaattggagttgggaagaacgatgtactga

SEQ ID NO: 1488 - protein, 170 aa, Arabidopsis thaliana
MVAESDNRDLTVDTAASCLMLLSGIGEHDGRKKRVFRCKTCERDFDSFQALGGHRASHSKLTNSDDKSLPGSPKKKPKTTTTTTAHTCPICGLEFPMGQALGGHMRKHRNEKEREKASNVLVTHSFMPETTTVTTLKKSSSGKRVACLDFDLTSVESFVNTELELGRTMY

SEQ ID NO: 1489 - DNA, 1152 bp, Arabidopsis thaliana
atgactgatccttattccaatttcttcacagactggttcaagtctaatccttttcaccattaccctaattcctccactaacccctctcctcatcctcttcctcctgttactcctccctcttccttcttcttcttccctcaatccggagacctccgccgtccaccgccgccaccaactcctcctccttctcctcctctccgagaagccctccctctcctcagcctcagccccgccaacaaacaacaagaccaccatcacaaccatgaccaccttattcaagaaccaccttcaacctccatggatgtcgactacgatcatcaccatcaagatgatcatcataacctcgatgacgatgaccatgacgtcaccgttgctcttcacataggccttccaagccctagtgctcaagagatggcctctttgctcatgatgtcttcttcttcctcttcctcgaggaccactcatcatcacgaggacatgaatcacaagaaagacctcgaccatgagtacagccacggagctgtcggaggaggagaagatgacgatgaagattcagtcggcggagacggcggctgtagaatcagcagactcaacaagggtcaatattggatccctacaccttctcagattctcattggccctactcagttctcatgtcctgtttgcttcaaaaccttcaacagatacaataacatgcagatgcatatgtggggacatggatcacaatacagaaaaggacctgaatctctaaggggaacacaaccaacaggaatgctaaggcttccgtgctattgctgcgccccaggctgtcgcaacaacattgaccatccaagggcaaagcctctcaaagacttcagaacccttcaaacacattacaagagaaaacatgggatcaaacctttcatgtgtaggaaatgtggaaaggctttcgcagtccgaggggactggagaacacatgagaagaattgtggcaaactttggtattgcatatgtggatctgatttcaagcacaagagatctctcaaagatcacatcaaggcttttgggaatggtcatggagcctacggaattgatgggtttgatgaagaagatgagcctgcctctgaggtagaacaattagacaatgatcatgagtcaatgcagtctaaatag

SEQ ID NO: 1490 - protein, 383 aa, Arabidopsis thaliana
MTDPYSNFFTDWFKSNPFHHYPNSSTNPSPHPLPPVTPPSSFFFFPQSGDLRRPPPPPTPPPSPPLREALPLLSLSPANKQQDHHHNHDHLIQEPPSTSMDVDYDHHHQDDHHNLDDDDHDVTVALHIGLPSPSAQEMASLLMMSSSSSSSRTTHHHEDMNHKKDLDHEYSHGAVGGGEDDDEDSVGGDGGCRISRLNKGQYWIPTPSQILIGPTQFSCPVCFKTFNRYNNMQMHMWGHGSQYRKGPESLRGTQPTGMLRLPCYCCAPGCRNNIDHPRAKPLKDFRTLQTHYKRKHGIKPFMCRKCGKAFAVRGDWRTHEKNCGKLWYCICGSDFKHKRSLKDHIKAFGNGHGAYGIDGFDEEDEPASEVEQLDNDHESMQSK

SEQ ID NO: 1491 - DNA, 528 bp, Arabidopsis thaliana
atgaagagagaccggtccgattacgaagaatccatgaagcatatagacatagtagaaagtctaatgatgttatctcgaagtttcgtggtcaaacaaatcgatgtaaagcaatctaccggaagcaaaacgaaccataataaccacttcgaatgcaaaacgtgtaaccggaaatttgattccttccaagctcttggaggtcatagagctagccacaagaaacctaagctgatcgttgaccaagaacaggtgaagcatcgtaacaaagagaatgatatgcataagtgtacaatttgcgatcaaatgtttgggaccggtcaagctctaggcggtcacatgagaaagcataggacgagcatgataaccgagcaatcgattgtcccttctgtggtttattccagaccggtttttaatcgttgcagtagcagcaaggagatcttggacttaaatctaactccattggaaaatgatcttgtgttaatctttgggaagaatttggttccacaaattgatttgaagtttgtgaattag

SEQ ID NO: 1492 - protein, 175 aa, Arabidopsis thaliana
MKRDRSDYEESMKHIDIVESLMMLSRSFVVKQIDVKQSTGSKTNHNNHFECKTCNRKFDSFQALGGHRASHKKPKLIVDQEQVKHRNKENDMHKCTICDQMFGTGQALGGHMRKHRTSMITEQSIVPSVVYSRPVFNRCSSSKEILDLNLTPLENDLVLIFGKNLVPQIDLKFVN

SEQ ID NO: 1493 - DNA, 762 bp, Arabidopsis thaliana; identical to SEQ ID NO: 333

SEQ ID NO: 1494 - protein, 253 aa, Arabidopsis thaliana; identical to SEQ ID NO: 334

SEQ ID NO: 1495 - DNA, 485 bp, Arabidopsis thaliana
atctcatcttcatccacccaaaaacatggattcaagagacaccggagaaactgaccagagcaagtacaaaggtatccgtcgtcggaaatggggaaaatgggtatcagagattcgtgtcccgggaactcgtcaacgtctctggttaggctctttctccaccgcagaaggcgctgccgtagcccacgacgtcgctttttactgcttgcaccgaccatcttccctcgacgacgaatcttttaacttccctcacttacttacaacctccctcgcctccaatatatctcctaagtccatccaaaaagctgcttccgacgccggcatggccgtggacgccggattccatggtgctgtgtctgggagtggtggttgtgaagagagatcttccatggcgaatatggaggaggaggacaaacttagtatctccgtgtatgattatcttgaagacgatctcgtttgatctatacgagtacgtttttagcagttaa

SEQ ID NO: 1496 - protein, 143 aa, Arabidopsis thaliana
MDSRDTGETDQSKYKGIRRRKWGKWVSEIRVPGTRQRLWLGSFSTAEGAAVAHDVAFYCLHRPSSLDDESFNFPHLLTTSLASNISPKSIQKAASDAGMAVDAGFHGAVSGSGGCEERSSMANMEEEDKLSISVYDYLEDDLV

SEQ ID NO: 1497 - DNA, 2675 bp, Arabidopsis thaliana
gtggcttcattgatttgagtgagctatggaaaacaattctcttcctatggatccagctatggattcttcattcatggacggattacttctagaaggttgctggttagagacaacagatgcatccgagttccttaattttagtccttcaacttctgtagccccttttgatccttcttccttcatgtggtctccaacgcaagacacatctaatagcttatctcagatgtatggtcaagattgtccagaaagatcaagtcttgaggatcaaaaccaagggagagatctctctacctttaacagacgttggtggattggaccaagtggtcatcatggcttttctgttatggaaagattggttcaagcagtgacacacattaaagatttcactagtgagagaggctctcttatacagttgtgggtgcctgtggatagaggtggtaagcgagttttgaccacaaaggaacaaccttttagtcatgatccaatgtgtcaaaggcttgctcattacagagagatctctgagaattatcagttctctactgaacaggaggattcagattctagttccagggacttggttggtttgcctggaagagttttcttggggaaggttcctgaatggactcctgatgtgaggtttttcaagaatgaggagtatccgagagttcaacatgctcaagactgtgatgttcgaggcacgttagctattcctgtgtttgaacaaggtagtcagatttgcttaggtgttattgaggttgtgatgactacacaaatggttaaactaagtcctgaccttgaaagcatctgcagagcacttcaggcagttgatcttagaagcacagagattccaataccgccttctctaaagggaccagatttctcttaccaagctgcattacctgaaatcagaaacctcttgagatgtgcttgcgagacgcataaactaccattagctcaaacatgggtctcatgtctcaaacaaagcaaaactggttgccgtcacaatgatgagaactatatccattgtgtatccacaatcgatgatgcttgctatgttggtgatcctacagtccgtgaattccacgaagcttgctctgagcaccatctcttgaaaggtcaaggagttgttggagaagcctttttgaccaatggcccttgcttttcatctgatgtttctagctacaagaaatctgagtaccctctctctcaccacgcgactatgtttggcttacatggtacagtcgcgatacgcttacgctgtatccacactggctcagttgatttcgtcttggagttctttttgcctaaaaattgtcgggatatagaggaacagaggaaaatgttgaatgctctttcgactataatggcgcatgtacctagaagcttaaggacagtcacgcagaaggaactagaagaagagggagattcaatggtgagcgaggtcatagagaaaggagtgacattgccaaagatagagaatacaacagaagtacatcagagtattagcactcctcaaaatgtaggattagtattcgatggaggaacaacggagatgggcgagttaggttctgaatatggcaaaggtgtgagtgtgaatgagaacaacactttctctagtgctagtggtttcaatagagtgactgagaaaaagcgaacgaaggccgaaaaaaacataactttggatgttcttcgccaatatttcgcagggagtctcaaagatgctgccaagagtattggtgtttgtccaacgacattgaagaggatatgcagacagcatgggatacagagatggccttcaagaaaaatcaagaaagttggtcattcgcttcagaaaatccaaagggtcatcgactcggttgaaggtgtttcgggtcatcatcttcctataggctccttctacgcgagtttcccaaatctagctgcttcaccagaagcatcatccctacaacagcaatccaagattactacattcttgtcctattcacattcaccacctgcaaagtcccctggttcctcgtgtagtcacagctcaagctgttccagtgaaacacaagtaatcaaggaagatcccacggataagactagactagtctcaagatcttttaaagaaacgcaaaccacacacttatcaccatcatcacaagaggatgattttctgagggtaaaggtaagctatgaggaggagaagatccggtttaagatgagaaactcgcataggttaaaagatttactgtgggaaatagcaaaacgatttagtatagaagatgtgagcagatacgatctgaaatacttagatgaagacaatgaatgggttttgttgagatgtgacgatgatgtagaagagtgtgtagatgtttgcagatcttttccaggacaaacgattaagcttttgcttcagctctcttcttcttatcttccagaacgttcttctgtcagtggatgtctttcatgacatgaagattaagagacaaagactacatatagtttgtgttgtgtaagcattgttcatagtttttcttcactattttcaagattattaggtggtgctttatttggcttttgttttaaaacgtatcaaagaaagagaaaacgtgtaaagagcctttcttctagaaaaaatgattcaagttttctttgtttactacttttgtaatgtgtagttggtttgctaatgt

SEQ ID NO: 1498 - protein, 808 aa, Arabidopsis thaliana
MENNSLPMDPAMDSSFMDGLLLEGCWLETTDASEFLNFSPSTSVAPFDPSSFMWSPTQDTSNSLSQMYGQDCPERSSLEDQNQGRDLSTFNRRWWIGPSGHHGFSVMERLVQAVTHIKDFTSERGSLIQLWVPVDRGGKRVLTTKEQPFSHDPMCQRLAHYREISENYQFSTEQEDSDSSSRDLVGLPGRVFLGKVPEWTPDVRFFKNEEYPRVQHAQDCDVRGTLAIPVFEQGSQICLGVIEVVMTTQMVKLSPDLESICRALQAVDLRSTEIPIPPSLKGPDFSYQAALPEIRNLLRCACETHKLPLAQTWVSCLKQSKTGCRHNDENYIHCVSTIDDACYVGDPTVREFHEACSEHHLLKGQGVVGEAFLTNGPCFSSDVSSYKKSEYPLSHHATMFGLHGTVAIRLRCIHTGSVDFVLEFFLPKNCRDIEEQRKMLNALSTIMAHVPRSLRTVTQKELEEEGDSMVSEVIEKGVTLPKIENTTEVHQSISTPQNVGLVFDGGTTEMGELGSEYGKGVSVNENNTFSSASGFNRVTEKKRTKAEKNITLDVLRQYFAGSLKDAAKSIGVCPTTLKRICRQHGIQRWPSRKIKKVGHSLQKIQRVIDSVEGVSGHHLPIGSFYASFPNLAASPEASSLQQQSKITTFLSYSHSPPAKSPGSSCSHSSSCSSETQVIKEDPTDKTRLVSRSFKETQTTHLSPSSQEDDFLRVKVSYEEEKIRFKMRNSHRLKDLLWEIAKRFSIEDVSRYDLKYLDEDNEWVLLRCDDDVEECVDVCRSFPGQTIKLLLQLSSSYLPERSSVSGCLS

SEQ ID NO: 1499 - DNA, 1412 bp, Arabidopsis thaliana; identical to SEQ ID NO: 393

SEQ ID NO: 1500 - protein, 380 aa, Arabidopsis thaliana; identical to SEQ ID NO: 394

SEQ ID NO: 1501 - DNA, 687 bp, Arabidopsis thaliana
atggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgaggctagtgataagtgccaaagagagaaaaggaagaccatcaatggagatgatttgctttgggctatggccactttaggattcgaagattacatcgatcccctcaaggtttacctgatgcgatatagagagatggagggtgacactaaaggatcaggaaaaggcggggaatcgagtgcaaagagagatggtcaaccaagccaagtgtctcagttctcgcaggttcctcaacaaggctcattctcacagggtccttatggaaactctcaatctctgaggttcggcaatagcatcgagcatcttgaagtgttaatgagtagtactaggacactattcatcacaatcttccgagactcgactatgcctgttgtgtctgagaatctgagtgatccactttccatagatatggattgtgaagctatttatcaccacttcattggcctgttgattctttcatgcaagtga

SEQ ID NO: 1502 - protein, 228 aa, Arabidopsis thaliana
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQSLRFGNSIEHLEVLMSSTRTLFITIFRDSTMPVVSENLSDPLSIDMDCEAIYHHFIGLLILSCK

SEQ ID NO: 1503 - DNA, 590 bp, Arabidopsis thaliana; identical to SEQ ID NO: 417

SEQ ID NO: 1504 - protein, 181 aa, Arabidopsis thaliana; identical to SEQ ID NO: 418

SEQ ID NO: 1505 - DNA, 561 bp, Arabidopsis thaliana; identical to SEQ ID NO: 419

SEQ ID NO: 1506 - protein, 164 aa, Arabidopsis thaliana; identical to SEQ ID NO: 420

SEQ ID NO: 1507 - DNA, 1005 bp, Arabidopsis thaliana
atgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataa

SEQ ID NO: 1508 - protein, 334 aa, Arabidopsis thaliana
MNISVNGQSQVPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMRKTLVFYKGRAPHGQKSDWIMHEYRLDESVLISSCGDHDVNVETCDVIGSDEGWVVCRVFKKNNLCKNMISSSPASSVKTPSFNEETIEQLLEVMGQSCKGEIVLDPFLKLPNLECHNNTTITSYQWLIDDQVNNCHVSKVMDPSFITSWAALDRLVASQLNGPNSYSIPAVNETSQSPYHGLNRSGCNTGLTPDYYIPEIDLWNEADFARTTCHLLNGSG

SEQ ID NO: 1509 - DNA, 1617 bp, Arabidopsis thaliana
atggcagtttattacacaagtaatgtcggttgttaccagcaagaaccaatctttctcaaccatcaacaacaaaaccaacaagcttcttcttcatccgccgccgcttctttcaccgtcaccggcggcgatactgttcgaaacgagatggtttttatcccaccaaccaccacaggagacgttgtaacaggaaacggtaccgtttcaagcagcgatctaagctttcacgatggtcaaggactgtctttgagccttggtactcagatctctgttgctccgtttcactttcatcaataccaattggggtttactagtcagaatccttcaatttcagtcaaggaaacgtcaccgtttcatgtggatgagatgagtgtgaagagcaaagaaatgatcttgttgggtcaatctgatccttcctctggttatgctggtaatggtgggaatggcttctacaacaattatcggtataatgagacatcaggagggtttatgagcagcgttctgcgttctcggtatcttaaacctgctcagaatttgcttgatgaagtggttagtgtcaagaaagaactaaaccaaatggggaagaagaagatgaaagttaatgactttaacagtggttctaaggagatagaaggaggaggtggtgagttatcgagtgattcgaatgggaaatcgattgagttatctacaattgaacgtgaagagcttcagaacaagaagaacaagcttttaacaatggttgatgaggtagataaaagatataaccaatattaccatcaaatggaagcattagcttcatcatttgagatagtagcaggacttggatcagctaagccttacacatcagttgctctcaacagaatctctcgccattttcgtgctcttcgcgacgcaataaaggaacaaattcagattgttagagaaaaacttggggagaaaggaggagagtcgttggatgagcaacaaggagagaggataccaaggttgaggtatttagatcaacggttgagacagcaaagagctttgcatcaacagcttggaatggttcgacctgcttggagacctcaaagaggtcttcctgaaaactctgtctctgttcttcgcgcttggctctttgaacatttccttcatccatatccgaaagaatctgagaaaatcatgcttgcaaagcagacaggattgtcaaagaaccaggttgctaattggttcataaacgcgagagttcgtctgtggaaaccgatgatcgaagaaatgtataaagaagagtttggtgatgaatctgagttactaatctccaaatcttcccaagaacccaacagcacaaaccaagaagactcctcatcgcagcagcagcagcagcaagagaacaacaacaacagcaacctcgcttattcatctgcagacacaacaaacattgtcttctcatcagaaaccaaaccagatcgtgttctaggcaatgataacgacccacagcaacaacagataaaccgctcatcggattacgacactctgatgaactatcacgggtttggtgttgatgattaccgttacattagcggaagcaaccagcaagaaagcagattctccaattcccatcacttacacgactttgttgtgtga

SEQ ID NO: 1510 - protein, 538 aa, Arabidopsis thaliana
MAVYYTSNVGCYQQEPIFLNHQQQNQQASSSSAAASFTVTGGDTVRNEMVFIPPTTTGDVVTGNGTVSSSDLSFHDGQGLSLSLGTQISVAPFHFHQYQLGFTSQNPSISVKETSPFHVDEMSVKSKEMILLGQSDPSSGYAGNGGNGFYNNYRYNETSGGFMSSVLRSRYLKPAQNLLDEVVSVKKELNQMGKKKMKVNDFNSGSKEIEGGGGELSSDSNGKSIELSTIEREELQNKKNKLLTMVDEVDKRYNQYYHQMEALASSFEIVAGLGSAKPYTSVALNRISRHFRALRDAIKEQIQIVREKLGEKGGESLDEQQGERIPRLRYLDQRLRQQRALHQQLGMVRPAWRPQRGLPENSVSVLRAWLFEHFLHPYPKESEKIMLAKQTGLSKNQVANWFINARVRLWKPMIEEMYKEEFGDESELLISKSSQEPNSTNQEDSSSQQQQQQENNNNSNLAYSSADTTNIVFSSETKPDRVLGNDNDPQQQQINRSSDYDTLMNYHGFGVDDYRYISGSNQQESRFSNSHHLHDFVV

SEQ ID NO: 1511 - DNA, 756 bp, Arabidopsis thaliana
atgaggagaaacattgattatgtttccagtaccgattatttgcctattaaagataatcctcatcttactagagtttctttcactcaaaccattactaataggtatagttctattgttcctaccaattcacttgatgctgttcaatatgatattgaacttgtcaaacgtgccatggattctaaacccaatatttggaatcctgttttttatcctccaaattttcttggtaaacaatgcgagattttaaaccctgagcctctaaatgtcatttttcctcaccaaaattctggagatcgtcaatatttaaacatgttttccttgtcatcaaagcataaccatgatcaaaatgttttccatgaaggccgatcttcgacaaaaatccccaaaccaaccatgtccattgaaaaaactactgaatatatagattgtgaagaaaacgagaaaagtgacgatgctcaatatgatggtcgaatacatagtttaccatataagaaatatggtccatatacatgtcctaagtgcaacagtatatttgatacttctcaaaaatttgctgcacatatgtcatctcactacaagagtgaaacgaataaagaaagagctcaaagatttcgtgcaagaaataaaagaaaatatcgtaaattgaatcttgaagtttatggggagtctcaaaagattaaacaagaagatggggtccataatgatggaaggagtgacgacaaacctattcaacatcataagattttatttcgttaa

SEQ ID NO: 1512 - protein, 251 aa, Arabidopsis thaliana
MRRNIDYVSSTDYLPIKDNPHLTRVSFTQTITNRYSSIVPTNSLDAVQYDIELVKRAMDSKPNIWNPVFYPPNFLGKQCEILNPEPLNVIFPHQNSGDRQYLNMFSLSSKHNHDQNVFHEGRSSTKIPKPTMSIEKTTEYIDCEENEKSDDAQYDGRIHSLPYKKYGPYTCPKCNSIFDTSQKFAAHMSSHYKSETNKERAQRFRARNKRKYRKLNLEVYGESQKIKQEDGVHNDGRSDDKPIQHHKILFR

SEQ ID NO: 1513 - DNA, 1125 bp, Arabidopsis thaliana
cctttcgcatttaaagattaatttccgtttttgaggttaatatatttattacgtagtttgtatttgatataaaagggtaagacaaacaatagaaaatatatactctatctatctttcaaaatgtcttctatgccaaataagttcaatcctcactgtgatgataacaatcgtggtttttcctccatccaaatgaatcaaaattctcaaatggttcattcgaggttcattacttcggatcacacaaaccatggtgatctgttttcatcatctccttctttttcttgttttcataattcacatgcctcttcatcttcatttggattccaaaattcacatgtggaaaatcatatgatgaagagaaacataatttctgatgacaattatttttctatcacaaacaatcctcattttactcgagtttctttcacacaaaccattacaaacaaatttacagccattgttcctactaatacacttgacgctgtacaatatgatgctcaacgtgtcaaacgtgccatgaatcccaaaaccaatatttggaatcctatattttctcctccaaatacttttgataaacaatgcgaatttttgaatcctaaacctcttaatgtcatttttccgagtcaaaattctgcatatcctcaacatttagacatgttttccttgtcatcaaagcacaatcatgatcaacgtgttctccaagatggtcgttctatgaagaaaatcttgaaaccaaccatattttttgaagcaactactgattacattgagtctcaagaaaacgagaaaagtaacaatgatcacaatgatggtaggacacatagtctaccatatgaaaaatatggtccatatacatgtcccaagtgcaatggcgtctttaatacttctcaaaaatttgctgcacatatgtcatctcactacaagaatgaaacaagcgaagaaagagaacagagaattcgtgcaaagaacaaaagaaaattttgtaaactaaatcgtgaaattaatggtgagcctcaaaagaccaaacaagaggatgtggccaacaacagtgaaaaaagtgacgataaaactttccaacatcttgtggtcgtaaaagaagagcttgtttaggattgtatctcctta

SEQ ID NO: 1514 - protein, 329 aa, Arabidopsis thaliana
MSSMPNKFNPHCDDNNRGFSSIQMNQNSQMVHSRFITSDHTNHGDLFSSSPSFSCFHNSHASSSSFGFQNSHVENHMMKRNIISDDNYFSITNNPHFTRVSFTQTITNKFTAIVPTNTLDAVQYDAQRVKRAMNPKTNIWNPIFSPPNTFDKQCEFLNPKPLNVIFPSQNSAYPQHLDMFSLSSKHNHDQRVLQDGRSMKKILKPTIFFEATTDYIESQENEKSNNDHNDGRTHSLPYEKYGPYTCPKCNGVFNTSQKFAAHMSSHYKNETSEEREQRIRAKNKRKFCKLNREINGEPQKTKQEDVANNSEKSDDKTFQHLVVVKEELV

SEQ ID NO: 1515 - DNA, 653 bp, Arabidopsis thaliana
caaatcagaaaatatagagtttgaaggaaactaaaagatggtacattcgaggaagttccgaggtgtccgccagcgacaatggggttcttgggtctctgagattcgccatcctctattgaagagaagagtgtggcttggaactttcgaaacggcagaagcggctgcaagagcatacgaccaagcggctcttctaatgaacggccaaaacgctaagaccaatttccctgtcgtaaaatcagaggaaggctccgatcacgttaaagatgttaactctccgttgatgtcaccaaagtcattatctgagcttttgaacgctaagctaaggaagagctgcaaagacctaacgccttctttgacgtgtctccgtcttgatactgacagttcccacattggagtttggcagaaacgggccgggtcgaaaacaagtccgacttgggtcatgcgcctcgaacttgggaacgtagtcaacgaaagtgcggttgacttagggttgactacgatgaacaaacaaaacgttgagaaagaagaagaagaagaagaagctattattagtgatgaggatcagttagctatggagatgatcgaggagttgctgaattggagttgacttttgactttaacttgttgcaagtccacaaggggtaagggttttc

SEQ ID NO: 1516 - protein, 189 aa, Arabidopsis thaliana
MVHSRKFRGVRQRQWGSWVSEIRHPLLKRRVWLGTFETAEAAARAYDQAALLMNGQNAKTNFPVVKSEEGSDHVKDVNSPLMSPKSLSELLNAKLRKSCKDLTPSLTCLRLDTDSSHIGVWQKRAGSKTSPTWVMRLELGNVVNESAVDLGLTTMNKQNVEKEEEEEEAIISDEDQLAMEMIEELLNWS

SEQ ID NO: 1517 - DNA, 912 bp, Arabidopsis thaliana; identical to SEQ ID NO: 471

SEQ ID NO: 1518 - protein, 303 aa, Arabidopsis thaliana [sequence omitted]

SEQ ID NO: 1519 - DNA, 918 bp, Arabidopsis thaliana
atgagttcgtctaacggaggtgtaccgcctggttttcggtttcatccaacggacgaagaacttcttcattactacttgaagaagaagatttcttatgaaaagtttgagatggaagtcatcaaagaggttgatttgaacaagattgagccgtgggatttacaagatagatgcaaaataggatcaacgccacaaaatgagtggtatttcttcagccacaaggataggaaatatccgacagggtcaaggacaaaccgtgcaacccactccggtttttggaaggcgacaggacgtgacaaatgcataagaaattcttacaagaagatcggcatgaggaagactcttgtattctacaaaggaagagctcctcatggccaaaagacagattggatcatgcacgagtaccgtatcgaagacactgaagatgacccttgtgaagatggatgggttgtttgtagagtgttcaagaagaaaaatctgttcaaagtagggaatgatgttggctcaaacatcagcaataataggcttgaagctcgtagtttcatccgaagagaaagcccttaccaaggaatctcaatgtttgagcttaacaagcctgaagagattagtgttcatcaatatcctcaaccaccaatgtttcaacctcatcacaagcctctttcaataggctatgactattcattggctcttctaccaagagaaagcgagtaccaacaagcgtgtcagccatcaggggttgaggttggcacgtgcaaggcagtaagtgaatggggaatagtgaattgtaacatggtgagtcatgaggactcgtctagagcgatgaggtttgaagatgacggtaacaacacttcttccacggtccagccaccttctaatctgctttcattgcgcggtgaaaatggatttcttgggttgttttaa

SEQ ID NO: 1520 - protein, 305 aa, Arabidopsis thaliana
MSSSNGGVPPGFRFHPTDEELLHYYLKKKISYEKFEMEVIKEVDLNKIEPWDLQDRCKIGSTPQNEWYFFSHKDRKYPTGSRTNRATHSGFWKATGRDKCIRNSYKKIGMRKTLVFYKGRAPHGQKTDWIMHEYRIEDTEDDPCEDGWVVCRVFKKKNLFKVGNDVGSNISNNRLEARSFIRRESPYQGISMFELNKPEEISVHQYPQPPMFQPHHKPLSIGYDYSLALLPRESEYQQACQPSGVEVGTCKAVSEWGIVNCNMVSHEDSSRAMRFEDDGNNTSSTVQPPSNLLSLRGENGFLGLF

SEQ ID NO: 1521 - DNA, 880 bp, Arabidopsis thaliana
agtatatatctatgtacatacgacgacaaaaaaaaatatgtatgtacatacatctcctctcactctaagcttattttcgtataaattatagtatagtcatattcttttaggacagaacccaccgaaagaaagctccaaacccaacaaaaagggaggcggcggagaagcaaacaacagcaacaaaaaaatgcagccagaggtttcagatcaaatattttatgccttcctcaccggaggattatgtgcctcgtctacttccaccaccgtgacgtcgtcgtctgacccttttgccacggtttatgaagacaaagctcttgcttctctgaggaaccataaagaggctgagcgaaagagaagagcaagaatcaattcccatctcaacaagctccgcaagttactctcttgtaactccaagacagacaaatccacactactagcaaaagtggttcaacgagtcaaagaactaaaacaacaaaccctagaaatcaccgacgaaacaataccgtcggagactgacgaaatcagtgtactcaacattgaggactgttccagaggcgacgatcgacggataatctttaaggtatcgttttgctgcgaggaccggccagagctcttgaaagatctcatggagacactcaaatctcttcagatggaaactctctttgccgacatgacaacagtcggtggtcgaacaagaaacgttctcgttgtggccgctgacaaagagcatcacggcgtccagtcggtgaattttctacagaacgcactcaagtctttactcgaacggtcaagcaagtcggtgatggtgggacatggtggtggtggtggggaagaaaggttaaaacgacgtcgtgcgctggatcacatcataatggtctga

SEQ ID NO: 1522 - protein, 230 aa, Arabidopsis thaliana
MQPEVSDQIFYAFLTGGLCASSTSTTVTSSSDPFATVYEDKALASLRNHKEAERKRRARINSHLNKLRKLLSCNSKTDKSTLLAKVVQRVKELKQQTLEITDETIPSETDEISVLNIEDCSRGDDRRIIFKVSFCCEDRPELLKDLMETLKSLQMETLFADMTTVGGRTRNVLVVAADKEHHGVQSVNFLQNALKSLLERSSKSVMVGHGGGGGEERLKRRRALDHIIMV

SEQ ID NO: 1523 - DNA, 1368 bp, Arabidopsis thaliana
atgatgatgaacagagacatattatttcatcaacaacaacagcaacaaatggaagagaacatgtcgaatctaacatcagcttcaggagatcaagcaagtgtgtcttcaggaaacagaactgaaactagtggctctaacattaatcagcatcatcaagaacagtgttttgttccacaatcgtctcttaagaggaagagaaatcaaccaggaaatccagacccagaagcagaagtgatggccttatcaccaaagacactaatggcgacaaacagattcatatgtgaggtctgcaacaaaggttttcaaagagaccaaaacttgcaacttcacaagagaggacataatctaccgtggaagcttaaacaaagatcaaacaaagatgtggttaggaagaaagtttatgtttgtccagagccaggctgtgtccatcaccatccatcgagagctcttggtgacttaaccggaatcaagaagcatttcttcagaaaacatggcgagaagaaatggaaatgtgaaaagtgttccaagaaatatgcggtgcaatcagattggaaggctcatgctaagacttgtggcactaaagaatacaaatgcgactgtggaactctcttttctaggagggatagtttcataactcatagagcattttgcgatgcattagcagaagagagtgcaagagccatgccaaaccctattatgatccaagcttcaaattctcctcatcatcatcatcatcaaacacaacaaaacatcggtttctcttcgtcatcccaaaacatcatcagcaacagcaatctccatggtcctatgaagcaagaagaatcacagcatcactatcaaaatatccctccttggcttatctcatcaaaccctaaccctaatggcaacaatggtaatttgttccctcctgttgcttcttctgtgaataccgggaggtccagctttccccacccatcgccggctatgtcagccacagctttgctccagaaagcagctcaaatgggttctacgaagtcaacaactccagaggaagaagagaggtcttcgaggtcaagctataataacttgatcacgactacaatggctgctatgatgacttcaccaccagaacctggcttcggatttcaagactattacatgatgaatcatcaacatcacggtggaggagaagctttcaacggtggttttgtccccggagaagagaagaacgacgtcgtggacgacggtggaggagagacgagagatttcttggggctaaggtcgttaatgtcgcataacgagattctaagtttcgcgaataatcttggcaactgtctcaacacttctgctacagcgcaacaacaacaacaacatagccaccaagattaa

SEQ ID NO: 1524 - protein, 455 aa, Arabidopsis thaliana
MMMNRDILFHQQQQQQMEENMSNLTSASGDQASVSSGNRTETSGSNINQHHQEQCFVPQSSLKRKRNQPGNPDPEAEVMALSPKTLMATNRFICEVCNKGFQRDQNLQLHKRGHNLPWKLKQRSNKDVVRKKVYVCPEPGCVHHHPSRALGDLTGIKKHFFRKHGEKKWKCEKCSKKYAVQSDWKAHAKTCGTKEYKCDCGTLFSRRDSFITHRAFCDALAEESARAMPNPIMIQASNSPHHHHHQTQQNIGFSSSSQNIISNSNLHGPMKQEESQHHYQNIPPWLISSNPNPNGNNGNLFPPVASSVNTGRSSFPHPSPAMSATALLQKAAQMGSTKSTTPEEEERSSRSSYNNLITTTMAAMMTSPPEPGFGFQDYYMMNHQHHGGGEAFNGGFVPGEEKNDVVDDGGGETRDFLGLRSLMSHNEILSFANNLGNCLNTSATAQQQQQHSHQD

SEQ ID NO: 1525 - DNA, 888 bp, Arabidopsis thaliana
atgggagctccaaagctgaagtggacaccagaagaagaaacagctcttaaagctggagtacttaaacatggaactggaaaatggcgtaccattctctcagatcctgtgtatagcacaattctgaagtctcgttctaatgtggatctcaaggacaaatggagaaatataagtgtaacagctttatggggatctaggaagaaggctaagcttgctcttaaaagaactcctttgtcgggtagtaggcaagacgataacgctacagctattaccattgtgtctttagctaatggtgatgtaggaggacaacagattgatgcaccatctcctcctgcaggttcttgtgaacctccaagaccttctacaagtgtggataagattatattggaggctattaccagcttgaagagaccatttggtcctgacggaaagtcgatcttgatgtatatagaggagaatttcaagatgcaaccggatatgaaacggcttgtgacttcaaggctgaagtatttgacaaatgttggaacattagttaagaaaaagcacaaatacaggatttctcagaattatatggctgaaggagaaggacaaaggtctcctcaactcttgttggaaggaaacaaggaaaacactccgaaaccggaggagaatggcgtcaaaaatcttactaaatcccaagtaggtggagaagttatgataatgggtatgacagaaaaagaagctgctgcagcagctgcaagagctgtggcagaagcagaatttgcaatggcagaagctgaagaagcagcaagagaggcagataaagcagaagccgaagctgaagctgcccatatttttgcaaaagcggcgatgaaagctgtgaagtatagaatgcatagccaaactcggtaa

SEQ ID NO: 1526 - protein, 295 aa, Arabidopsis thaliana
MGAPKLKWTPEEETALKAGVLKHGTGKWRTILSDPVYSTILKSRSNVDLKDKWRNISVTALWGSRKKAKLALKRTPLSGSRQDDNATAITIVSLANGDVGGQQIDAPSPPAGSCEPPRPSTSVDKIILEAITSLKRPFGPDGKSILMYIEENFKMQPDMKRLVTSRLKYLTNVGTLVKKKHKYRISQNYMAEGEGQRSPQLLLEGNKENTPKPEENGVKNLTKSQVGGEVMIMGMTEKEAAAAAARAVAEAEFAMAEAEEAAREADKAEAEAEAAHIFAKAAMKAVKYRMHSQTR

SEQ ID NO: 1527 - DNA, 252 bp, Arabidopsis thaliana; identical to SEQ ID NO: 507

SEQ ID NO: 1528 - protein, 83 aa, Arabidopsis thaliana; identical to SEQ ID NO: 508

SEQ ID NO: 1529 - DNA, 1016 bp, Arabidopsis thaliana; identical to SEQ ID NO: 533

SEQ ID NO: 1530 - protein, 260 aa, Arabidopsis thaliana; identical to SEQ ID NO: 534

SEQ ID NO: 1531 - DNA, 735 bp, Arabidopsis thaliana; identical to SEQ ID NO: 545

SEQ ID NO: 1532 - protein, 244 aa, Arabidopsis thaliana; identical to SEQ ID NO: 546

SEQ ID NO: 1533 - DNA, 975 bp, Arabidopsis thaliana
atgacttcaatcccaaatggcttaaattcttatgttgacgatactgtgaacatttgtggttttactcccatcgaaatgagttccaaccttaggaatcatgagtctaagatggttcactcaatgttcaatacttctgaccacacgaatcatcatggtttgttttcttcctctcgtgtgtttaatttttatcaagattcacatgtttcttcatcttcttttggtttcaacaattcacatatggcttatcatatgagaaaaaacatggtttccacttttgggatgccttgcataactcaaaactcaaataaccctcatctttctcaaatctctattactcaaactatcacaaatagctattctgctattgttcctacctataatcttattacttcccaaaatgaatatcaacgtgccaaagaacccaacatcttcaatcctcctttttaccctccaaattttgttgacaaaaatgttggaaaccaatgccagatcttgaatcctacacccctcaataccatttttccacatcaagcttccatatttcctaggaatgtagacaaattttctttttcaccaaaacagaaccctcaccaatatgtttcgtatcgccaacccctgaaaagacattgtagaccaaccaaaaaatttgaaaatacttttagtgattttgattctggaaaagatattgaatacgatggtcggacgcatagcttaccatatgagaaatacggtccatatacatgtcccaaatgtaacagtgtgtttgacacttcacaaaagtttgctgcacatatatcatcgatgcactacaaaaatgagtccatagaagagaaatttaagagatataatgcaaggaacaaaaagagattacgtaaaagaaaccaaatgatccatgaagaatctaacaatatccaaccagaagagatagttgcagaggaaagcggaggcgataacaacatagcaagtagcaagtga

SEQ ID NO: 1534 - protein, 324 aa, Arabidopsis thaliana
MTSIPNGLNSYVDDTVNICGFTPIEMSSNLRNHESKMVHSMFNTSDHTNHHGLFSSSRVFNFYQDSHVSSSSFGFNNSHMAYHMRKNMVSTFGMPCITQNSNNPHLSQISITQTITNSYSAIVPTYNLITSQNEYQRAKEPNIFNPPFYPPNFVDKNVGNQCQILNPTPLNTIFPHQASIFPRNVDKFSFSPKQNPHQYVSYRQPLKRHCRPTKKFENTFSDFDSGKDIEYDGRTHSLPYEKYGPYTCPKCNSVFDTSQKFAAHISSMHYKNESIEEKFKRYNARNKKRLRKRNQMIHEESNNIQPEEIVAEESGGDNNIASSK

SEQ ID NO: 1535 - DNA, 998 bp, Arabidopsis thaliana; identical to SEQ ID NO: 555

SEQ ID NO: 1536 - protein, 191 aa, Arabidopsis thaliana; identical to SEQ ID NO: 556

SEQ ID NO: 1537 - DNA, 3786 bp, Arabidopsis thaliana
atgaagaaaagaggtttctacaatttgaagcatccatttgatccatgtcctttcgagttcttctgctcgggtacatggaagcctgtggaatacatgaggatcgaagatggaatgatgacaatacgtctgttagagaatggttatgtgttggaagatatccgtcctttccaaaggcttcgtctcagatcaagaaaagcggctttgagcgactgtatctgtttccttcggcctgatatcgatgtttgtgttctctatcgtatccacgaggatgacttggaaccggtttgggtggatgcgaggattgtttctatagagaggaagcctcatgagtctgaatgctcttgcaagatcaatgttagaatttacattgaccaaggctgcattggctcggagaaacagagaatcaatagagattccgtggttatcggtctaaaccaaatctccattctccaaaagttttacaaggaacaaagtactgatcagttctacagatggagattctctgaggactgcacttccttgatgaaaacaagactgtctttgggaaagttcttgccggatctttcgtggttgactgttacctcaactttgaaaagcattgtgtttcaaataagaacagtgcaaaccaagatggtttatcagattgtaacagatgaagaaggctctagcagtacgttgagttcgatgaatattactttggaagacggtgtttcgttatcaaaagtggttaagtttaatccggcagatatattggatgattctcaagatcttgaaataaagcaagaaaccgattattatcaagaagaagatgaggtagtggaactacgtaggtccaaaagaagaaacgtgagaccggatatctacaccggatgtgattatgagccagatacaattgacggttgggtgcggatgatgccgtaccagtttggaaaatgtgctgttaatgttgagagtgatgaagacgaggacgataacaatgaggatggtgatactaatgatgatttgtatataccattatcgcgtttattcatcaagaaaaagaaaactaattctcgagaagcgaaaccgaaaagtcgaaaaggcgagatcgttgtgatagacaagaggagagtacatggatttggtagaaaagagaggaaatccgagctttcggttattcctttcactccggtgtttgagcctataccgttggaacagtttggtcttaatgctaacagttttggtgggggtggtagtttctcaagaagccagtactttgatgagactgaaaagtatcgaagtaaaggcatgaaatacgggaagaaaatgacggaaatggaagagatgatggaagctgatctatgttggaaaggtcctaaccaggtgaagtcgtttcaaaaacgaacatcccgatcttcgcggtcagttgctccaaaaacagaggattctgatgaaccacgggtctataagaaagtaacattgagtgcaggtgcatataacaagctgatagatacatacatgaacaacattgagtccacaattgcagccaaggacgagcctaccagtgttgttgaccagtgggaggagttaaagaagacgaatttcgcatttaaactgcatggggatatggaaaagaacttgagtgaggatggtgagggagagacttcagagaacgaaatgttatggagagaaatggaactatgcttggcttcttcttacattctcgatgacaacgaggtaagagtggataacgaggctttcgaaaaggcgagaagtggttgtgagcacgattataggctggaggaagaaatcgggatgtgttgcaggttatgtggtcatgtaggaagtgagataaaagatgtatctgcaccatttgcagaacataagaaatggaccatagagactaagcatatcgaagaagatgacataaagactaagttgagccacaaagaagcccagactaaagatttctctatgataagtgattcttcagaaatgcttgcggctgaagaaagtgacaacgtttgggcattaatacctaagcttaagagaaaactacatgtgcatcaacgaagagctttcgagtttctctggagaaatgtagcaggatctgtggaaccctcgcttatggatcccacttcaggtaacataggtggttgtgtgatctctcattcacctggagctggtaaaacattcctaatcattgctttcctcactagctacttgaagctatttcccgggaaaagacctttggttcttgctcctaaaacaactttgtacacatggtacaaggagttcatcaaatgggagatcccagttccggttcatttgatccacggtcgaagaacctattgtaccttcaaacagaacaaaacggttcagttcaatggagttcctaaaccgagccgagatgttatgcatgttcttgattgcctagaaaaaatacagaaatggcatgctcatccgagtgttcttgtaatgggttacacctcgtttacgactttgatgagggaagactcgaagtttgctcaccggaaatacatggctaaagtgctaagagagagtcccgggcttcttgttcttgatgaagggcataacccgaggagtaccaagtcaagactacgtaaggccttgatgaaagttggtactgacttaagaatacttctttcgggtactttgtttcagaacaacttttgcgagtacttcaacacgctatgtttggctagaccaaagtttattcatgaggttctaatggagttagatcagaaattcaagaccaatcacggtgtgaataaggcgcctcacttgctcgagaatagagctcgtaaattattcctcgatataattgccaagaagattgatgcaagcgtgggagatgaacgccttcaaggtctcaatatgttgaagaatatgactaatggtttcattgataactatgaagggagtggaagtggaagtggtgatgctcttccaggtctacagatctatacattagtgatgaactcgacggatatacagcataagatactcacgaaacttcaggatgtaataaagacgtactttgggtatccacttgaggtcgagcttcagataacattagcagctatacatccgtggttggtcacaagctcaaactgttgcacaaaattcttcaacccgcaagaactttccgagatcggaaaactcaagcacgacgcaaagaaaggatctaaagtcatgtttgtgttaaaccttattttccgagtggtcaagagggagaagatcttgatcttttgccacaacattgcgccaatccgtatgtttaccgaactgtttgagaacattttcaggtggcaaagaggcagagagatcttgaccttaaccggtgatcttgagctgtttgaaagaggtcgagtgatagacaaattcgaagaacctggaaacccatcccgagtcctcctggcctcgatcacagcttgcgcagaagggattagtctgaccgctgcttcacgggtcatcatgctcgactcagaatggaacccttctaagacaaagcaagctatagctcgtgcattcagaccgggacagcagaaagttgtttacgtttatcagctcttgtccagaggaacattagaggaagacaagtacaggaggacaacatggaaagagtgggtctcgtgtatgatattcagtgaggagtttgttgcggatccatctctgtggcaagctgagaagattgaagatgatattcttagagagatcgttggagaagataaagttaaatctttccatatgatcatgaagaatgagaaggcttcaacagggtaa

SEQ ID NO: 1538 - protein, 1261 aa, Arabidopsis thaliana
MKKRGFYNLKHPFDPCPFEFFCSGTWKPVEYMRIEDGMMTIRLLENGYVLEDIRPFQRLRLRSRKAALSDCICFLRPDIDVCVLYRIHEDDLEPVWVDARIVSIERKPHESECSCKINVRIYIDQGCIGSEKQRINRDSVVIGLNQISILQKFYKEQSTDQFYRWRFSEDCTSLMKTRLSLGKFLPDLSWLTVTSTLKSIVFQIRTVQTKMVYQIVTDEEGSSSTLSSMNITLEDGVSLSKVVKFNPADILDDSQDLEIKQETDYYQEEDEVVELRRSKRRNVRPDIYTGCDYEPDTIDGWVRMMPYQFGKCAVNVESDEDEDDNNEDGDTNDDLYIPLSRLFIKKKKTNSREAKPKSRKGEIVVIDKRRVHGFGRKERKSELSVIPFTPVFEPIPLEQFGLNANSFGGGGSFSRSQYFDETEKYRSKGMKYGKKMTEMEEMMEADLCWKGPNQVKSFQKRTSRSSRSVAPKTEDSDEPRVYKKVTLSAGAYNKLIDTYMNNIESTIAAKDEPTSVVDQWEELKKTNFAFKLHGDMEKNLSEDGEGETSENEMLWREMELCLASSYILDDNEVRVDNEAFEKARSGCEHDYRLEEEIGMCCRLCGHVGSEIKDVSAPFAEHKKWTIETKHIEEDDIKTKLSHKEAQTKDFSMISDSSEMLAAEESDNVWALIPKLKRKLHVHQRRAFEFLWRNVAGSVEPSLMDPTSGNIGGCVISHSPGAGKTFLIIAFLTSYLKLFPGKRPLVLAPKTTLYTWYKEFIKWEIPVPVHLIHGRRTYCTFKQNKTVQFNGVPKPSRDVMHVLDCLEKIQKWHAHPSVLVMGYTSFTTLMREDSKFAHRKYMAKVLRESPGLLVLDEGHNPRSTKSRLRKALMKVGTDLRILLSGTLFQNNFCEYFNTLCLARPKFIHEVLMELDQKFKTNHGVNKAPHLLENRARKLFLDIIAKKIDASVGDERLQGLNMLKNMTNGFIDNYEGSGSGSGDALPGLQIYTLVMNSTDIQHKILTKLQDVIKTYFGYPLEVELQITLAAIHPWLVTSSNCCTKFFNPQELSEIGKLKHDAKKGSKVMFVLNLIFRVVKREKILIFCHNIAPIRMFTELFENIFRWQRGREILTLTGDLELFERGRVIDKFEEPGNPSRVLLASITACAEGISLTAASRVIMLDSEWNPSKTKQAIARAFRPGQQKVVYVYQLLSRGTLEEDKYRRTTWKEWVSCMIFSEEFVADPSLWQAEKIEDDILREIVGEDKVKSFHMIMKNEKASTG

SEQ ID NO: 1539 - DNA, 802 bp, Arabidopsis thaliana
gtaactatctaaaactcaaaatgtgtgcacttgtccctccattatatcccaatttcggctggccttgcggagatcatagcttctatgaaaccgacgacgtatccaacacgtttcttgattttccgttgccggacttgacggtgactcatgagaatgtgtcgtctgagaataacagaacattactagacaatcccgtggtgatgaagaagcttaatcacaacgcgagtgaacgtgagcgtcgcaagaagatcaacacaatgttctcatctcttcgttcttgtcttcctcccaccaatcaaacgaagaagttaagtgtttcggcaacagtttcacaagcattgaagtacataccagagctgcaagagcaagttaaaaagctcatgaagaagaaagaagagctctcgtttcaaatttcgggtcaaagagatctcgtttacaccgaccaaaacagtaagtcagaggaaggggttacaagctatgcgtcgacagtttcttcgactaggctcagtgagactgaagtgatggtccaaatttcatcgttacagactgaaaaatgttcgtttgggaatgtcttgagtggtgtagaagaagatgggttggttcttgtgggtgcttcatcttcaaggtctcatggagagcgactcttttactctatgcatcttcagataaaaaatggccaggtgaattccgaagaattaggtgatagattgttgtacttgtacgagaaatgtggacactcgtttacatgatttaataattaacgatgctatatatattttttctgaaaaaaaaaaaaaaaaaa

SEQ ID NO: 1540 - protein, 242 aa, Arabidopsis thaliana
MCALVPPLYPNFGWPCGDHSFYETDDVSNTFLDFPLPDLTVTHENVSSENNRTLLDNPVVMKKLNHNASERERRKKINTMFSSLRSCLPPTNQTKKLSVSATVSQALKYIPELQEQVKKLMKKKEELSFQISGQRDLVYTDQNSKSEEGVTSYASTVSSTRLSETEVMVQISSLQTEKCSFGNVLSGVEEDGLVLVGASSSRSHGERLFYSMHLQIKNGQVNSEELGDRLLYLYEKCGHSFT

SEQ ID NO: 1541 - DNA, 914 bp, Arabidopsis thaliana
ttccaagcatctagagaaaacagaatctacaatacttgtccttagtaagcaaaaatgtgtgcattagtacctccattgtttccaaactttgggtggccatcaacgggagagtacgacagctactacctcgccggagatatcctcaacaacggcgggtttcttgattttccggtaccggaggagacttatggagctgttacagcggtgactcaacatcagaatagctttggtgtttctgtttcgtcggagggaaatgaaatagacaacaatccggtggtcgtcaagaagcttaatcacaatgctagtgagcgtgaccgtcgcaggaaaattaactctttgttctcatctctccgttcatgtcttcctgcctctggccaatcgaagaagctaagcattcctgcgacggtttctcgaagcttgaagtacataccagagctgcaagagcaagtgaagaagctaataaaaaagaaggaagagctcttggtgcaaatttcaggtcaaagaaacactgaatgttacgttaagcagccaccaaaggccgtcgcgaattatatctcgaccgtttctgcgactaggcttggtgacaacgaagtgatggtccaaatctcatcgtccaagattcataacttttcgatatctaatgttttaagtgggttagaagaagataggtttgttcttgtggacatgtcatcttcaaggtctcaaggagaaaggcttttctacactttgcatttacaagtggagaagattgaaaattacaagctgaattgcgaagagttaagtcagaggatgttgtacttgtatgaggaatgtggaaactcatatatatgagaatttggtcttgtttctttatagttatgttatgtcgtcctttttctcttcgaaatctaacattctccaaaaaaaaaaaaaaa

SEQ ID NO: 1542 - protein, 258 aa, Arabidopsis thaliana
MCALVPPLFPNFGWPSTGEYDSYYLAGDILNNGGFLDFPVPEETYGAVTAVTQHQNSFGVSVSSEGNEIDNNPVVVKKLNHNASERDRRRKINSLFSSLRSCLPASGQSKKLSIPATVSRSLKYIPELQEQVKKLIKKKEELLVQISGQRNTECYVKQPPKAVANYISTVSATRLGDNEVMVQISSSKIHNFSISNVLSGLEEDRFVLVDMSSSRSQGERLFYTLHLQVEKIENYKLNCEELSQRMLYLYEECGNSYI

SEQ ID NO: 1543 - DNA, 1161 bp, Arabidopsis thaliana; identical to SEQ ID NO: 595

SEQ ID NO: 1544 - protein, 221 aa, Arabidopsis thaliana; identical to SEQ ID NO: 596

SEQ ID NO: 1545 - DNA, 1419 bp, Arabidopsis thaliana
atggaagattcaagcaaaaaaagccaaaagaagaagaagaacaaaagcaagaacaacatcccaactgtttggttctcactcaagaaatccctccactgtaaatccgaaccatctgatgtccacgacccaatatccaccactaaacagcaacaacacctctccacaatctccaccaagaaaatctccggcatatcatccggcggagccgccgtatgcggtggtggtttatcaggatgttcaagatcaatagcaaatctcaaagacgtaatccatggaagcaaaagacatttcgagaaaccaccaataagtagtcctcgttctattggaagcaatgagtttctaaatcctataactcatgaagttattcttagtaactcaacttgtgagcttaagatcactggtgtcggagacatggcttcacctgtcggagcagcggattccggcggaggtggcggtggaggaaatggtcggtctacgacttatgtagggatgcttagaccaggaacaccgatgcattatcttaaccattcagcttcttacaggagccaaacaagaaagggttcgtttgctttgtcggagagagatcgaggaggaggaggaggaggagaagggttagggtttcatacaaacagaagggtttcattggagatgaacagagaatccaccattaatggaggcaacaattcctctgtttcttgtcataaatgtggtgaacagttcaataagcttgaagctgctgaagctcatcatctctctaaacatgccgtaacggagcttgtagaaggagattcatcaagaaaaatagtggagataatctgcagaacaagctggttaaagtcagagaaccaatgtggaagaatcgatagagttttaaaagtacacaacatgcagaagacattagctagattcgaggaatacagagaaacagttaaaatcagagcaagcaaacttcagaagaagcatccaagatgtctcgcagacggtaacgagctacttaggttccacggaaccaccgtggcttgtggtttaggtataaacgggtcaacaagtgtttgcacggcggagaaatgttgtgtctgtcggattatacgaaacgggttctcgtcgaaacgggagaagaataatggggttggtgttttcacggcgtctactagtggaagagcgttcgagtcgattttggttaacggtggagatgagagtggagatgttgatcggacggtgaggaaagtgttgattgtgtgtagggttatcgccggaagagttcatcggccggtggagaatgtggaggagatgaatgggttgatgagtgggtttgattctttggctggcaaagttggtttgtatacaaatgtggaggagctttatttgcttaatcctaaagctttgcttccttgctttgtggtcatttgcaagccctaa

SEQ ID NO: 1546 - protein, 472 aa, Arabidopsis thaliana
MEDSSKKSQKKKKNKSKNNIPTVWFSLKKSLHCKSEPSDVHDPISTTKQQQHLSTISTKKISGISSGGAAVCGGGLSGCSRSIANLKDVIHGSKRHFEKPPISSPRSIGSNEFLNPITHEVILSNSTCELKITGVGDMASPVGAADSGGGGGGGNGRSTTYVGMLRPGTPMHYLNHSASYRSQTRKGSFALSERDRGGGGGGEGLGFHTNRRVSLEMNRESTINGGNNSSVSCHKCGEQFNKLEAAEAHHLSKHAVTELVEGDSSRKIVEIICRTSWLKSENQCGRIDRVLKVHNMQKTLARFEEYRETVKIRASKLQKKHPRCLADGNELLRFHGTTVACGLGINGSTSVCTAEKCCVCRIIRNGFSSKREKNNGVGVFTASTSGRAFESILVNGGDESGDVDRTVRKVLIVCRVIAGRVHRPVENVEEMNGLMSGFDSLAGKVGLYTNVEELYLLNPKALLPCFVVICKP

SEQ ID NO: 1547 - DNA, 1244 bp, Arabidopsis thaliana
tgtctctctttctcccgcaggtcaccgagaaaatatcttttgttgtctccacccaccccacccaggttatggattctctcgctctcgctccccaggtttacagccgcaaggacaaatctctcggcgttcttgtcgccaatttcttgacactgtataatcgtcccgatgttgatctatttgggctcgatgatgccgccgcgaaattaggagttgaacgtcggcgtatttatgatgtggtcaatatattggagagtattgggcttgttgcaagaagtgggaagaatcagtattcgtggaaaggttttggagctgttcctcgtgctctatctgaactcaaagaagagggaatgaaagagaagtttgcgatcgtcccttttgtggccaagtcagagatggtcgtttatgagaaagaaggagaagaatctttcatgttatctcctgatgatcaagagttctcaccatctcccagacctgacaacaggaaggagagaactctctggctacttgcacagaactttgtgaagctgtttttatgctctgatgatgatctggtaacatttgatagcgctacaaaagcattgctgaatgagtctcaggatatgaatatgagaaagaaagttagacgcctttacgacattgcaaatgtgttttcctcaatgaagctaatcgagaagactcatgtcccagagactaagaagccggcatataggtggttgggatctaaaaccatatttgaaaacagattcattgatggttctgcaagcttatgtgatcgtaatgtgcctaaaaagcgggcatttgggaccgaactcacaaacgttaacgcaaagagaaacaaatcaggttgttctaaagaagacagcaagcgtaatggaaatcaaaacacaagcattgttatcaagcaagaacaatgtgatgatgtgaaaccggacgtgaagaattttgcctctggatcatccactcctgcaggcacttctgagagtaacgatatgggaaacaacattaggccaagaggtagacttggagttatcgaagccctttctactctttaccaaccatcatattgcaatcctgagttacttggtctttttgcgcattacaacgagacatttaggtcatatcaagaagagtttggtcgggagaaatgacttaatcatcaggtagattaacttgcggggcgtaacttcaattctctaatcacaagccaaatttcttttgctcatttgcgttaaactacagaaaaa

SEQ ID NO: 1548 - protein, 359 aa, Arabidopsis thaliana
MDSLALAPQVYSRKDKSLGVLVANFLTLYNRPDVDLFGLDDAAAKLGVERRRIYDVVNILESIGLVARSGKNQYSWKGFGAVPRALSELKEEGMKEKFAIVPFVAKSEMVVYEKEGEESFMLSPDDQEFSPSPRPDNRKERTLWLLAQNFVKLFLCSDDDLVTFDSATKALLNESQDMNMRKKVRRLYDIANVFSSMKLIEKTHVPETKKPAYRWLGSKTIFENRFIDGSASLCDRNVPKKRAFGTELTNVNAKRNKSGCSKEDSKRNGNQNTSIVIKQEQCDDVKPDVKNFASGSSTPAGTSESNDMGNNIRPRGRLGVIEALSTLYQPSYCNPELLGLFAHYNETFRSYQEEFGREK

SEQ ID NO: 1549 - DNA, 1158 bp, Arabidopsis thaliana; identical to SEQ ID NO: 609

SEQ ID NO: 1550 - protein, 385 aa, Arabidopsis thaliana; identical to SEQ ID NO: 610

SEQ ID NO: 1551 - DNA, 1267 bp, Arabidopsis thaliana; identical to SEQ ID NO: 611

SEQ ID NO: 1552 - protein, 292 aa, Arabidopsis thaliana; identical to SEQ ID NO: 612

SEQ ID NO: 1553 - DNA, 1011 bp, Arabidopsis thaliana
taagcttaacataaaccctaatattttcttgatttttttcaagaaaataaaaacataaagatgcttgaagttagatcaatggatatgactccaaaatcaccagaacccgaatccgaaactccgacccggatccaaccagctaaaccaatctctttcagtaacggaatcatcaaacgccaccaccaccaccaccacaacaacaacaaagtcacttacaaagaatgtctcaagaaccacgcggcggcgattggtggtcacgcgcttgacggttgcggcgaatttatgccgtctccttcgtcaacaccttccgatccaacttctctcaagtgtgcagcttgtggttgtcaccgtaacttccaccgccgtgaaactgacgattcctccgccgttccaccaccgtctcttcttccatcttcaacaacaaccgccgcaattgagtatcagcctcatcaccgtcatcatcctcctcctccgctagctcctccgttaccacgtagtcctaattcatcttctccgccgcctatctcttcctcctacatgcttttagctctctccggtaataataaaaccgcaccgttctcagatctaaacttcgccgccgcggctaaccatctctccgccacgcctggctcgaggaagcgattcaggacgaagtttagctcaaatcagaaagagaagatgcatgaattcgccgatcgaatcggttggaagattcagaaacgtgacgaagacgaagttcgtgatttttgccgtgagatcggagttgataaaggtgttctcaaagtttggatgcataataacaaaaactccttcaaattctccggcggaggagcaaccaccgtgcagagaaacgataacggtatcggcggcgagaacagtaacgatgatggagttcgcggtttagctaacgacggtgacggtggtggtgggagatttgagagtgatagtggaggagctgatggtggcggaaacgtaaacgcctcgtcgtcttcgtcgtgaagaagaaaacat

SEQ ID NO: 1554 - protein, 312 aa, Arabidopsis thaliana
MLEVRSMDMTPKSPEPESETPTRIQPAKPISFSNGIIKRHHHHHHNNNKVTYKECLKNHAAAIGGHALDGCGEFMPSPSSTPSDPTSLKCAACGCHRNFHRRETDDSSAVPPPSLLPSSTTTAAIEYQPHHRHHPPPPLAPPLPRSPNSSSPPPISSSYMLLALSGNNKTAPFSDLNFAAAANHLSATPGSRKRFRTKFSSNQKEKMHEFADRIGWKIQKRDEDEVRDFCREIGVDKGVLKVWMHNNKNSFKFSGGGATTVQRNDNGIGGENSNDDGVRGLANDGDGGGGRFESDSGGADGGGNVNASSSSS

SEQ ID NO: 1555 - DNA, 1014 bp, Arabidopsis thaliana
atgtctaatccagcttgttcgaatctcttcaacaatggatgtgaccataatagcttcaactattccacttctctctcttacatttacaactctcacggtagctactattactctaataccacaaaccctaattacattaatcatactcataccacttccacttcccctaactcacccccactaagagaagctcttcctcttcttagcttaagccccataaggcaccaagaacaacaagaccaacactatttcatggacacccatcaaattagctcttcaaactttcttgatgatcctcttgtgactgtggatcttcatctagggttaccaaactacggtgttggtgagagcattaggagcaatattgctcctgatgcaaccacggacgagcaagatcaagatcatgaccgaggagtagaagtcacagttgagtcccaccttgatgatgatgatgatcatcatggagatctacacagaggtcatcactattggattcctactccttctcagattttgattggtcctacacagttcacttgtcctctttgcttcaagacattcaacagatacaacaacatgcagatgcacatgtggggacacggctcacaatacagaaagggaccagaatccttaagaggaacccaaccaacaggaatgctaagactaccatgtttctgctgtgcacccggttgcaagaacaacattgaccacccacgagccaagcctcttaaggactttcgaaccctccaaacacattacaaacgtaaacatgggtctaaaccatttgcttgtcgtatgtgtggtaaggcctttgcagtgaaaggagattggagaacgcatgagaagaattgtggaaagctttggtattgctcttgtggctcggattttaagcacaagaggtcgcttaaggaccatgtcaaggcctttggaaatggtcatgttccttgtgggattgatagttttggaggagatcatgaggactactatgatgctgcttctgatatcgagcaataa

SEQ ID NO: 1556 - protein, 337 aa, Arabidopsis thaliana
MSNPACSNLFNNGCDHNSFNYSTSLSYIYNSHGSYYYSNTTNPNYINHTHTTSTSPNSPPLREALPLLSLSPIRHQEQQDQHYFMDTHQISSSNFLDDPLVTVDLHLGLPNYGVGESIRSNIAPDATTDEQDQDHDRGVEVTVESHLDDDDDHHGDLHRGHHYWIPTPSQILIGPTQFTCPLCFKTFNRYNNMQMHMWGHGSQYRKGPESLRGTQPTGMLRLPCFCCAPGCKNNIDHPRAKPLKDFRTLQTHYKRKHGSKPFACRMCGKAFAVKGDWRTHEKNCGKLWYCSCGSDFKHKRSLKDHVKAFGNGHVPCGIDSFGGDHEDYYDAASDIEQ

SEQ ID NO: 1557 - DNA, 710 bp, Oryza sativa
  misc_feature (20)..(20): n is a, c, g, or t
  misc_feature (31)..(31): n is a, c, g, or t
  misc_feature (51)..(51): n is a, c, g, or t
  misc_feature (64)..(64): n is a, c, g, or t
  misc_feature (98)..(98): n is a, c, g, or t
  misc_feature (115)..(115): n is a, c, g, or t
gacccagggtcccgctgacntcgccggcganccgcccgccgtcgttgcccnaggccagatccgncaagcccaggccggatctggccacttgccgccantccgacgacgacgaccntgcggtgttctaccttcgcggccggtcggcgcggctcaacttccccgaggagatctccttgctggcttcgccgtcagagggtggcggcgcaggcgagccccgcgagcccgacggcggcacgctgtccgcggcctcgatccggaagaaggccatcgaggtcggctcccatgtcgacgcgctccagaccggcatgatggtcgcgccgacccaccaccgcgagcagcagaagcaccaccaccacccgcacctgcaaccgcacggcgaggagcaacaccaccacgaggattggattagttctaagtatgaagacattcatacttaaaaatctcttgttgatctcttcctctcgcccctgtcttggttggattagttgccatattagagtaagcactaatccatccatacttcttgctcgatcttgatttcgcgtggttaagtaagtcgtattagcctttcaggttaaggaggttgttaaggtttttaagtaagaacctcctgtagcttacttactagtttgtgatgcttgctgtattttcttctagttcttggcttggtcttaaggagtttttgtttgattgtaaaaaaaaaaaaaaaa

SEQ ID NO: 1558 - DNA, 536 bp, Oryza sativa
tcctccgacctcaatcgcatttcgccgaacaccttgcatgcgcccccgtccacgaccgcctccttggcgctatccgcttcgctgactagctatagctactagctgctactctctctctgtgtcttggggtggctaaggactacgaacaagatggatggaagaagggaggcaaaatcagctcggattactactcgtcgtcggaggtgtccggggtgggctcccgttgagtcggggttcttggtccgcggcgctggggcgcggggctgcggcggctggagcggcacgggcagccgcggcgccgacgacggagtgctgcgcgtcgacgcgggcgccgacctcggcggccttcttgcggatggcggcggcggtgagctccctgtggtcctcggcaccaccgccgctgccgccaccaccacccgcgccgtcgagctggtcggggaagttgaggcgcgcggagcgccgctctagaggatccaagcttacgtacgcgtgcatgcgacgtcatagctcttctatagtgtcacctaatcatcatg

SEQ ID NO: 1559 - DNA, 517 bp, Oryza sativa
catcctcctaaagctcccgacccagcgcaaggtccccgatttgcacgcacgccgagaacgccgcgacggcggcgacggtgtcgatgcacacccgctatcatccgccatggccgtacaagaaacgacgtcccggccagccggcgtggaatccatcgaagagcgcccaccggaggcgagctcgacgcgcgcgaggtagagctcgacgagcccatccggacgacgaggcggtggtcgaggccgagcttggccgcgtgtgcgtgcacggccggccggcctccctggtcggcgaccaagcccttgataagggccctgagcaacggcgccagtggcgctccggcgagctcctcccggtcccttctgcgagctccggtagctgtactagattaacttcttccattttttttgcctaattgtgatttgccagtagaatgaccctgattttctatggcctcttagttggatgagataagaagagatgagtatgatgagatggcatttgtaccaaaaaaaaaaaaaa

SEQ ID NO: 1560 - DNA, 690 bp, Oryza sativa
  misc_feature (28)..(28): n is a, c, g, or t
  misc_feature (77)..(77): n is a, c, g, or t
aagaaaggccttacgagctgcccgtttnttctgcgacgccgaggtcgcgctcatcatcttctccagccgcggcaagntctacgagttcggcagcgccgggtataattaatacagacacaacaacacacacaaccaacaaaccagcatcaatttgaacctgcagatctgctgttttctctgatcaattgcttctttttttttgttcttttttgtttcttttatctgctgcaacggcgtcctgctcctctggggtttctcgttttctttttcatttatttttagcaggtgccaagtagccgagctactatacttacctggccatgttaattattttattccgtctgtctgtgtgtgtctgtgcatactactatagggacatggcgcggtgttcttataaaccgggaggccggatccctaactagcatgggaggatatcttttcagcggatctatacaaaccctactcctgctgacctctttcttccagtttctccgggtcttccttggattattattgcccatcttccgggttgtgcgtgtgtcagagacagctcgaacgataaatttctcaaaaccagtactagagagggtgtgttgtgtgtgagaactgagtggagagttagcatgaaggctgcaaactagaaaggaaggtatgttctttcctttttgatccaaaaaaaaaaaaaaaaaa

SEQ ID NO: 1561 - DNA, 1043 bp, Oryza sativa
tacccgcgggaatcgttcgatcgatcgggcgagatggggaggggaagagttgagctgaagcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccggcataacaaagactttagaaaggtaccaacattgttgctacaatgctcaagattccaacaatgcactttctgaaactcagagttggtaccatgaaatgtcaaagttgaaagcaaaatttgaagctttgcagcgcactcaaaggcacttgcttggggaggatcttggaccactcagcgtcaaagaattgcagcagctggagaaacagcttgaatgtgcactatcacaggcgagacagagaaagacgcaactgatgatggaacaggtggaggaacttcgcagaaaggagcgtcagctgggtgaaattaataggcaactcaagcacaagctcgaggttgaaggttccaccagcaactacagagccatgcagcaagcctcctgggctcagggcgccgtggtggagaatggcgccgcatacgtgcagccgccgccacactccgcggccatggactctgaacccaccttgcaaattgggtatcctcatcaatttgtgcctgctgaagcaaacactattcagaggagcactgcccctgcaggtgcagagaacaacttcatgctgggatgggttctttgagctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggtaaactgttt

SEQ ID NO: 1562 - DNA, 1083 bp, Oryza sativa
gacaagagtactagttagcttaataatatagctttgcaaaagttgaggtaaggggttgtgagaagaagcagcttgatttgctactggctttgtgctgctgtgtggttgttctggtgtggatcgatcagagatggggaggggaagggttgagctgaagcgcatcgagaacaagatcaaccggcaggtcaccttctccaagcgccgcaacggcctcctcaagaaggcgtacgagctctccgtgctctgcgacgcggaggtggcgctcatcatcttctccagccgcggcaagctgtacgaattcggtagcgccggaataaacaagacattggaaaagtacaatagttgctgttacaacgctcaaggttcaaatagtgctcttgctggtggtgaacatcagagctggtaccaagagatgtcaaggctcaagactaagcttgaatgtctccaacgctctcagaggcacatgcttggtgaagatcttggaccattgagcataaaggaactgcagcagctggagaagcaacttgagtactcactgtcacaggctcgacaacgaaagacacaaatcatgatggagcaggtcgacgatcttcgccggaaggaacgccagcttggagagctcaataagcaactgaaaaacaagctagaagctgaagccgatagcagcaactgcagatcagccatccaggattcctgggtccatggcaccgtcgtcagtggcggcagagtgctgaatgctcaaccaccaccagatattgactgtgagcctactctgcaaattgggtactatcaatttgtccgtcctgaggcggccaatccaagaagcaatggaggaggaggggatcagaacaacaactttgtgatgggatggcccctctgaagtccaagcttgctaataaaaacgctggcgtgctataatatatagttcggcaaatgttgaaacacatgtgttctcagtatgtatatttctcccctatccggtggtactcttagcacgtacctatgagtgtatgtttgtacgttatctatactctatgctaggcaaccctatactattatggtaagacgtctatcttttcaatc

SEQ ID NO: 1563 - DNA, 999 bp, Oryza sativa
cacgcacgcacgcacgcacgcctccgttttcccccaccgacgagaggcggagagggaggggagctagggtttttcggggcggggatggcgcggagggggagagtgcagctgaggcggatcgaggacaaggcgagccggcaggtgcggttctccaagaggagggcggggctgttcaagaaggcgttcgagctcgccctgctctgcgacgtggaggtggcgctcctcgtcttctcccccgtcggcaagctctacgagtactcctcctccagcattgaaggtacctatgatcgctatcagcaattcgctggagccaggagagacctgaacgaaggaagtacaagcatcaacagtgatgaaaatgcaagtatacactccaggcttagggacataacggcctggtctctccaaaacaatgctgacgagtcggatgctaatcagctagagaaactggagaaactgctgacaaatgctttgagggatacgaaatcaaagaagatgttggcaaaacaaaatggtgaagggagtaggagcagagcaaactccagtggctctagggggcaggaggaaggaagtgcatgagcaggaagcacaggtgtcctgtgcataagtttggcagtgcatgcacctcccaaattaaaaagctaataaaaaaaagagaaaatggtgcatgctctgtttgctgccagtttctcccactgattgatcccaggtagagaaaagagttgccatggcctctggctctgcttgttagatcaagggggggagatggaataaaaggatggggaagtattcaggttcttgtaatgaagacctatgctgtggtgttttagcaatgtttgatatgtgtgctacctgtgtttgactggttgtgttgcttgatgtgtcatctgaccatgatactgaaagcctgataattgcactgacttgtgtatggagtttgtttcaacctattggtatgaatctgtttgattctgtaggaactgtggtttgctgtttgcc

SEQ ID NO: 1564 - DNA, 1373 bp, Oryza sativa
ctcgatcgatccatccatcgatcgatcggtcccccccaccgcgcgcgacgcattccgccgccgtctcgccgtgtccacgtgatgggggccggggctaggggataggcggatagccagcagccaccaccaccagtagttgccgtgtggggataggtgtggctatagggctagtggtcgtcgctgatagcgaggtgggtagggttaattttggttggaggtagagagagagagagagggagggagggaggaggaggaggaggaggaggaggaggaagaacaggaggaagatggggcggggcaaggtgcagctgaagcggatcgagaacaagatcaaccggcaggtgaccttctccaagcgcaggtcaaaactgctcaagaaggcgaatgagatctccgtgctctgcgacgccgaggtcgcgctcatcatcttctccaccaagggcaagctctacgagtacgccaccgactcatgtatggacaaaatccttgaacgttatgagcgctactcctatgcagaaaaggtccttatttcagctgaatctgacactcagggcaactggtgccacgaatataggaaactgaaggctaaggttgagacaatacagaaatgtcaaaagcacctcatgggagaggatcttgaatctttgaatctcaaagagctgcagcagctggagcagcagctggaaaattcgttgaaacatatcagatccagaaagagccaactaatgctcgagtccattaacgagcttcaacggaaggaaaagtcactgcaggaggagaataaggtcctacagaaagaactggtggagaagcagaaagtccagaagcaacaagtgcaatgggaccagacacaacctcaaacaagttcctcatcatcctccttcatgatgagggaagcccttccaacaactaatatcagtaactaccctgcagcagctggcgaaaggatagaggatgtagcagcagggcagccacagcatgaacgcattgggctgccaccatggatgctgagccacatcaacggctaaggaggcttcgagtccataccagtaatcacaagttgcaacctgacccggtccggtcgcctgctgctctggtttactactagtactattgtcatcttgcggttgcgagacgaggaaagcattttagccctaaattcagcattagtagcaagctgcaatgtgtatattttggcttcgtccagcaccgtcttcctcccaccagtaatttacccatgtaatatatgcgagcagcatgaacaaattttcccgtttccaaccatctccattggtgtcatgtgtgacttaaatagcgaaatttcagcattgtgcatagtgtgattactgtaagataaaaaaaaaaaaaaaaaa

SEQ ID NO: 1565 - DNA, 1031 bp, Oryza sativa
gctctccaccctccacccgccaccgccgcctttcgccgccgccgccgccgccgccgacgacgatggggagagggccggtgcagctgcggcggatcgagaacaagataaacaggcaggtgaccttctccaagcggaggaacgggctgctgaagaaggcgcacgagatctccgtgctctgtgacgccgacgtcgcgctcatcgtcttctccaccaagggcaagctctacgagttctccagccactccagtatggaagggatccttgaacgctaccagcgttactcgtttgatgaaagagccgtactggagccaaatactgaggaccaggaaaactggggtgatgaatatggaattttgaagtccaaactggatgcacttcagaagagccaaaggcaactcttaggtgaacaattggacacactaacaacaaaagaactccagcaattggaacatcaactggaatattctctgaagcatataagatcaaaaaagaatcagcttctgtttgaatcaatttctgagcttcagaagaaggaaaagtcacttaaaaaccagaataatgttctgcaaaagctcatggagacagaaaaggagaaaaacaatgctataataaacactaaccgggaggagcaaaatggagcaacaccaagcacatcatcaccaacaccagtgacggctccagatcccatcccgacaacaaataacagtcaaagccaaccaagaggatcaggggagtcagaagctcaaccgtctccggcacaagcaggcaacagcaagcttccgccatggatgctccggacaagtcacacatgaaggccatctgttgatctcaaacgtcactccactcaatggccaacatcaacatgtttcttccaactaaggcagccactgttgtgcaatccatcttccagcgatattgatatatcggcattcggcatagccaatatatattaatgtaatgtatcttgtcaaagcttcatagggttaatgacgccttgagcttctctgttctataaaaaaaaaaaaaaaaaa

SEQ ID NO: 1566 - DNA, 1347 bp, Oryza sativa
ctcctcctcctcttcttcttcttccactagctagttcgtcttcctccttcagctagcttgtagcagctaaggttaggtcggatcgagatcgggatcggccgccggcgagcggcgagcggcgaggatggggcgggggaaggtgcagctgaagcggatagagaactcgatgaaccggcaggtgacgttctccaagaggaggaatggattgctgaagaaggcgcacgagatctccgtcctctgcgacgccgaggtcgccgccatcgtcttctcccccaagggcaagctctacgagtacgccactgactccaggatggacaaaatccttgaacgttatgagcgctattcatatgctgaaaaggctcttatttcagctgaatctgagagtgagggaaattggtgccatgaatacaggaagcttaaggcaaagattgagaccatacaaaaatgtcacaaacacctcatgggagaggatctagaatccctgaatctcaaagaactccaacagctagagcagcagctggagagttcattgaagcacataagatcaagaaagagccaccttatgcttgagtccatttccgagctgcagaaaaaggagaggtcactgcaggaggagaacaaggctctgcagaaggaactggtggagaggcagaagaatgtgaggggccagcagcaagtagggcagtgggaccaaacccaggtccaggcccaggcccaagcccaaccccaagcccagacaagcttcttcttcttcttcatgctgagggatcagcaggcacttctttcaccacaaaatatctgctacccgccggtgatgatgggccagagaaatgatgcggcggcgcggcggcggtggcggcccaaggccaggtgcaacttccgcattggaggctttccgccatggatgctgagcaccttcaaggcttaagatgatcatcggcgtcgtcgtcgggccaacaagttgccgattgcaccgggaatcatgggagcaaccttgaatgaaatggaagcattgggattggaagcggataatatatatgaatctcctaaaaggaaatggactcaaaaaaaaaaacctagcgattaagctattcttatatatgcgtttgcctgctgctccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattat

SEQ ID NO: 1567 - DNA, 1308 bp, Oryza sativa; identical to SEQ ID NO: 742

SEQ ID NO: 1568 - DNA, 529 bp, Oryza sativa
  misc_feature (23)..(23): n is a, c, g, or t
  misc_feature (27)..(27): n is a, c, g, or t
  misc_feature (38)..(38): n is a, c, g, or t
  misc_feature (54)..(54): n is a, c, g, or t
  misc_feature (69)..(69): n is a, c, g, or t
gaatgggaaatcgcaggtccctnggancagattgggangcatttaccatgtctnccaaggagtggatanaggaaaatagagaatcgccatgtccaactgaggaacgacgacgtgcataatgaactcaaggacttctgtggattctagtgctcctgatcgagctttcttgtgcatatagagctctctactttgcatcaagtacacatgattttcacaagggttcctttgcttcaggaggaggaacaaggatgcgttcaacgagaagttgagaactgtactgatgatgttgtgatagcattcgatagaaagttgtatatatcgcataacattacaagcatttgtttacctttttattttgaaaatttacaagcatttgtttcagacgaactgttcagtatagagccagatgtaatacagaatgtggatcatacattgatggatgtatagtgcaaagaaatattgccatactgttgactgttgctaaaaatgctgacaattatatcaatgttttgaacaaaaaaaaaaaaaa

SEQ ID NO: 1569 - DNA, 712 bp, Oryza sativa
  misc_feature (3)..(3): n is a, c, g, or t
  misc_feature (7)..(7): n is a, c, g, or t
  misc_feature (15)..(15): n is a, c, g, or t
  misc_feature (27)..(27): n is a, c, g, or t
  misc_feature (40)..(40): n is a, c, g, or t
  misc_feature (42)..(42): n is a, c, g, or t
  misc_feature (87)..(87): n is a, c, g, or t
  misc_feature (91)..(91): n is a, c, g, or t
  misc_feature (124)..(124): n is a, c, g, or t
  misc_feature (132)..(132): n is a, c, g, or t
  misc_feature (210)..(210): n is a, c, g, or t
  misc_feature (276)..(276): n is a, c, g, or t
aantttncttgtcantctgatgatccngtgttgggtcccnanactcccagttccagtggatactgcagtgttccggaagaaggttgncccntaaacggggcccctacagtcccccaagatttcnggaatgantatccctggataatgatgcggttaatgctgtacctgtgctactaacaactgcggttacagcttatgcgtgcattcgcntcttttgaagatctttttactcaagtttcttccaaccacccaattccattcaaaggtgtcaaggcntggccccaagacaatgaaatgatggattaggcattttggctgcttgatgagaaagattcaattcactcaacgttgttcactactccaagaaaaacattgtttggttggttggtgctaccgcaagctgaaaagtgtcagttgtctaagcatatacagttaccctacttaatgtgaaagtgataagctggatagtcctgactcctgaaccctattttctgctgagctaaggattgtggactttcgtcgtgtggatgatggctgttgttatttctgtactgacctaaggatttgttgacttagctgtgtgagtttttccatacaaagctgtttgggacaaaggaaagctgctgctgatttcctttggaaatggtgcaaatcctccattttaatgagaaataaagcatccagtgtctatgtgtcaaaaaaaaaaaaaaaa

SEQ ID NO: 1570 - DNA, 322 bp, Oryza sativa
  misc_feature (123)..(123): n is a, c, g, or t
  misc_feature (139)..(139): n is a, c, g, or t
  misc_feature (260)..(260): n is a, c, g, or t
gtgctaaggaggggaatcctcgctttgtccagaggatacaccaggaatgtatgggaatgatccctggccctgtctggggaaaatcacaatgatggtggtgaaattaaaatgggatttcgccgncttacgatatcaccgnatataggaggaatggtgaccacaatgtaccacgacggtggataatgatgtgcccccccctcgtgtgttgtgttgtggtgtggtgccctggtgacccaaagggagtgtggtgaatgcacccntgtttgcgaaaggagacgggttaactgagtctttacggggtgaaaaaaaaaaaaaaaaaaaa

SEQ ID NO: 1571 - DNA, 791 bp, Oryza sativa
ctcatatgaaaaccaccttcgtgaaagcgtagcggcaatggccaggcagtatgtccggaccgtggtggcatcagtgcagagagtggccatggcaatagctccttcacgtcttggtggacagattgaaacaaagaaccctccaggatctcctgaggcccatacgcttgcaaggtggattgggaggagctaccgattccacactggagcggatctccttcgcacagactcacaaagcacggattcttccttgaaagcaatgtggcaacactctgattcaatcatgtgctgctccctgaaggctgctcctgtgttcaccttcgccaaccaagctggcctcgacatgctggagacgacgctgattgctctccaggacatctcgctcgagaagatccttgatgatgatggccggaaggcactatgtacagagttccccaagatcatgcagcagggtttcgcctacctcccgggcggcgtgtgcgtgtcgagcatggggcggccggtgtcgtacgagcaggcggtggcgtggaaggtcctgagcgacgacgacacgccgcactgcctcgccttcatgttcgtcaactggtcattcgtctgagaaccaccctagtagaatcgatcccccctcttgtttgtctgtcctaaagaccttatgtagtattgcttttgtgtatcatcaccatgaacatgtcaagaacctccccagtttctatcatcatgaacttccgtttgaatctagtactgctaaatgatctaaaaaaaaaaaaaaaaactccaagggggggccccggacc

SEQ ID NO: 1572 - DNA, 455 bp, Oryza sativa
  misc_feature (173)..(173): n is a, c, g, or t
  misc_feature (206)..(206): n is a, c, g, or t
  misc_feature (211)..(211): n is a, c, g, or t
  misc_feature (233)..(233): n is a, c, g, or t
  misc_feature (246)..(246): n is a, c, g, or t
agtcaatcgacaaattttaggcacttgtctattcgtatgtacatttgccttcttgaccttaggttgaattctctcaaggtgttggtagttgacaaattgcctcagatgagcaatgaaacaattgactgttttgctagaaaaagagagaaatccaagatgtccctatgtcagtntcaactaacaggcatgcccagatgaggtgagcncgacncaaagatgtcagtctttaactnttaacaggcagtntcaacttagaaacgctgcaggagataacgggaatgtataaatattttctctatactgctatttgcatcggatgtactgtaagccaaacaagattttttactttacagtgccccacccttatactccctccgtttttaaaacgaacgacgatgttgatttttggatataatgtttggtttcatcaaaaaaaaaaaaaaaaaaaaaaaaaa

SEQ ID NO: 1573 - DNA, 449 bp, Oryza sativa
  misc_feature (52)..(52): n is a, c, g, or t
  misc_feature (371)..(371): n is a, c, g, or t
gctcgaaacaactctggtggcgctccaagacatgacgctggagaaagttttngacgatcaagggaggaagaacctgtgcacagagctccccaacatcatggagcaggggatggcgtgcatggagggaggggtgtgcgtgtcgagcgttgggagggcggcgtcgtacgagaaggcggtggcgtggaaggtggtcgacggcgacggcggcggcgcccactgcatctgcttcatgttcatcaactggaccttcctttgatttcatttcattatacaccccaatgcaaaacggatatataatattacaactagtgcaatttacgtacgtaatctcatgaaacagcgtgtacaaatgttttggattttgagaaccncggtgctagtttttgtacggatcgatagtggatacattctctgttcggagtagggataaaaaaaaaaaaaaaaaaaaa

SEQ ID NO: 1574 - DNA, 978 bp, Oryza sativa
gcggcgtcggaccggccgcctgcgcaggactgccgtggcgaagggggaaactttggtggtggtggtggccggagtggaggatggcggcagcggtggcgatgccgatgcggagcggcagcggcagtgacggcggcgggtacgacaaggccgggatggactccggcaagtacgtgcactacacgccgggtcaggtggaggcgctggagcgggtgtacgccgagtgccccaagccccagattctctcgccgccagcagttactctgcgagttatccatcctcgccaacatcgagcccaatcattatatcaaggtatggttcccaacacataatgtgagcacgaacatgctaggatatgcccatcaactgcttttggcttggagcaccatcttctcgggtagttcttcgtagcataaacgctcttctacgaaacagtaatagttagtttgtatttacggtattatcatcgaactatatgttctctgtagaacattgatatattttcccccgacattattccgttttgcgtctgtccttttacttgttcattcgctttctctcatgcctcttacgatttgtattgtttaattaaccgttctttggaaattatggaaagtcaatctatttacggttaattactctgtcccctccttccatctgacaaactcctttctggtcgctattttatttctctactatgttctcttctctctcatgttcccgtgtctacaacgatatccctggagctaaaccgacccaacaccttctcttccctgtcaacacccatcctgcagcaatattatataatgctcgacttacaagagttcatacgacatagtttagtacgcgtccattcctaaactagtttattagccgtactatcaccgttctctcaactttctctctacacttgtttacgaatctactttctagtcaatgtcattgttatttttcgtctttgtactgtgtagtggttaacac

SEQ ID NO: 1575 - DNA, 1406 bp, Oryza sativa
catttcggggggggtagtttataagggcttgcgcgaggagggggaggagtagcgggtagcggcgggctcgagtcgagtcgagtcgccgtcgtcgtcgggcggcggcggccgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccagcctacagaaaaccatcgaccgctataaagcatacacaaaggatcatgtcaacaataagacaattcaacaagatatccagcaagtcaaagatgatactttaggtttggccaagaaacttgaagctcttgatgagtccagacggaaaatattgggagaaaatttagaaggatgctctattgaagaactgcgtggtctagaaatgaaacttgagaagagcctccacaacataagactaaagaagaccgagcttctggagcggcagatagccaagctgaaagagaaggagcggactttgcttaaagacaacgaaaatttacgcggaaagcatcgcaaccttgaggctgcggcgctggtggctaaccacatgacgacgacgacggcgccggcggcgtggccgcgggacgtgcctatgacgagcagcacagccggcgccgccgacgccatggacgtggagactgatctgtacattggattgcccggcactgagcgctcctccaaccggtcggagacaggttgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaacggaaacaaagaattaacaaagctgtagcagaccagatcggcaaattgaaatgccaggtaatccagtatatatttcgctaaagttattcatgttggtgtgatgggcctgtgagtgtgggtgcttgggaggagatttcttgggttttttccccgagcaaaatcaatctgctcgtgcccttgagatttcagttccgcccataagaactccgacgcacatttagcattcggagagtaattttgttaggttaaaagtatggtaagttataggtggtatgttatgtttttctttttcttttctcaatgttatctggtacctaagtttgtcaagaaaatcatagtggacaagtc

SEQ ID NO: 1576 - DNA, 232 bp, Oryza sativa
  misc_feature (63)..(63): n is a, c, g, or t
tagacaacatagagacgtagacagataacctaacatagtagacccacataggacccctgtacnaacttaccaactactacttacttgtggttgttgttagatcaaacgttggttaacatgtactactagtaataaggtgttagcatactatcatgtgcaaacactaggaaataagaaccattggaataaagtatcaatcaatttcagccttggcaaaaaaaaaaaaaaaaaa

SEQ ID NO: 1577 - DNA, 639 bp, Oryza sativa
gccgccaccgcctccgcatctccagcgcccccaaaccctagctctctcctcctccgccgccgcgccgatcgatcaggagtagcaatggccaggttctccgcagccgccgtgatcgccttcgccgtggtggccgcggccgcgctggccaccgtggcgtccgccgccgacgcgccggcacccgccccgacctccggcgcggtggcggccgtctcgggcgcctctctccgtgtgctgcgttggcggcctcctcctcgccttgctccgccactgaagcgttcttcttcctctgaatgcttttgcttcagatctagcagtacagtggtcgtgcgagtcttacttagcatttagtattagagcttagtagcgatgatgacgtgtgcgtgtggaggcattgttttttggttggatctatggggttttacgggttggtttggagtgaggaggatttgagatggggattattagtatctgttagactgttactactactggtttatttattttggtagtcttttggtgtgatgggtttgggatctgtgtatttaccacttgagtacactgttctgagagatcgttattgatattattatgattattattattacgtaaaaaaaaaaaaaagaaaaaaaaaaaaaaaaa

SEQ ID NO: 1578 - DNA, 489 bp, Oryza sativa
  misc_feature (477)..(477): n is a, c, g, or t
ctagttctagatcgcgggcggccgcaactatggtggcggcagcggcggcattggaggatatggcaactatggtggtggctataatggggaacctggagggggtggtggcggacggcagaaggtggtggatatggcggggattatggcggcggcgatgtcggtgcaaactggagcaagcgcgggagcttccgcggcggcggcggcaagacacagcagaaggacggtggcggtaacaactgaagccgcccgtcctcgtcttcctcctctggccatgagacgaaccatgagcttcataactagagcaatgtataggaatctcctaagatatatatagtgtcatgtcatccatgctacgttatcaactggggaacgctgatgtacgagcttcaatttgagcatagcgtaccgtacgtgctgtgttcttcaggctttgtaactggttagtaccttctactacgatggttcatgccccaaaanaaaaaaaaaaaa

SEQ ID NO: 1579 - DNA, 618 bp, Oryza sativa
tacggcggtgaccgcggctacggcggcggtggcggcggctacggcgggggcgaccgcggctacggaggcggcggcgggtacggcggcggcggcggcggaggcagccgcgcgtgctacaagtgcggcgaggagggccacatggccagggactgctcccagggaggaggcggcggtggtggctacggtggtggtggcggcggctaccgcggcggtggtggtggcggcggcggcggcgggtgctacaactgcggcgagaccggccacatcgctcgcgagtgccccagcaagacctactaggcgctgctcgcggcgtcagatccagctccctcccatgatgcgttttgctccccctccctcactgaatcaccgagcagcgggtgatcagttctatcttattagtagtcgtagatctcgttaggaaagctatggatctatcggttcgtcgtcgtcgtcgttctatgtaatgggatgggagtcttggagtggtttaatctttttgtttcgttgggtcggtttgagagacaagccatggatttgcactgtctgatctatctatgaatctatctattatgaaccgagaaagaaaatattcatcagcatttggatgagttaaaaaaa

SEQ ID NO: 1580 - DNA, 695 bp, Oryza sativa
  misc_feature (355)..(355): n is a, c, g, or t
ggtgcctttctggttccgaaggctgtggctccaagccccaactgatatcaatatttctggaatccccagatttgcaagatatagtagctgaagaaaatgttgatattcctggagggggctttgaaatgcctggtcctgagggtgtattctctttgcctgaagaaggtgatgatagtgttcccattgagactgatgagattttgtacaacgatgacacccagaaacttcctgctatcattgattctttctgggaacagttcctggtggctagccctctatctgttgataatgatgaagtcgattcaggtgtactagaccaaaaggaaacacaacaggggaatggatggaccaaagntgaaaacatggctaaccttacagaacagatgggcctcctgtcatcacaccatacaggatgatgaggtacaataggacatacttagccaccatttgtcaaggtaccctgggatctcggtaataaactcccacatcatcacctacccttatgtctatgttatgttctatcattttgctgaaacaatactgaaacgtcaccctatatgtgggaggatactaatcttccacctatgaaacacggtttacccgaggggtttacctgcttgtatctaggtttggcaggcgtaagaattgatcaatggtaacttgtcaaatctgtatgataaaaaaaaaaaaaaaaa

SEQ ID NO: 1581 - DNA, 1095 bp, Oryza sativa
cgaggaggagagggaggggagagaagggagagggggtcggggagaaagaagagcgagcgagcagctttggctacggccaaaccctacagcgcctccaccaccactccttgccttttttggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccagtacgcagaaaacaattgaacgctataggacgtatacaaaggaaaatatcggcaacaagacagtacagcaagatatagagcaagtaaaagctgacgctgatggtttggcaaagaaacttgaagctcttgaaacttacaaaagaaaactgctgggtgaaaagttggatgaatgttctattgaagaactgcatagcctggaggtcaagctggagagaagcctcattagcatcaggggaaggaagacaaagctgcttgaggagcaggttgccaaactgagagagaaggagatgaagctgcgcaaggacaatgaagagttacgcgaaaagtgtaagaatcagcctcccttgtctgctcctttgactgtccgggccgaagatgagaacccggaccgtaacatcaacaccaccaacgacaacatggatgtcgaaactgagctattcatagggctgcctggcagaagtcgctccagcggcggtgctgcagaagatagccaagcgatgccccattcttaagtaacaggccaggaataagctggatctctgcgttgagaaaggagatgatgctaggcatgcaatgacaccaaaccatcctaaaaacagaccacgctgtatattttacttacccgtattgtcgtccatggatgcgaaatgctagacgcatatgcacccacccattcagcaccaccaggcagaaacccttcgatcggcagactccactacccatctaaatctaaatcgagagatctcaagtg

SEQ ID NO: 1582 - DNA, 1640 bp, Oryza sativa
gttgccgcacatatactcgtgctcgcgctcacgccgccgcccccgaaactccccgctccgccattgccgggggaggcgatctcccatctccatctcccatctcgcctcagcgaactccccttcacatcgcgtctcttccgtcgcagagagtggcggccggtgaccatttccggtgggagggcggaggttttgtcccggctccggcgacactccacactccgacagcccaccgctccgtcaccctgcatttttggtcaggatgcacgagagcgacagcagtcctgattctgacaggacacactggtatatgagcaatagcgatgacgagtcatttgttgataaagataaagattgcagaaggagcaccgtagccctgctgttgaagaaaggtccatggacatcttgggaggactccatcttagagaagtacatcaagaagcatggtgaaaggaactggaagcttgtgcagaagaacactggcctcttgaggtgtggcaagagttgccgtcttcggtggatgaaccatctgaggcctaacctaaagaagggggctttcagcaaggaagaagagaataaaattattaatcttcatcgcaaaatggggaataagtggtctcggatggctgctgatttgccagggcgtactgataatgaaataaagaactactggaacactcgaataaagaaatgcaagaacaatcgttcgcctttgtatcctgctaatgtatgcaacgatgctttgaatgaagatcaacatgagtctgctgaccccaacgttagggagaagctgaccaataatcatctagaagatactactagtatgtattctgcacccccaggttttcaggatgcttccatcagtaatatacttgataggagacttgcatcaaaagattatgactccatagaagatcaaagaaaccaaatagaagttgtagcaaaatatgagattccacttcctgtgttgaaaacaacgaacaatgacatatttccatcagcctctatctttgccaaccatggtatttcaaatggcaatctctctgctttgtccacaactgatgctttgcagatggagctccctttaatccaatttgatccaaacaaccagttcgtttactcaagggcttatgcgatgcacctaacaaactttgctttattaaatgatcaatcagaagaattactaaatgatactgatgtattgaactatgtggtgatgaaagaagagctttctggagggagtttgagtcctactattaatatgccatgtgaagcacataactccatggctgcctctaatgagctggtagtgccacaatatgaaggagatgctccacctcttcaagatgatttcacatcatatttctatttgaatgatactaatctatccatattcgaagacacaaatgaattgtttttggaaaacaagttggatactaaaggtaactgacgccagattgtcatgagttgctgctctcttggataaactcatcatgaaaccaagaattttattccatgaagctcgtgaacgagccagtcgttgctatctctcttattaggatttccagtttggatattgccgtactcctttacttttcttcatgtcgaaattaccatgcgtgctatgttgaatttcatctgct

SEQ ID NO: 1583 - DNA, 2373 bp, Oryza sativa
ggaaaaatggggtgcccatgcggccctgcccaatagcgttgctgtacctttcagctttataatctcgcccctcgcgagagagactccccccatcctgcagactcgccccactctcttgctcagctcctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccagttgagacgccatgtatcgggtgaagagcgagagcgactgcgagatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatgtcagaattcaaatgaattctgtatttggtatttgccagacgctaaagcagattcttggtatcgttcttgctcattgtttggatcataacttgaggaagatctcgtcggttgtaattctgcattgctgacagagtccttgatggcatgcaggcactatcagatgttctcttatgcgactagcccttttgtccaataaagtagtgcatggagataagccggttaattattgttttcttttttgtattagagaaccctttttgtcatctctattgccggaattctgttggaaattcgtcatgtttgtttgaacaaaaaaaaaaaaaaaaaaaaa

SEQ ID NO: 1584 - DNA, 2388 bp, Oryza sativa
gagaagaagtgcctcaactcggagctatggcacgcctgcgccggcccgctcgtctgcctccccaccgtcggcacgcgcgtcgtctacttcccgcaaggccacagcgagcaggtggcggcgtcgacgaacaaggaggtggagggtcacatcccgaactaccccaacctgccggcgcagctgatctgccagctccacgatgtcacaatgcatgcggatgtggagactgacgaggtgtacgcgcagatgacgctccagccactgaacccacaggagcagaacgatgcgtaccttcccgcggagatggggataatgagcaagcagccgacgaattacttctgcaagacattgacggcgagcgacaccagcacgcacggggggttctccgtgccccgccgtgctgctgagcgcgtcttccctcctttggatttcacacagcagcctccagcccaggagctaattgcacgggatattcatgacatcgagtggaagttcaggcacatctttcgaggccaacccaaacgacacctgctaaccactggctggagcgtttttgtcagtgctaagagacttgttgctggagattctgtgcttttcatatggaacgagaaaaaccagcttttacttggaataagacgtgccagtcggccacagactgtgatgccttcctctgttctttcaagcgatagcatgcacataggtctccttgcagcagcagctcatgctgctgctacaaacagccgtttcactattttctacaacccccgggcaagtccatcagaatttgtcataccactgtcaaaatacatcaaggctgtttttcacacccggatatcggttgggatgcggttcaggatgttgtttgagactgaggaatcaagcgttcgcaggtatatggggactataactgaagttagtgatgcagacccagtccgttggcctagttcctattggagatctgtgaaggttggttgggatgaatcaactgcaggggaaagaccaccaagagtttctttatgggaaattgaaccattgacaacctttccaatgtatccatctctgttcccactgagagttaagcatccttggtattcaggagttgcttccctgcatgatgacagcaatgctttaatgtggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaattcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtcctttgtgaatagtgtatggtacatcaagatactttcacctgaggatgtgcataagatgggaaagcaaggaaatgatccacggtatctgtcctga

SEQ ID NO: 1585 - DNA, 2643 bp, Oryza sativa
ggggaacaaagatgtctgaactcggagctgtggcatgcatgcgctgggccccttgtgtctttgccagtggtcaggagcagggtcgtctactttccacagggccatagcgagcaggttgcggcatcaactaataaggaagttgatgctcaaatcccaaattatccaaacttacctcctcagttaatctgccagcttcataatgtcaccatgcatgctgatgcagagacagatgaagtttatgctcagatgacattgcaaccattgagcccggaagagcaaaaggagcctttccttccaatggagttgggtgctgctagcaagcaacccactaattacttctgcaagacattgactgcaagtgacacgagcactcatggtggtttctctgttccccgccgggcagctgagaaagtcttccctccactagatttttcacagcagcctccggcacaggagctgattgcaagagatttgcatgataatgaatggaaatttcgccatatatttcgtggtcagcctaaaaggcatctcctgacaacaggctggagtgtgtttgtgagtgcgaaaagactagtagcaggagactctgttatatttatctggaatgataacaatcaacttcttttgggaatacgtcgtgcaaatcgccaacagactgttatgccctcttccgtgttgtcaagcgatagcatgcatataggtcttcttgcagcagcagctcatgctgcagccacaaatagtcgcttcactattttctataaccccagggctagcccttctgaatttgtgattccattggccaagtatgtgaaagctgtttaccacacacgtgtatctgttggaatgcgttttagaatgcttttcgagacagaggagtcaagtgtcaggcgatacatgggtacaatcaccagcataagtgatctagattcagtgcgctggccaaactcacactggcgttctgttaaggttggttgggatgagtccaccactggtgataaacagccaagggtttctctttgggagattgagcctttgacaacctttccgatgtaccccagtgcttttcctttaagacttaagcgtccgtgggcttcaggactgcctatgcatggcatgttcaatggtgggggaaatgacgattttgcacgctattcttctctcatgtggcttcgagacggaaatagaggaacccagtccctgaattttcaaggacatggagtctcaccatggcttcagccaagaatagattctccattgctgggccttaagccagacacgtaccagcaaatggctgcagcagcactggaagaaattcgatatggggacccttcaaagcagcatccagctactctgcaataccaacagactcataatctgaacagtggattaaattctctgtttgcaagccatgttctagggcaggtgcagtttcaacctcagcagtcacccctgcaagttgttcagcaaggccattgtcagaacactggtgactctgggttccttcaaggtcagcttccacggctgcagttgcataacactcagcagctgctaaaggagcaagagttgcagcagcagcaaagacagcatgttttacaagagcaatctagtcaagagatgcaacagcagctcccatctagtgatcatcatgttgctgatgtagcttctgagtctggatctgctcctcaggcacaatcatcattgcttagtggatcatcattctacaatcagaacctcttagaaggaaatagtgatccccctttacatctacacaacaatttccacaacttctctaaccaggaagcctcaaaccttcttattttgcctcgaagtagccaattaatggcatcagatgggtggccttcaaagcgattaactttagaatctgctgttcatcctgaagctccgtccatgcaccccaagattgagaaagtaaatcaccagggtatatctcattttcctggcgcctttccaccacaatcagcaagaggctgttccatcgtccaggattgcagggcagatgctgagaaccgcctactttcatcatcatttgaactccaggatggcatgacaagcatcataactgatgctaacagagaaactgatactatggccatacctttgttgagatatagtggtgcagatttgacaactgaaaacaccttagcaacctccaattgtttaggtgaatctggaacgttcaatcctcttaataacatatctgtaaatccatcacaaggagcaacctttgtgaaggtttacaaatcagggtcccttgggagatcacttgacatctccagattcagcagctactgcgagttacgtagtgagcttgagcgtctctttggtcttgaaggccaactggaggaccctgtaagatcaggctggcagcttgtatttgtcgaccgggaaaatgacattcttctcgtcggcgacgatccatggcaggagtttgcaaatagcgtatggtgcatcaaaatactctcgccacaggaggtgcagcagttggttcgtggtggagacggccttctgtcctcacctggagcaaggatgcagcagagcaatgcctgcgacgactattctgcaagccacaacatgcagaatatcgccggaaacattgcatctgtagcgcctctggactactga

SEQ ID NO: 1586 - DNA, 2868 bp, Oryza sativa
atggcgtcctcgcaggagaaggccaagacgggtgttctgagaaatgccgcagcgctgctcgacgaaatgcagctcatgggagaaacacagggtgccaagaaggtgatcaactcggagctctggcacgcttgtgccgggccgcttgtgtgcttgccgcagcgggggagcctcgtgtactacttccctcaggggcacagtgaacaggttgcagcgacaactagaaagattccaaattcccgcattccgaactacccaaacctgccatctcagttgctgtgtcaagttcacaacatcaccttgcatgccgacaaggacactgatgaagtttatgcacagatgacccttcagccagtaaactctgaaacggatgtattccctattccaactcttggtgcttataccaaaagcaagcaccccactgaatatttctgcaagaatttaaccgcaagtgatacgagtacacatggtggtttctcggtgccacgaagggctgcagagaagttgttcccacaactggattactcaatgcaacctcctaaccaggagcttattgttcgagatttgcatgataacatgtggacattccgtcacatttatcgtggacagccaaaacgacatcttctaacaactggatggagtctctttgttggggcaaagcgtctaaaagcaggggactctgtcttatttataagggatgagaagtcacaacttcttttgggtgttaggcgagccacgcgacaacaaacaatgttgtcatcttctgttctatctactgatagcatgcacattggcgttcttgctgctgcagctcatgccgcatcaagtggtagttcatttactatctactacaatcctaggacaagtccttcgccatttgtaattcctgtagcaaggtacaacaaggcaacatatatgcaaccatcagttggaatgagatttgcgatgatgtttgagacagaggagtcaagcaagcgcagatacacaggtacagttgtgggaataagtgactacgaccccatgagatggcccaattctaaatggcgcaacttacaggtcgaatgggatgaacatgggtatggagaaagacctgagcgtgtgagcatatgggatattgaaactccagaaaacactcttgtgttcccttcgtcgaccttgaattcaaagcggcaatgtcttcctggttatggagtttcagtgcctgggatggaaattggatcagcaaatatgtcatcatttccaagggctcagggtaatccctatggcagtttgcagcacattccagctgttggatcagaattggctatcatgcttctcaaccaatctggtcaaacccttgggagtccccttagttttcaccagtcctcatattctagtattatccaaaatgtgaagcaaaattatatccctcctctaacagttagcacttcagcttgtttgacaaagcaagaaagcctgccttcagatgatgcccagcaccagttccatatggcaaatatgcagaatggtgatcttgaaggctctgaagtccagcctgtcattgattcgatttctgagtcaaagttgaatgctacatcaagagatccaagaaacacagattcatacacaagtcgaagtacttcggagcaaaacagtaagggtgagcctagaggcaagactcgtaggagtaagaagggcttgcctcacaaaaccgtttcagagaaatctgacctttcttcagccccttcttggatctgtgacaatcagcaggttggtttagaatcgaaactggttggttgtgatgaacaagtaaactgtggaaatattgaagattcatcaggtgcacttactcaaggtaattttgttggacagccgcatggccatcaggttgaacaaaagggagtgctgtcgccaccaaaggtagaatcatcaaaatcacctgatggaggaaagtctgtcaattcgtttccaaaccaagggtgtttttcgcagttcattgatggtcttgattggatgactcagccttcctactaccaagactccaatgtaattcaaccagccggtgtgtcagagaacattttcagttcttctgcagatatacctccctcaatgattgctgatactatggagacttttcaggcttcatgtctttctgattgccttcctaattccatacaagaattcatctccagcccagatctgaattcactaacctttctttcacctgacatgcaaaatttggaggtccaactccagcatgatggaagcaatttgccaagcacgtccaactcgtttgtacagatgagtttttctgaagagagtgcaagtcagagtgcaaacttaagtggacttcacatggaatctacacacagaagcataaacaccacttcatgctctcaaccaatgtctactgggggctttgatgcagggatgtactcaaagttgccacgtttaaaagaatcccaaatcttgtctttgccagagattcataccaattccatgggaacatcagcttgcagtatggatgcaaccgagtacagccttgaccgaagtgcgaagccgatgaaaccaccagtgcggacatatacaaaggttcaaaagcaaggatcagttggaagatctatcgatgttacagggtttagaaattaccatgagttgagatctgccatcgcttgcatgtttggtctccaggggaaattggagcatcctggcagttcagagtggaagcttgtatatgtcgactacgaaaatgatgttcttcttgtcggagatgatccatgggaggaattcatcaactgtgtccggtgcatccggattttgtcaccttcagaagtacaacagatgagcgagaatggcatgcatgttttgaacgactgtattcaagcagcttag

SEQ ID NO: 1587 - DNA, 441 bp, Oryza sativa
  misc_feature (280)..(281): n is a, c, g, or t
cgccgagtcccgtgacatcgcccttcaacgtctgtgagtcgccccggctcaggctccggctccggctccggctccaggctccaactctacctccgcgatccgaggacccggcgtgcgccacggtgcacgacgtcggaccactggtacgcggcggagggctgtccagctgagcgacaagcagctgcggcagatgaagcggtgcagctgggctacaccatctacgactactgcgccgacgcccaggcacaagggacgccccgtgccgccggagtgcagcatnncccagtactgatcatgcatgcgcatgtctagtttcacttgatttttcatggcatgtttgattaatggcttcttggaagaagtaaatctctgttgttttattttggattatatattatatatgaacatgattatttgatttaaaaaaaaaaaaaaaaaaaa

SEQ ID NO: 1588 - DNA, 342 bp, Oryza sativa
  misc_feature (316)..(316): n is a, c, g, or t
  misc_feature (318)..(318): n is a, c, g, or t
gagatgttcaacaggaccagtcaaaacatcaggacgaatcagacaaacagcatgttgaaaggcgtcaatctgcgagacaccacgacgacgatgacgacgacgatgacgaagattatgaggttgaggaggaggaagtggtgtctacaagcgattgatctgcctcgccgcgtagaattttggccatgtaatatataaacctgcgtctaatgatgtttccctgtcctggtcttttggagagatgctgaaatgcactgccagcagtggtatttcccgctgctacgctgactccgatcgatagtgccactcatctcttggntnttgacccgaaaaaaaaaaaaaaaa

SEQ ID NO: 1589 - DNA, 444 bp, Oryza sativa
  misc_feature (21)..(21): n is a, c, g, or t
  misc_feature (423)..(423): n is a, c, g, or t
tgagcctatcgaaggccaggnctacaaatccgatgacgagaatgcttatgaagatgatgatgaagagtatgatgacgatgatgattttgctcggaaagtaggggttgttttctcttgagctctgtgggccttctcctggttttgttgcatgcagcaaagctgaaaatgcttgccttagtgaatctatttggataaattcctctggtgctttgtgttttgttcttgaagttcatagtgccaaagcctttatttataaggctgataactgataagtataggtcaggtatgaagcgggggtaggattcataaattaaaagggctttacgtgtaaaaactgctgcactcgttgtgttcagcatatatctgatctatcctgaaactattgtattgtattagtttcctaactaacagacaagatatttntttgaaaaaaaaaaaaaaaaa

SEQ ID NO: 1590 - DNA, 335 bp, Oryza sativa
agaggagccggcattagaagatttcaggatttctgaggatgatgaggatgaggatgaggatgaaggggaagatgaagaagtggagcacttttggcttataaggtgactgaacgtagcgtttacttgacggtgtttaggagaacctagtcatgcctggtgtttctttcccggtgattaaaacggaaatgaaattgtcaatatcatatcagtaggggtgctgattgctagtctgtaaatcgactcttctctgggtcaatctcgtatgctcatgtcggcaatgtatgccacgattctataaacttgatattgaacttcaaaaaaaaaaaaaaaaaaaa

SEQ ID NO: 1591 - DNA, 691 bp, Oryza sativa
taaagagaatgcctccaagaatgaacatgatgaacccccacttggtttatccaacacctgcaaggaaccatgaatacgccgataaagggcccagagaaccttacaaaaccaggagaaccagcttcatctgttgatgtccttacgtgaacggaatagtggataattcagattctgtccaagaggaaccttcggtggaggctacagtgtctgcaactgaaacatctaatgtagatggacctgaggacaacaatgactctgacgaggaagatgaagaggaagaggaagagaaaacatcttcagcgaagaagctgtggcgttgcctcataacttgatggagattagtttcacctctgatagataatacagagctaactgtaggctgacagtttacctctcttataaagataatcactttagctgtattgctttcggcattgcccccctctcggattgaaaggggaagcctttgtgtctattgtgtgtgcatgtggtattgtgagcagcgcagttttggaagccgctgctgagctgaatcctccactgtgttttccatcttcttgcctctgttgcttcttcgacttgtaaagtggttgtgtacaaatgatgggggcgccctggtaacctcttgctgttgtgctaagtggaaacaagttaacgtagatggtttgatattcaaaaaaaaaaaaaaaaa

SEQ ID NO: 1592 - DNA, 1223 bp, Oryza sativa
gcctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtaggagggagcagcatctccgactacctcaccaccatctgccccggctggcgcgtcgaggacctcctccccgacgacgacgccttcgccgccgccgccgcgcaggcggggaaagagaaggacgagcgcgtgccgttcctcgacgccgacctgttcgacgtggtcgccggccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgt

SEQ ID NO: 1593 - DNA, 398 bp, Oryza sativa
  misc_feature (32)..(32): n is a, c, g, or t
  misc_feature (48)..(48): n is a, c, g, or t
  misc_feature (116)..(116): n is a, c, g, or t
  misc_feature (158)..(158): n is a, c, g, or t
gaaagcaaaaattgaagctgaaatgaagaggntggaggcaaagatagngatcaagagagctcgcgagcaggacaggctttcgagcaagttggcagctgcaaggcacaaggcagagncgaggagggaggccgctgagtccaggaagaaccaagaagcancaagaactgaagagcaggcggctcagatccggaaaaccgggcacataccttcctcaatctcctgctggtgctggtgcctgtgattcttcactctgccatgatcatctgttatttgggtagaagaaaaatacttgctccttgcacgaccatgtaaaatattcgctactggttggttcatcgttcagtgatcaatgccaatgagtcgccatttttgtccaaaaaaaaaaaaaaaaaaaaaaa

SEQ ID NO: 1594 - DNA, 436 bp, Oryza sativa
tttgttcggaaaagagtcatacatcatccacgtttacagaatcagacggtgacagcacagaggttcaatcagcgagaacttcttgcaaaggcgtgtcgcgttcaaggataaataaaatgagagaaccggaagactcagaagacagtgctccaataagacgtgtgtctcgcagaagaccagttaggtgatgccgaactgtaatatggaccaagtggcaacaactcctctctgggaagatctcgcctagagatcttggagttctgaagcaaatggtctccctggcgcttgtcccaccagaaactctatctaacgccgatatatttgttgaatcataatgtttataagcctgcgttgacctgctaaatcttggtcagctccacacggaacggtttgctggatgctgatatttcatctaaaaaaaaaaaaaaaaaaaaaa

SEQ ID NO: 1595 - DNA, 652 bp, Oryza sativa
tcgcattttttttttttttttttggtgccaattagtttcgaatattgacgataattctggctataattattttatttactgatgctttaaatagattagttgttgttttggagaacaattttctcaggttctttaaccatgatattctttttttccttatacctcgctttccgaataatttgccttgaaggattattttcagtaatctgtatttagggccgtttctcaccatgtatccggcatgttctaagtcattagacatctctgtggcggtggtgtggcctatgcgtgaccgcccgtgcgcccctccgcccggtttggttcggcttgagagtgcgttggctatcgccgcggtgcgaagacggcgtgcctcggcgcgccgcgctctcgtgggtgtggttggtggcggccgtgccggcccgtgcaggagtcgcgccgcgctcgagagagggcggcggcagcgtgcgtcccggtgactgctcgcgctctaccgcggtcggtcagcgcccccccgcggccgcccggacaggcggtcgggcgagggcgagggccgcgcgggtcggccggcaactggagacactaccgccggcgggggtagatggaggtgcagaggctgggtcggaatgcgcgccccgttcccgttgcgtggggt

SEQ ID NO: 1596 - DNA, 287 bp, Oryza sativa
  misc_feature (67)..(67): n is a, c, g, or t
  misc_feature (118)..(118): n is a, c, g, or t
  misc_feature (152)..(152): n is a, c, g, or t
  misc_feature (178)..(178): n is a, c, g, or t
  misc_feature (201)..(201): n is a, c, g, or t
  misc_feature (263)..(263): n is a, c, g, or t
tttttttttttcttcggtggtgttgggagtggacaaggtagtgtgagtaagtagtgagcaccatggngagccgagagcacctcctgctcgacccggcggcgctggccgtctcttgggntgaccccgctgcggtggagatcccgcccgagctnctcgccgcgctgggtgagtacctgtncgccaggcgtaggacggggaggncgaggacgacgccgaggcggaggctgatgatgagttcatgatgtacgagttcaaggtgcggnggtgcgcgcgggcgggagccacga

SEQ ID NO: 1597 - DNA, 335 bp, Oryza sativa
  misc_feature (10)..(10): n is a, c, g, or t
  misc_feature (50)..(50): n is a, c, g, or t
  misc_feature (63)..(63): n is a, c, g, or t
  misc_feature (219)..(219): n is a, c, g, or t
ctcgggtggntctgcgcaggctgctgtacaggagcaagcagcggggtttnttggagctggccncatacaagcagcgaggacgacggcaagccagacctcggcgtcaccagcaccggcggtggctgattactgctgctgcttcaccatgtcctctcttgcagtagcctgtctaggtctgttcttttttcctatcatctcttcttttttaaaaaaaaatgnaaagggcaaagacttgtaatttgtaacctgtaatgtagtagtaccaaccatcgagggctggactggaacaatcttaataaaataacatcaattagcacgaaaaaaaaaaaaaaaaa

SEQ ID NO: 1598 - DNA, 411 bp, Oryza sativa
agaagccccccgaggccttacctccttccgggcttctttcgaagaacaccaaccttctgccccatccacccaagccgtgtcaccatcatgccccaagacatccagctcgcccccccgcatcccgcggagcgcgcgtaacccccccttcgacgcggttgcgttgcgtagccccgaacgatctggggggatcaacgacgacgacgtgacgtggtcaactttgattcccctctcgcttccgcttttagatctcgttttcattaccagcttttaataggtttgtcgttaaattaagtgtaaaaacaggttcggttaaagactcaaatcaatgttatcccttctttggattttccgttaaccaaacagtgttaaagactataatattcgtttactatatggaaaaaaaaaaaaaaa

SEQ ID NO: 1599 - DNA, 561 bp, Oryza sativa
  misc_feature (148)..(148): n is a, c, g, or t
tctgacgcgtcgtcgagccgtcttcgtcgcgttgtgcggccaagggccagtacgtgtgggcttctttcggggaacccggatcttctggtgtaccatggagttgctgctgacgtcgggcccgttcgtccggcagctcggtcacctgtcntcgggaggtgacgacatcgcggcgccggtgagggagtctgttcggtggtcgcggcacgggggagttcaggatggcgtccggctacgtcctctggaagacggtcagcctcgaccaccccaacgccatcctcgagctcgacgtctacgtcaacccctgagatcgccgccgccgccgccggccaccgtgtgcttgcttccggcgtacgtggtggtggcatgacgtggcgtgtgccagcacacgacacatgtcgcagctgccacggatgctacactaccttacactatactactatactatactagtactgccacccagccagtgacgaataatatggacaagtccattccatgtgttgttagttgttaccgtggcgtgtaataattcatgagatttgtcaaaaaaaaaaaaaaaaa

SEQ ID NO: 1600 - DNA, 493 bp, Oryza sativa
ctgcgttcctagcagcttcctcggcatcattgttctgatctttggtaatgtgagcaacatcggggccctgaagctctgggcatctgaagggaatggaagacgagaagagctggcatggagaaaggggaaggcatgagtgcgcgttgccgattccggcgagggaagggggagggtatgatgatgattaaatgggcttgtgggaaggaaagattggaaaattgctgtggagttgtgtttgtgagagggatttgttcttctttcttgtttctttcttgttcatgtttcagtgacactgttaattccctgctttgccccccttggatgcactgatgatgatgacatagtggtagaggaagtgtgctagttgttaatgtgttattctttgcttggaagaccattgtaactgatgatatggttctttgttcatcgccaccgaaattctctctgccagtcatgcttcgtggttgcttttctgttgaaaaaaaaaaaaaaa

SEQ ID NO: 1601 - DNA, 516 bp, Oryza sativa
  misc_feature (337)..(337): n is a, c, g, or t
  misc_feature (449)..(449): n is a, c, g, or t
  misc_feature (495)..(495): n is a, c, g, or t
ttaaaagctaggctccaaaatttctcaaatcgttattacacaagacaaaataatacaccaacaattaattacctccatatatatatataaaagaaaagaaaagaagaagcaacgaattgcatatcgcacaccctgcaaaaccttgaattttaacttttgcatgctgtaattaagtagttctagaactcttaatcatctggccgtaccaaataatgcgcttaaataaaataccaaattgatcacaaccttaaacacacacctgaaaatggaacaacaaacgaagttattagaattttttttaatttgttctaacgtaccagccttattggagtagggnttattgtctcttgtaattgatcaaatcatccctggcttccagaggtgagggaagcttcttgctgagctcagtgtgagctgcccttgcgagtggtcgaggctatctacagggnactgctcggctgcagcctctttcagggggatccgcggcttccgggngtggagcggcctgtggtgagc

SEQ ID NO: 1602 - DNA, 542 bp, Oryza sativa
gacaagagggagtagttagcacggtgataaactgataacgagatagtaacaaggcatggatgaagcgttcatttaagactgtatagtactttcgccacacacaaccgtcgttcaagcaagcgtcgccatcgtcatagagcgagcgaatggtgggttcagggtcagtgccgaggcggcttgtgctgaccaatggtgtcaccgctgctgccatcatcaccgtcaccgacctcttctctcagagcgatctacagagcaagatttatacttctgctttgacgaacaagttattaggagtgtcataggccgattccaaacaggtgatgcgagagcgttttgattcgttagagtatcttcattgctctgccagaagttatacttctgctcaacaaaagagtttggcaagatttgaacggttggttgtacataacataccaattgattgacgggatgtacccagtttggagcccatataacttgtgtatttcttatttgcaattaatcccacacttaaagatggtgttgaaaaaaaaaaaaaaaaaaaa

SEQ ID NO: 1603 - DNA, 958 bp, Oryza sativa
  misc_feature (27)..(27): n is a, c, g, or t
  misc_feature (30)..(30): n is a, c, g, or t
  misc_feature (49)..(49): n is a, c, g, or t
  misc_feature (61)..(61): n is a, c, g, or t
  misc_feature (76)..(76): n is a, c, g, or t
  misc_feature (167)..(167): n is a, c, g, or t
  misc_feature (289)..(289): n is a, c, g, or t
  misc_feature (358)..(358): n is a, c, g, or t
  misc_feature (371)..(371): n is a, c, g, or t
  misc_feature (553)..(553): n is a, c, g, or t
tgatactcctgccgcgtaaccgggganacnccgtgcgcacagtacccgngggatgtacccncgagcctacctcccncgagcctcgtgcatccgctttggtccccatattttgaagccggtcggctctggttttccggccggcgttctccatcatggtttcctccaanacggggtgcgcttttctttggccatgtgtccggcttgttcttggtttttcctcccaggtgcctccacaaaggagtctcacatggaaagggcccattggtcggtctggtggctggggcaggcngcggtgcaaacaccccctgggtgcgcttggccatggaaaggccaagggccatgccccccggattgtccntgtcaagggttgncccttgtggccatagtcttggcgataccccgaggtgagctgcctgcgtggcgtgtgctgcctgtatctgtgcacctagccgtattggcctactgtgcccgcccttgcgattgttggacttgctgttccatactggttgaacctgcgctgctattgcctgtgtgaacgatgcgtgcatatgtntgtggggacaattggctatttattgggttcttgggatgaggatgaactggactggctaatgtgaggttgatgatcatgtgctggataatgggggctgatgaccggtgaccaatgctggtggtgatgatggactgcatggtgcccgatctgcaacctgattggtgtgttgactagctgccctatgagagatgaagctggatgcctgaagggatgctaacttgcccatgaactgatttattgtttgcctgatgctgccatgatgaggatgaagctgattggtgtaagggattgatggatgagaagtagttggatcagtcttataaaagacgcataactattgttttcctatctccatagagataagctgattgtaataattaatggattcctatcaaaaaaaaaaaa

SEQ ID NO: 1604 - DNA, 436 bp, Oryza sativa
  misc_feature (133)..(133): n is a, c, g, or t
  misc_feature (225)..(225): n is a, c, g, or t
  misc_feature (337)..(337): n is a, c, g, or t
  misc_feature (363)..(363): n is a, c, g, or t
  misc_feature (413)..(413): n is a, c, g, or t
cgtcttcccagatatccagctcgatgttttccgcgagatggtaaccagcttcgactgcgagtcacgtctcgctgtcgtcgccgatgcacttgtcaaaaatcgtgtgtcttgggtgaagggccggtggaggctncccgacgaaacaaacaacacctcggccttgccagcagcagcagcagcaacgccgcagacaaatgccaaaccgttacaggcccagggtgcgtntcggaggaggcaaggtggtccagtaccgatcaaggaacaattcaggagtgccgaatacagggaagcggtcaggtcactggctctttacgagttcaagggtctttcgcggtcngccgtgactgcagtcttggctgaacncccccattcatacctagaggcgcgaaagacgctcatcgaggtgtcttccnaatcaaaaaaaaaaaaaaaaaaa

SEQ ID NO: 1605 - DNA, 415 bp, Oryza sativa
  misc_feature (352)..(352): n is a, c, g, or t
tgtgcgtcccccatccaccccgagttccccactccttcagccgccaaagattgacgccatcagccatcccatcacatcatggtcctctacttcccattctgctttgtgctgttgcacacaaaaacagcaatgttccgtcgagtgactgatggattagggtgaggtgttgttcacagatagagagaagatgtcttgtgtgctaccactctatcgtgccatcttgctgagggacccatcgagctgtcctctctattaagcaactagaccgtaacaatttccttttctttttttgtttttaactacaacccagtgattccttttttattttaattgcttccatgtagtgtggggnataatattaattctttcatgcagtaaggcaaggaatcaattctatcaaaaaaaaaaaaaaaaa

SEQ ID NO: 1606 - DNA, 563 bp, Oryza sativa
  misc_feature (1)..(1): n is a, c, g, or t
  misc_feature (11)..(11): n is a, c, g, or t
  misc_feature (21)..(21): n is a, c, g, or t
  misc_feature (23)..(23): n is a, c, g, or t
  misc_feature (27)..(27): n is a, c, g, or t
  misc_feature (52)..(52): n is a, c, g, or t
  misc_feature (62)..(62): n is a, c, g, or t
  misc_feature (77)..(78): n is a, c, g, or t
  misc_feature (103)..(103): n is a, c, g, or t
  misc_feature (108)..(108): n is a, c, g, or t
  misc_feature (117)..(117): n is a, c, g, or t
ntcctgatttngatacgtatncncctngatgagtgatacgttccgcaccgangacggccagngatcatgagggagannggagggccccaaaacgcaaccgctntcccngcgcgtgcngattcattaatgcagtggcacgacagtttccggactggaaagcgggcagtgagcgcaaacgcaattaatgtgagttagctcactcattaggcaaccccaggctttacaactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagggacactgaaaatacatacgattcagaatttcagactagattttggttttatacctgtacggttcattttctgtaaatgatgtatgtcggctacatgcacatctagaacttacacttttacgttcttaaaaaaaaaaaaaaaaaa

SEQ ID NO: 1607 - DNA, 442 bp, Oryza sativa
  misc_feature (15)..(15): n is a, c, g, or t
  misc_feature (65)..(65): n is a, c, g, or t
  misc_feature (191)..(191): n is a, c, g, or t
ttttcgcgccaaccncacgatcggcggtggtgatgtgccagccgtcggcttcttcgacggcggcntgaatcctgagcagcgccactccatcctctcctcgtcatgctcggctccatcgccggcggccacctcctcctcaccgcggctgatgaggtacgagcatatccggccgacggcctcgccgacgaccnccgagccgacgatctccaccaccgacggtcgctgcatattcttcgcttacaagtactccaactatggtggtctctacgcacatggtcatgtcaatattccaaaagttttgacaaaattacaccgaaagataaacaatgtattcatgagtaatgtgaaactgaaatcttacatgttttggattattattaattatatttgatttgcatgcggttaagtttaaaaaaaaaaaaaaaaaaaaaaaaaaaaaaaa

SEQ ID NO: 1608 - DNA, 338 bp, Oryza sativa
  misc_feature (248)..(248): n is a, c, g, or t
cagcacatcatcaggcaccagctgagtactggccatctgtactggacgcgattctccgcgctgcagtcctcgccacaactcgtcggccgaagagcgagtcgacctgaggcttcgtcaggcagtgtgttgctttttttgcccaaaagatggaccctctcgtcgaccatgaaaattttccttgttgcctggtgtacttttccttgttggatcttggatgatgtgtgtacacaccttactgaaattttgtnacccagttttgttgaaacgatccagaaagaatatatcatgcatcacaagtatggagtacttgtgggtttcctaaaaaaaaaaaaccagta

SEQ ID NO: 1609 - DNA, 589 bp, Oryza sativa
  misc_feature (21)..(21): n is a, c, g, or t
  misc_feature (420)..(420): n is a, c, g, or t
acacagcctatgagggaaatngaacaatgacccagatatgtgcctccaatcagtctaatcatctgatagtcaggttgtctgtggaaactctgaaggaaatcctgaatttcgcaccacatgagattacccagccatatcagctacagagtataaccgatttttggcttccgtcatcattggttttctggtggttctttcaaattgggggctggacgttggtggcactatcacccaagtattagttgctacaaggcccattctatttcttattgtaacgaacataacccttgtcttcactttgttgatggagaacacaggaccccaacgtgaggggtagaccagctggcagcaaccttggttctgctgataacttaggcccaatgctagagattggcctgctactacagaaagccctgagcnccctcctgatagactgcagcgtttgcgctgtcatcatgatctgttttatttgattttgaggggtaccttgacagtattttacggaattgcttgtaagaacgccaggtaccattctgtctatcgttcgaatttggagccctttttgctttaaaaaaaaaaaaaaaaaaaa

SEQ ID NO: 1610 - DNA, 508 bp, Oryza sativa
agatccttctccagctaaccagaagagagattggcacacacatttgttactatgggccatggggctgcttcagttctttttcctcgaaatcacgtatggaccccctgttgtcgctctcgtggttgtggtatacgtcctcactttcacttacgatcgaaaagccgataatactcaatgcagcatttgggggaaaaaaaaccattgacgggtcccgcactttgtaatgttgtgaaattgcagcggttggatcgaaatgggattggtgtttttgtgcgttgcacggctgcttggcctgctgctgtgttgagtatactgtatatacttgtgccgtttaattttgtgttgcccttccctatatgttcttctacacccgtgtagggctgagggtatatcagtttttgggtcctgttagaaggaaaatgccccagctcctcatgtgcagaactcaactcatgggataccgtgatactagtgcagaatttgaactgaaaaaaaaaaaaaaaaaaaa

SEQ ID NO: 1611 - DNA, 537 bp, Oryza sativa
  misc_feature (16)..(16): n is a, c, g, or t
  misc_feature (134)..(134): n is a, c, g, or t
  misc_feature (280)..(280): n is a, c, g, or t
cgaagaactgtatggncggctggctgacatgttcggaatcgagaaagaagaaatcataaaccatcttcatttccgtgacgcagctggtgtagtcaagcatccgggtgaggtaccattcagtgacttcatgaaancggcacggaggcttacaataatagcccggcgacagggagagaattgagagacctctcatcgaatgcttagttgagcaggcgtgatagttcaataaactcccgtttgaatttaattctgaaatatgaatcgtagcgtgaaaagactncctttgttacatgtacttgcgttgggctgttaactaagcagacctgctttgtattgtcagtgttgtggattgctcaagttaaggtgtgtgtgtttttatcttgcctcggttagctgtcagtttctttgttgcaatcagtggtcatgttcttctgttcaagttcgtaaaccaaacacttggatgaatcttagtcaaaataaaagttccttgggaaatcctacaatttcacagctaaaaaaaaaaaaaaaaaaaaaaaa

SEQ ID NO: 1612 - DNA, 596 bp, Oryza sativa
  misc_feature (25)..(26): n is a, c, g, or t
  misc_feature (43)..(43): n is a, c, g, or t
  misc_feature (68)..(68): n is a, c, g, or t
  misc_feature (172)..(172): n is a, c, g, or t
  misc_feature (185)..(185): n is a, c, g, or t
  misc_feature (213)..(213): n is a, c, g, or t
taatgtgaccaactggagcctcccnntcgactggtgtaagggntccactggaatggccaaatgctccntggccagccacactctggggccaccctcttcttgatagtaattgtggttggagggagtaaatacatgtgacccataatctcctccaagatattttgaccgcaangccagctaacctntccactgccatccctggggccatgtttnagctccctcgaacaaggcggcccctgggactctggctgatggcaacatgaattggattctgcaatcctatgcgacagaaagggtagcaatgagctatcctcatgtagtggctaattaggtgatttgccccataccttggatactagttaggtgattgtaagttgtaactcgtagaaatgtttagatgtttatacccatcatccgtgcataccacgagaaaacatctgattatgtttacacaacgattttataggattcatttttctttacaggagtttgcgcatgtaaataccttttttttttcttaacgggaatttcagggaagccccagacctgaggcatgagttccttaaaaaaaaaaaaaaaaaaaaaaaaaaaaaaaa

SEQ ID NO: 1613 - DNA, 456 bp, Oryza sativa
aggagctgtagcctctttttttcttgtcgctagtatgggggcatgtggaggtatgtagtggttacatacttgcatgtgtacgctgcaggttgtagggctgagagcctgagatctttcttcctaactttccaggaaaaatggtgtattacagctcagcagctggctcttgcagttcatttgaaataacaggaggcggcgactgctgttaggtattttgctgcaagagagagtagctgtaggctagtgtagaagcagcaaatgtattttctacagaaggaatgttttttgttctatcactgtctagtgtgttgcgtctaactcttgttacttggaacgtctgacgtctgagattatggttggtttaaacaatcgggtatggttgcgacttgtgactcctgttataatttaattgcgaggatatttattgtcacattggccaaaaaaaaaaaaaaaaaa

SEQ ID NO: 1614 - DNA, 665 bp, Oryza sativa
  misc_feature (57)..(57): n is a, c, g, or t
  misc_feature (65)..(65): n is a, c, g, or t
tcataatgtttagaccagctgagtaagccgccaagtggatgctgaactggataagtnaaaaagcntgagtaaggaagaggcagccatcctttgctgctagggcagttgcccgaggcagaagcagccattgctgaagctgaagaagcagcaagggctgcagaggccgcagaagccgaggtgacgctgcaaaggcttttcttgatgctgttgtgaccacgatgcaaaacagaaatcatgcttctgcggtatactgaacacattctttgtcaacataattgtggtgagcactgcctgcagctaataatgccgctcactgcacttgataaatgccagatgcttccgagcttgctgatcttctctacggattcagattgggtttcagccagtgaaacttgtcaagacaacgctggtgttctgctacaaagcttttgttgatagatgagattcttgtatagccttatagatcaagatgctttagtgaggggggttttcaacattttgctctgatcctgaaccctaactactcatatttgagttgatgtcatccagtggtatccaattagatacatatatcacgtgactggtgtttgtgctatgttaagacaatcaacaactccaataacaagggcgaatgagaatttagtctgaaaaaaaaaaaaaaaaaa

SEQ ID NO: 1615 - DNA, 464 bp, Oryza sativa
gccctcctgccaatgccgacgccgcccctctcgtccccctgaagggacccggctgggaggtggtggtgccgacgaagagcggcggcggaatgctgacgtcgctcaccagttagcttcttcattcgctcgctgttgccgtctatgcatgccgaccgggtggggtgcctacttcacctgtgctgatgagacgatgcttttgtgatatacaatatcccccaagtaattgactgactgggcgttgcacttgcacctactgactaggagtaggaggtgatgtagtagtgtgcactgttataggctcagctgctggaattcattttgcaaggccagaagccttttccagcaagcctgtgcaaggaagtggtttttgtcatgatacaattgtctacccagcttatgtgtaagcaagctatgcaatgcaatgctataaatagtttctcaaggtaaaaaaaaaaaaaaaaaaa

SEQ ID NO: 1616 - DNA, 659 bp, Oryza sativa
tttttttgccggttgtttggaagtgtgctgtggtgtccccgcaccggggggaggcgtgtgtcggcgggggtgctccgggcctgttgcggcatgcggcgtctttcggccgcagggttgagtttgtggggttcaaagtgtatgagcccaatgatcagcgccagtggccggggtcgtggctacagcatatcaggggctgagcccatataatggaggttcgtaagcacgcagtatggcataccgggcaagccccttctggcaatgcagctggcgtttgcaactggagaaacaaccaagtctggcaacatgctgcgcgctgggtggcgcaaacaatctcactatcaggacattaacatggttgcagccatagcgcagcagctacaactccagcagtttggggatcttacttggatgcggaatctggctcaagctcaagctgctattggcttttaacgtgccatctgagatatgggtatcctaccctagggtactagggtgcacccagtaccagtgaccacctggcggtgtgcttgtaatggattttaacagtatatggttcggaattaaaaataagctcagatatcatgcatatggacatggtgaaacttggggtgatataaatagaaataaagtgtcgttcatatttaaaaaaaaaaaaaaaa

SEQ ID NO: 1617 - DNA, 883 bp, Oryza sativa
gctcgtcattaagagcgaaagaaagttacttggaattctttggtttgttgtaatgacaatcacgagagaagaagcggagagcaaggagatggagagcctacgggtgcacgccagcgcgctgctctcgctgtcgtcgcctgcagcgtcggcgtcgcagccgacgtcgtcgtcgtcgacgacggagggggtgttcgagtgcaagacgtgcagcaagcggttcccgtcgttccaggcgctgggcgggcaccggacgagccacacgcggctgcaggcgaagctgctgagcgaccccgccgcggcggcggcggcggcggccgagagggacagggcacgcgtccacgagtgcgccgtgtgcggggtcgagttctccatggggcaggcgctcggcggccacatgcgccggcacaggggcgagacgggcacgacgaccgtcgtgctcgcggacgccgacgactcgggcggcgccaccgtgccgcagccgccggagcccatgccggacctgaactacccgccgctggaggacgccggcgacggctcggagcctgagttacttaaccttcttgtataagttgcatcgatagatatacatgtgaattgaattggcgtctgtacatagatatggtggatggattctttaccaaatttgatcgaaaaaaagaactaaattttggagcgtgatgatcatagcatgtaagttgtaacaaatgattgttaactgtaagataggaattctattcatttgttctcttctgtacaaaattacaaataggttgattaattagttggtcggttgtggttgattctttgtaaaataccaatttactagtataaatatactgacagcttattgtttcaaaaaaaaaaaaaaaaaaaaaaaaaaaaa

SEQ ID NO: 1618 - DNA, 676 bp, Oryza sativa
  misc_feature (38)..(38): n is a, c, g, or t
  misc_feature (498)..(498): n is a, c, g, or t
  misc_feature (600)..(600): n is a, c, g, or t
  misc_feature (624)..(624): n is a, c, g, or t
aacttgtctacgtcaaatacctgtaggaaagcgttgtngatttgttcaatattccaatagggcttcagctgaggaggccataaggatgctaaatggaagccaatttaggaggtcagagcataaggctttcatggggtcgtagccctggaaacaagcagcctcagcaagaccagaaccaatggaatgctggctattatggatatcccccccaaggatatgatccatatggttatgttcggccgcctcaagatcctgccatgtacgcttatgcagcatatcctggatacgggaattatcaacaaccagcgccacagcagccccctcaacagtaagaacaagtgttggtcaagtgccctatcacaacatatgatgaaaatagttttggcaactttggtgtaattggcatgaaaatttttgaactgttgcttgtgctatctttgttgaacgtcgtgtgcacgcccagcctatgttgtaacatgacattttactgaggcctangtgacactagaatgacagcttttagggaggggagtattggagtgaccatttttcgcttgctcaaaaagttttgtcgccatgggtaccattagaagaggagtngagcaagaaataataaagtttgtnacattagacatcggcggacattttaatcgggcactttggtattattgcactg

SEQ ID NO: 1619 - DNA, 506 bp, Oryza sativa
  misc_feature (50)..(51): n is a, c, g, or t
  misc_feature (92)..(92): n is a, c, g, or t
accttgattggaggacagaatgtggaggctttcatgggccgcacccttcnnaatagacaagctcagcctcaacaggattccaaccagtgggntgttgctaatgctggatactatgtttatgggccaaggatatgagggttatgggtatgcacaacctcaggaccctaatatgtatgggtatggagcttatgctggttatcccaactaccagcaacccctagctcagcagccgcagcagcaacagtgagatccatggaagatttggttttcgagactgatcagagccgtcgaatgaggtgatgcttctgcattccggagcatgtctgggttatgtcaatagagattgtgatttgtagttctccagattttgactgcttatgaggtgttttgattaagcgacatgttctgtacttctgtgagcctgggctggtgcacattgtgattctgtcgtacatgtgaactgcatgtagtaaaaaaaatctttcgtggttaaaaaaaaaaaaaaa

SEQ ID NO: 1620 - DNA, 565 bp, Oryza sativa
taggtatgtcgagaaagtatattgagatggaggagaaaggactggtttgcgtggctttcgacctgagaaacaattagaaggccagacacaatccagcctgcaaaacagaggatgaatacgattacttgcaggatggcagaagacaggctgaaggccagactacagagggcactggaccgggtgcgctctatgacacatacccagaagcacagagaacagtaccgtaggcttacaacttgtgttgctgaaatgcaacagtccaggatgatgcaggacgagatgctaagtgaggcagctggtgctgacggaagtgatttcatgaatggactggaggacttgatatgcagagacgacccccaatgactgccatttggtgaagtcgaagttgttacatcagttaggccgatcattgccttgttcattgccatattagccttgtaaattcttccgcttgtagttcactcactgcttaatatctagctcatgctgttagtattatgtaactctgtgcactgatcataatagaatatttctctcctgtatgttaccaaaaaaaaaaaaaaaa

SEQ ID NO: 1621 - DNA, 510 bp, Oryza sativa
  misc_feature (17)..(17): n is a, c, g, or t
  misc_feature (35)..(35): n is a, c, g, or t
  misc_feature (41)..(41): n is a, c, g, or t
atctggcccaggcgatnatgagatcaacctccaantaactntcagtagaaagaaaaatcaaacaatgcaacgctttgcatgcaggagttagagagtggacaagcaaaaatttagcctgtgtactactgaacttttttatcagtgcaacgtcatagtgaagcaattagtctgcttcatgatgatgattagtacgtagtactactaaataacactaatagcttcttgcaacaaggtcttggtaatgacatcacacatcactggaccctggccatgcatgcatgtccaagtataatcttgctgacctagttggtgcaatcttcttatttccaaaatttgtttgagtgtttagctaggttaaatcgagacagatgaaacaaggttctgaattcagtatctatgtgtgtcatttcatatgtgtctcaggcgatgaactagtgtaaaactgcattaaaaattttctgatctatccctagtttttataataatttccagttcaaaaaaaaaaaaaaa

SEQ ID NO: 1622 - DNA, 702 bp, Oryza sativa
  misc_feature (7)..(7): n is a, c, g, or t
  misc_feature (59)..(59): n is a, c, g, or t
  misc_feature (86)..(86): n is a, c, g, or t
  misc_feature (196)..(196): n is a, c, g, or t
  misc_feature (261)..(261): n is a, c, g, or t
  misc_feature (299)..(299): n is a, c, g, or t
aaaaggnagttttatgattattcgacagaaaatttgtccaagttacaggccccattttncgaggacatcaagtaaggaaaagctancggaggatagtctggtctgtaggcattgtggagaaaattatattgagtggaggagaaagcgaaggggcctgcgtggtttccaaccggtaaaacagcttgaaggtccatcnccgatccaacagcttgaaggtccatcgcagatccaaccagcaaaggaagaggaagaggatgaatntgattacctcaaagatggcaggaagcaagccgaaggcngattacagagagcactagctcgtgtgaaatcgatgactcaatacccagaagcaagagaacagtacagtagaatcgcaaaccgtgttacagaactgcaggagcctcaggcgatgatgattcaggatgatatgcaaagtgatggagctattgctgatggaggcgacttcatggctgaactggaggagctatgcggggatggggacgcaccaatgcccaccattttgtgacattgaggagttttactagatcagttaggctgcgacctctgttctttaccaggctagctgtaaattcttgtgctagatgttcagtgctcaccgttcgactctatatagcgttatacctaataccatgcgacttctattaaaaaaaaaaaaaaaaaaaaaaaaaaaaaaaaaaaaaa

SEQ ID NO: 1623 - DNA, 271 bp, Oryza sativa
taccgcgtcgagtccacggagaccatcgacggtcgacgtcgccatggacgacgtcgccaggcgcggcgtggcgacggtcaaaatcacgagcagccaccaaatggcatgacagcacttccggaattgtatcctgtctattcccgtctggactctgaagttgcaatgtaatgaagaaacggtgatgatacatattagcactttaaaaatgttgaatgaaaattttatttactcgttctgtaaaggaacggtaatacgacaaaaaaaaaaaaaa

SEQ ID NO: 1624 - DNA, 713 bp, Oryza sativa
  misc_feature (107)..(107): n is a, c, g, or t
cccgatcacactaagaagctgagcatcccgacgacggtgtctcgcgtgctcaagtacatacccgagctgcagaagcaggtggagaatctggagaggaagaagaaggngctgacgacgacgagcaccaccaactgcaaaccaggagtgttggggagccagctgatgagcgagggcatggctcccatcgtttcggctacctgcatcaatgacatggagatcatggttcaggtcagcttgttgagcaatgtggcgggttcagttcttcctctctccaagtgtatcaaagtactggagaacgaaggtcttcacttcatcagttcatcgacttcctccggatttgggaacaggacattctacagtatccatcttcagagaagtgaaggaacgatcaacgaggagtgcccagcattttgtgaaaggttggagaaagtcgtcaggaacaaagcaaagctttaagcactagtaccgcgcgcgcgtgcctatgataatcctgaattaatcaagggccaaaatctaggtaaaaatgaccatgcgcagttgttaaatatagcatttggttagctgataataatgatatataagtagtgtgctcgatttatattaactaatttctatgacatatatactatgttgctcgatgtagcttttgtacatatttcatgcatgactctcagtgtattaattaattatattatgagaaaaaaaaaaaaaaa

SEQ ID NO: 1625 - DNA, 187 bp, Oryza sativa
cactgttggatgcctggttggttttttgggaaaaaagaaaataaaaggagggatggaacaagaacatcatgttacatatggcctactgatgagtaatttataccctttgtggattattaattggttgtttatttacaagtaaatgtcaagataccaaattgtggattaaaaaaaaaaaaaaaaaaaa

SEQ ID NO: 1626 - DNA, 548 bp, Oryza sativa
gaccttccagaatatacattacgcaaccaggctagtcagaggccacagaaagtgttaatggcatcctccttccggttcttattgatcaagacatcccgaaaagcaagggtggaaattgagatttcggaagattcaaagtttgcacggttcgacttcaacggtgcaccattcaccatgcatgatgatgtatcaatccttgaagccatcaggcgtaacaacaaaggaagagctggcctctccattcacccttaagaggcacaagaatgtgacaaaccattgaagtgtcaaactcaaaactggcaccaccagtttcttttgcacagttatgtatagctatagcgtacctttcagtatggaaactcgacctagtttataggacagtctctcaggctttttagcagatatgacctgcgaattttgcctcttttttgtgcctagcaggtgagtctggaatagttttttcttgcgtgtgctgttatgtataaactcattgccgtttcaattcgaagcttgtgtacaagctccattgatgaaaaaaaaaaaaaaaa

SEQ ID NO: 1627 - DNA, 566 bp, Oryza sativa
tcgaagaaactctccagagcttaatgtgcgaagcggcaggcgcctgattacatgtctaatctatctcaattctcaactatctgggctcgcgaagcgcctactgcttctggtagcactccagccactgccgctgctacttccgctactgccagcactcaaatgcatctgaaggtcagcaatcgaatggacccccaccaaacggcacctgcagggaataccaacgggccatcgtctaaaaagtccggtggttccacaccagtaggattagggacttccttggagttgaagaagcagaaatcaagcagaagtcatagaaagtaacatcagtggtaggtttatttccaacattttggaattgtagggtgctttgagttttttacccacatagaattgtcacgccagcatggtggcagagtaattttgtttgttttttttggaggggttcttaggatgagttcaataataacaacgagaatgaagtgaaacattgttgtgacttgatagactactgatgatgagataaaatgcctaagcattctgccttcacaccaaaaaaaaaaaaaaaa

SEQ ID NO: 1628 - DNA, 721 bp, Oryza sativa
  misc_feature (263)..(263): n is a, c, g, or t
  misc_feature (366)..(366): n is a, c, g, or t
cgcggagacaacgtgagaaagaaagaaacgagacgaacgcgaggtggtggaggtggacgccatggccgccgccggcagcagcagcaggttcgccgtcacgtgcggcctcctcagccagtacatgcgggagcgccagcagccgcagccgccggtgacggttcttgaggcggtggcggaggaggaggaggaggaggacgcgcggactatgcagctcttccccccgcgcgccgccgccgccgacgggttcgcgacgccgtcggagngaacggccccgctgaccatcttctacgacgggaggatggtcgtggtcgacgacgtcccggtcgagaaggccgcggactcatgaggctggccggctccgcgtgntcgccgccgcagccggcgcacgccgccgcgcttcccggagatgccgatcgcgaggaaggcgtcgctgcagcgtttcctccagaagaggaagcacagggatcacgacaacgagcgaaccatacaagaaggcggcggtggcgtcgcggcgccggagaaaagcttcgccgtcgcgccggtgaaagatgagccggcgaaatggcttcgggctctgaagatttatctgcccggtttaagaaggaggagaatatcacaaagggaagaaaaaaaattaaagtactgacttaaattgttgttttcccatgatttaagttcgtctctgttttaagatttctttggccccaaacccaaagaattc

SEQ ID NO: 1629 - DNA, 672 bp, Oryza sativa
  misc_feature (41)..(41): n is a, c, g, or t
  misc_feature (56)..(56): n is a, c, g, or t
tcacttataggccgatttggttacgggcccccccttcgagntcgccccacgcgtcngcaccttcatccttcactccacagttaacagccatggttaacaagcaagaagttacagaacaacgaagctgcaatggcggacggcgctgttaaggaatatcgccatggtctgtgcatggatgtcccgatgtacattgaagattcggagtattgtggagaggagcttggcaccagactaacttgcaggcatggcctcacgccgaaacggaggacagcttgggaaggacctgacacaggaagaaggttcttaggttgtccgctggaggaagaggatcagtgcgataaatttttttgggtcgacgaaccatggcacccaagagttcagaagacacttgagcagatgtggcatgcagtggaacgtgctaccaagctaaccggttcgaaacaatatgactggtgttgtttcgttcggaatacaaaggccgaggaagaaaaaatgaagttagagttagatacggctgaccatatctctgaactagaattggcgtataaaaaaaattaatgaaaaagaaaaaagagctcgacgatactcgtgcgtggttaatgggatcgtttgtagtaattgtcattatgttagtgaaaattagtgatctcatgtacaaaaaaaaaaaaaaaa

SEQ ID NO: 1630 - DNA, 418 bp, Oryza sativa
  misc_feature (31)..(31): n is a, c, g, or t
  misc_feature (63)..(63): n is a, c, g, or t
caaaaatggtggatgggcgtttgtaacgcgntgggagacgacagacctccgtctgtttttagngggatggtttccaaccgcttcaccgtccatgtagctttctcaggcgtgttggactaaagtggctaaccggtatagtgcgcaattttgtttcatatcgtaaaaatatatatttatatccatagaaaagctgtcgcgtgatggcacgctggattgtgcaatgtggatatgatactgtacaacattggtccaactgggcgtgcacatagaaactctttttttggtttggtttggtttggctaactggatggatgattacaaactcctttttggctaactggatggaagtatctgtttcgtatcgtccatcccaatatcaatcaatatatgtctttaatttcaaaaaaaaaaaaaaaaa

SEQ ID NO: 1631 - DNA, 507 bp, Oryza sativa
  misc_feature (7)..(7): n is a, c, g, or t
  misc_feature (264)..(264): n is a, c, g, or t
cggaacntgacagagaacgcgtgggggagggccacggcgcggtcgccgtcggcgacgggatcgacgtcgacgggatagtgggccgggtgcggggcgtgctcggccgcgccgacgcgctccggctgcgcaccgtgaagcgcgcggtggagatcctcgagccggcgcaggcggccgagctgctcgtcgccgccgccgacatggagatcggcttccgggagttcgggctcaagtacagctcggcccgcagcgactagcgcttccacnccgcggcccagcttacaggcccagtttttttctccaatactgttggttttactgggccgaaaaagccataaaatcttagtgagtggtgtgctgggacgtggctgggcaggactagccctctgttaagagaaaaaatgtaataaaatgcaagcaactatgatcgttttttgctgtgcaaagctgatgattcacccatggatcgattgctcgatccgtttaagatgctaaaaaaaaaaaaaaagg

SEQ ID NO: 1632 - DNA, 763 bp, Glycine max
  misc_feature (1)..(1): n is a, c, g, or t
  misc_feature (12)..(12): n is a, c, g, or t
  misc_feature (18)..(18): n is a, c, g, or t
  misc_feature (25)..(25): n is a, c, g, or t
  misc_feature (28)..(28): n is a, c, g, or t
  misc_feature (620)..(620): n is a, c, g, or t
  misc_feature (713)..(713): n is a, c, g, or t
natgatttgagnaagggnataaggncangggctagcgcgcatttaccctcactaaagggaacaaaagctggagctccaccgcggtggcggtcgctctagatctagtggatcccccgggctgcaggaattcagcacgaggacgaaccaaagttaactactttagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtctgtgctagagtcgatgctcttcaggcaacccttcaccaccactacgtgcccccgcggcaacttctctctggcggtggtggtgggtccggggatntcccggtgcgggttgttgacctgaataagatgcctgaacccgagagttccgactgtgagtgggatgtgaattgaacgaaaaaaagtacatgtnttcgtattcggctgctaagcgccgggtcgaggcaagctgatttgccgatg

SEQ ID NO: 1633 - DNA, 672 bp, Glycine max
  misc_feature (1)..(1): n is a, c, g, or t
  misc_feature (30)..(30): n is a, c, g, or t
  misc_feature (33)..(34): n is a, c, g, or t
  misc_feature (78)..(78): n is a, c, g, or t
nggggtcgtaccggaagaaagctacaactntgnnaaatccattacttccagacgcgcaattaacccctcactaaaggnaacaaaagctggagctccaccgcggtggcggccgctctagaactagtggatcccccgggctgcagggttctaagagaagaaaatggagggtggaagatcatcagtttcaaatggtatatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtgt

SEQ ID NO: 1634 - DNA, 653 bp, Glycine max
  misc_feature (569)..(569): n is a, c, g, or t
  misc_feature (590)..(593): n is a, c, g, or t
  misc_feature (595)..(595): n is a, c, g, or t
aacaccagactcaattgtgttatgtttttattgcacaaaatttacaaaggtaaacattatgtctgatccttaacagcaattgtatgcttcttggtagataatctcgtaccatacatatgttgtactgttgaatggaacaaatgtggttgatgaactacaagatccaactcaaagaagtctgatcattctagggagaagttgttgctttgttggctgcttggtacaaaatgacaacctccccgattactgaacagtttttgctaatgcagctgcaatccgagttttattgctttggctgatggttcactgtattgaggctgtggctgacttagttggagactaataggtgcatgtaaatcatatccatttctgaccttataagaaggattggatgccacattttcttcatttgtactccttgcttcataaaccttcttctgtagctctgcattttctttttggatctgctccatcttttgatagagttcaacattttcttgatgaatgagatttcccttttggcgtagttcttcgatctcattagttaaaatttggtcctttttcatgcngacaccctttaaactcatctnnnntnggttttccagactttgtagttctttaatacccaaacccataagttcttcccccattaa

SEQ ID NO: 1635 - DNA, 732 bp, Glycine max
  misc_feature (14)..(14): n is a, c, g, or t
  misc_feature (20)..(20): n is a, c, g, or t
  misc_feature (22)..(22): n is a, c, g, or t
  misc_feature (24)..(27): n is a, c, g, or t
  misc_feature (38)..(40): n is a, c, g, or t
  misc_feature (43)..(43): n is a, c, g, or t
  misc_feature (54)..(54): n is a, c, g, or t
  misc_feature (56)..(61): n is a, c, g, or t
  misc_feature (66)..(66): n is a, c, g, or t
  misc_feature (81)..(81): n is a, c, g, or t
  misc_feature (87)..(88): n is a, c, g, or t
  misc_feature (126)..(126): n is a, c, g, or t
cgccgagcgaggcngcgggngngnnnngggggggaaannnagnattaactctcncnnnnnnccggncctaagtctctgaancatgcnnatactttccagacgcgcaattaacccctcactaaaggnaacaaaagctggtagctccaccgcggtggcggccgctctagcactagtggatcccccgggctgcaggaattcggcacgaggctgtgcgatgctgatgtggctctcatcgtcttctccaccaaaggcaagcttttggactactccaaccaaccttgtacggaaagaattcttgaacggtatgagaggtatttgtatgcggagaggcaacttgttggagatgatcaaccaccaaatgaaaactgggttatagaacatgaaaagctcaaggctagggtggaggtactacagagaaatcaaaggaattttatgggagaagatctggacagcttaaatcttagaggacttcagagtttggagcaacaacttgattccgctctcaaacacattagatcacgaaagaaccaagccatgaatgaatctatttctgagcttcagaaaaaggataggacactccgtgaacacaacaacttgctctccaagaagataaaggaaaaagagaaggagctgaccccacaagagcaagaaggactgcaaaataacatggatgtgagctctgtccttgtaactcaaccactggaatccctgactattggaagcttcccagaa

SEQ ID NO: 1636 - DNA, 799 bp, Glycine max
  misc_feature (1)..(4): n is a, c, g, or t
  misc_feature (630)..(630): n is a, c, g, or t
  misc_feature (639)..(639): n is a, c, g, or t
  misc_feature (656)..(656): n is a, c, g, or t
nnnnaaggatacgactgccagactcggccaagcgcgcaattaaccctcactaaagggaacaaaagctggagctccaccgcggtggcggccgctctagaactagtggatcccccgggctgcaggaattcggcacgaggcacaacacaaacacattcaacaacatggtagcaattctcaagagacagggagaaaacgaatccgaagaaaccatcataggcttggcaaaaagtctcatgcaactctcgcgtgtccaacaacaaagcaataagcctcttctcaaaaccttttctccaacggagttcgagtgcaaaacctgtaaccgcaagttttcatcttttcaagctcttggtggccacagggctagccacaagaagcccaagttcgaagctgaagaactcaaagaagaagccaagaagactaaacccaaaatgcacgagtgttcaatttgtggcatggaattctctctgggccaggcactggggggtcacatgagaaaacacagaggtgccattagtgagaacgacaataataatgaagcgttgtcttctataaagcaagcaattgcaaaagctccggttttgaaacgatcgaatagcaagagggtcatgtgcttggagatggacctgaatntgacgcctntggagaatgacttgaangtgttgttcgggagacaaaggctcgctagagtcgatcttttctttgtagaggattaattgattattcctgtatctttcgattcattatttgtgtaaaaatttagtgtgactttgctttcttaattcagtcctcgtgtagacga

SEQ ID NO: 1637 - DNA, 607 bp, Glycine max
tgaatctggtgagcaaatatggagctttgttggcaaacatccatccatggttcttgaagaagcatggagataaaggggtgtgagagggtcctcaccactcacactcctccacttaaaacagtttgttttggcttagctttggcttctctaatcaacaagggatgtgttctaacattctctcttgagtggcagaagcagatatgcattctccaaaggaggagaggctttggctacagcctggcaaaccggcaagtcacgaaaaggcaatggactccattggggtctctatggctatctattgctcatctatgtagttcttcttgctgtagaatgtaataaaacaaagttggccttcctttgagaagttaccaacttttgctgtccaaattactcaatttgcagctgactagaattcctttctctctgatcagtttctgcagatgagtaggtaggtaatttgtgatcactcccttcccttcatgtctgtgttcccttttccatgcttgtttgtgttgttagttataaccttatgaggaataaaagaatagtacaattctagtccctcaaagtttaggattgtattctattgaactttaatagaaaagct

SEQ ID NO: 1638 - DNA, 925 bp, Glycine max
  misc_feature (598)..(598): n is a, c, g, or t
  misc_feature (622)..(622): n is a, c, g, or t
  misc_feature (768)..(768): n is a, c, g, or t
  misc_feature (770)..(770): n is a, c, g, or t
  misc_feature (836)..(836): n is a, c, g, or t
  misc_feature (853)..(853): n is a, c, g, or t
  misc_feature (865)..(865): n is a, c, g, or t
aggggaggcgcccccccccaccccccccccccgacgcaattacgagcagtccacagggccgcaatcgcgctattaaccctcactaaagggaacaaaagctggagctccaccgcggtggcggccgctctagaactagtggatcccccgggctgcaggaattcggcacgagcggcacgagcagcagtctgcaagacaacgtcgcggtcatggcacgccaatatgtccgcagtgtgatttcctccgtgcagagggttgccatggctatatctccatctggtataaacccatcaattggagctaaactttctcctggttctccagaggctgttacactagctcactggatctgccaaagttatagttactatttagggtccgacttactgagatcagattctcttgttggtgacatgatgctgaaacaactgtggcatcaccaggatgccattctatgctgttcactgaagtcattgccagtgttcatatttgcaaatcaagctggccttgacatgttggaaacaaccctagttgccttacaagatatcacattggataaaatatttgatgaggctggacgcaaggcattgtgtacagactntgccaagttaatggagcagggttntgcttatctgccagctggaatctgcatgtcgacgatggggcgccatgtgtcatatgaccaagccattgcatggaaagttcttactgcggaagacaacactgctcactgcttggctgtctctgtcataaattggtcatttgtatgananatccgattcgtgtgccctgctttttcccacttgaacatacaaatgaaagggtaaaagggagacaangacagcttggcgggaanaaagagtcgtanatgttgtattacacatcaggatcaggttgcatttaatcgatttaattattcttattaggc

SEQ ID NO: 1639 - DNA, 787 bp, Glycine max
  misc_feature (1)..(1): n is a, c, g, or t
  misc_feature (787)..(787): n is a, c, g, or t
naagtaatccgatctctattgaccgtgactaaagggaacaaaagctggagctccaccgcggtggcggccgctctagaactagtggatcccccgggctgcaggaattcggcacgaggacaagatataactttagagaaaatatttgatgatcatggacgaaaaattctcttttcagagtttccacagattatacaacagggttttgcatgtcttcaaggtggtatttgtctttcaagcatggggcgacctgtctcgtacgaaagagttgttgcttggaaggtgctgaatgaagaagagaatgctcattgtatctgctgtatgtttgtgaactggtcttttgattgacatcttgttctgagtacacttgggcttattgtatcttagtgtaacataaggatttactccaagacactcgtgctttgttggatgatgttttactgtatttgcactagatacttggattgcacattaaatgactatttatttcttagtctaaaacaaaaaacaaaagtagaaaaatagataataaacactcgtgggggggccccggtcccaattctccctatagtgagtcgttttacgcgcgctcactggccgtcattttacatcgttgtgattggggaaaaccctggcgttacccaacttaattggcttgcagcacttgcccccgttcgtccagatgcgtaattagcgaataggccccgacctgatcgccttcctaacagatgcgcattctaaattgcgattgatacccgccttgtagcggcactctaaccccacggggttn

SEQ ID NO: 1640 - DNA, 802 bp, Glycine max
  misc_feature (691)..(691): n is a, c, g, or t
atgtgggcacgcttgaccatgattacgccaagcgcgcaattaaccctcactaaagggaacaaaagctggagctccaccgcggtggcggccgctctagaactagtggatcccccgggctgcaggcagctggggccaaagtcactttctggatcacccgaggcccttaccttagcgcgatggatctgtagaagctacagggttcacactggcacagagctttttaaagctgagtccacagctggtgatgcaatccttaagcaactttggcaccatcccgatgcaatcatatgctgttctgtgaaaacaaatgcatctccagtgttcaccttttcgaaccaggctggtttagacatgcttgaaactactcttgtttcccttcaagatataatgcttgataaagttcttgatgaatctggcaggaagattctctgctccgagttctccaagataatgcaacagggttttgcatctctccctgcaggaatatgtgtatctagtatgaatcggccagtgtcctatgagcaggttgttgcatggaaagtcctcaatgatgatgattctaatcactgcctagccttcatgttcatcaattggtcttttgtatgatggatgaaccatatctagagactactacttattttatctactaatcagatgatactatcacagacagatgtactgatgtcagctnttctttatgccctatgtatgaagtatgctaatgttacttattcgctatatatataaaatatctagtttaaaaaaaaaaaaaaaaaactcgaggggggggcccggtacccca

SEQ ID NO: 1641 - DNA, 940 bp, Glycine max
  misc_feature (1)..(2): n is a, c, g, or t
  misc_feature (61)..(61): n is a, c, g, or t
  misc_feature (922)..(922): n is a, c, g, or t
  misc_feature (940)..(940): n is a, c, g, or t
nnaaggagggggtggggggggatgaggcgctcttctgtgggggcggctgtcgcgccttttnctcctcactcacgggaacaaaagctggagctccaccgcggtggcggccgctctagaactatttttatcccccgggctgcaggaattcgacacgagtctcccagttcatcagcttcatcaccagcgaggcctctgattagtgtcagagagaaaagagaaagactattaacggcgatgatttgctctgggcgatggccactctcggtttcgaggattatatggatcctcttaaaatttacctcactagataccgagagatggagggtgatacgaagggctctgccaaggctggagactcatctgctctgagagatgttcagccaagtcctaatgctcagcttgctcatcaaggttctttctcacaaaatgttacttacccgaattctcagggtcaacatatgatggttccaatgcaaggcccggagtaggtatcaagtttattattgaccctcttgttgtaacgcttgttttctacgccagttaccaagtgctcacggcatattgaatgtctttttatgttatgtgaatactgacaggagatgttggctcttgtgtccgttattcttttgacattaaggttcgtatattatctctggattcgaattattatttgatagctatgattatattgttaatcctagagccctgttgtctgaatccatcatgctgcttgttcaagaccgagatgttaggactgatcgaagcataataccgaatattctctgcctaattcctctcacaatgatcgatgatgaatgctcgaagctctctcatctagagaactaacattactcgaggaggggctcggtactccattcgcttatagggatctattatctcgctactgatctcgtttacacgntcggactgtaaactctgn

SEQ ID NO: 1642 - DNA, 895 bp, Glycine max
  misc_feature (1)..(1): n is a, c, g, or t
  misc_feature (565)..(565): n is a, c, g, or t
  misc_feature (603)..(603): n is a, c, g, or t
  misc_feature (646)..(646): n is a, c, g, or t
  misc_feature (655)..(655): n is a, c, g, or t
  misc_feature (693)..(694): n is a, c, g, or t
  misc_feature (864)..(864): n is a, c, g, or t
nggatgaccgcctgatatgatcacgccaagcgcgcaattaaccctcactaaagggaacaaaagctggagctccaccgcggtggcggccgctctagaactagtggatcccccgggctgcaggaattcggcacgaggtttgcattcagcctcccagtggaaagggccccaagcataagcagacatgcacatgtaatgtatgcttaacagtgaagcgacgattccgtacccttatgttacggcgtgagaagaaacaatcagaaaaagaagcagagacaactcgtaaaaagcaacagcaacaacatcctctaccattaccttcatctgaaattttgcttgatgaagattccttgccctgtagtaacacaggtgatagtagcccaaaccagaacaaagagggtaatgatggttctgatgatgatcctagccgaataaaatcatctgcttcgccgttcaaaggcaaaattgacctcaatatccaaccagagcgagaagaagaattatcacctggttcggattctggcggcatgatgaagttgctccatgatgctactgagcgatatctcanacagcagactgtgaactctggtactggagattcatcangcagtcagtcacagctggtaggagatgcaatgagggaagatanacttagcantgtgttgccccatgcagtagtagtcataatactgatanngacatgcccatcttttgctatgatggtgaaatatattgcgctagccatattgatacgtctgcaagctataatgagtggggagatttgtgacatttatcactttcgctcttgcttttcttgttgacataagagataggaaaatgtagaaccatttattcgtattagtgggntttttaaggttgtagaacctgaaagccatta

SEQ ID NO: 1643 - DNA, 851 bp, Glycine max
  misc_feature (5)..(5): n is a, c, g, or t
  misc_feature (33)..(33): n is a, c, g, or t
  misc_feature (544)..(544): n is a, c, g, or t
  misc_feature (548)..(548): n is a, c, g, or t
  misc_feature (584)..(584): n is a, c, g, or t
  misc_feature (610)..(619): n is a, c, g, or t
  misc_feature (623)..(623): n is a, c, g, or t
  misc_feature (627)..(628): n is a, c, g, or t
  misc_feature (645)..(646): n is a, c, g, or t
  misc_feature (665)..(665): n is a, c, g, or t
  misc_feature (668)..(669): n is a, c, g, or t
  misc_feature (671)..(671): n is a, c, g, or t
  misc_feature (678)..(678): n is a, c, g, or t
  misc_feature (680)..(684): n is a, c, g, or t
  misc_feature (691)..(691): n is a, c, g, or t
  misc_feature (701)..(701): n is a, c, g, or t
  misc_feature (724)..(724): n is a, c, g, or t
  misc_feature (737)..(737): n is a, c, g, or t
  misc_feature (741)..(741): n is a, c, g, or t
  misc_feature (756)..(757): n is a, c, g, or t
  misc_feature (782)..(782): n is a, c, g, or t
  misc_feature (797)..(797): n is a, c, g, or t
  misc_feature (826)..(826): n is a, c, g, or t
ggtgnctataaccaaaaataaaggcagaatctncagctctattacgactactatagggaaagctggtacgcctgcaggtaccggtccggaattcccgggtcgacccacgcgtccggtggtggggacaggtacggaggaggtggtggtggtggcagatatggaggcggcggtggcgggaggtacgttggtggtggaggcggcggcggcggcggaggaagctgctacagctgtggagagtctgggcattttgccagagattgcccatcaagtgctcgttgaatttactgttagggttgtttatgttttgcggattgttttaagtttttactttaatatgtcttagggattttaatggtttctgtccaaactatgggttcttatgagtagatgtgtgggatttttcttttttggttatttaaatgaagggtttctgtgttatcgttacaatctgcaaaaaaaaaaaaaaaaaaaaaaaaataaaaaaaaaaaaaaaaaaaaaaaaaaaaaaaaaaaaaattaaaataaaataaaaaaaataatatantatntatataaaaaaaaaaaaaaataaaaaaaaaaagggnttttcttttaaaaaatcaaattttannnnnnnnnntttnaaannttatttttttattaatnnaacttattttaattccctnccnntntttacanannnnnaataaanaaaccctttntctacccacttaattcctttcanccatcctcttttnccantttaatatataaaannacccccccccatctccttccacacnttcccaccctaattntaaataccccccctttttcttcctttcancctctctttttatatccttctcttt

SEQ ID NO: 1644 - DNA, 624 bp, Glycine max
  misc_feature (567)..(567): n is a, c, g, or t
  misc_feature (573)..(573): n is a, c, g, or t
  misc_feature (576)..(576): n is a, c, g, or t
gccttacattaggtaatacgacataactctagggaatttggccctcgaggccaagaattcggcacgaggaagaattcgcggccgcaggaatttttttttttttttttttaatgaatcacactttgttgaaaagaagcgcattagataaaacaattagcaaagccctggaaaaacatatttggaaggaaggaaggaaatgccaatggctagaaacaaaaataacagaatccatttaaccaaccccaactaacagtaacagactcaattcaatagaagaaaccataacacattctcactcatttccttttccaacattcggacattccctcgcaaaatgcccttcctccccacagttaaaacaccctcctcctcctccaccaccaccgccgcgtctccgattcctaccatcatcaccaccaccaccaccctgtccatggtaacaatcccttgccaagtgacctattcttccacagttataacactcagggcctcctcctctccgaccgaaccctctgccacggccttccccgcccccgtagcgtcctcctcctctgcccctcccaccgncgccgncgngaaatcctccgggaagacgagatctaacggctgaggtgacgtcgacga

SEQ ID NO: 1645 - DNA, 406 bp, Glycine max
cctcgtgccgaattcgcacgaggcggtggtggtggtggcaggtatggaggcggcggtggcgggaggtacggtggtggtggaggaggtggtggcggcggaggaagctgctacagctgtggagagtctgggcatttcgccagagattgcccatcaagtgctcgttgaaattactgttatggtggtttatgttatgcggattgttttaagtttttactttaacatgttgtagggattttaatggtttctgtcaaagctgtggcttcttataagtagatgcgtgagatttttcttttttttggttatttaaatgaaagtttctgtgttatcgttacaatctgcaaacaaaatctgtttggacctacattttgctataatgaattggatgattgttatcaaaaaaaaaaaa

SEQ ID NO: 1646 - DNA, 956 bp, Glycine max
  misc_feature (1)..(1): n is a, c, g, or t
  misc_feature (5)..(6): n is a, c, g, or t
  misc_feature (882)..(882): n is a, c, g, or t
  misc_feature (889)..(889): n is a, c, g, or t
  misc_feature (956)..(956): n is a, c, g, or t
ntaannaaccccccccccccccccccccccccccccccggcgtccatgaacgtgccatgcgcaaattctgccaagctctaatacgactcactatagggaaagctggtacgcctgcaggtaccggtccggaattcccgggtcgacctacgcgtccgatgagactggattaccttgaagatagagttgcatttgctcggctgttgtttcctgctgaggctagggtagccattgagaatgctgaagcagattcatcatcactgtatgcaaattcatcggctttgaaggtcacaaatggcaacccgaaagaagtagatctaaatgaatctccctcggctcgaaccagaaaactccagttaagattgcatgcccttatgaaaacagttgagaatgggaggcgcttctttccccattgctctgaagtgcttgataagtttctggaagacgacgaaatgccagatgttttcttcctagagaagggcagtgaagaagagcagagaatcaaaaaagcacgcttcatggagcttaaagatgatgtgcaaaaggcatttcacaaggatatggctgaaaataaccattctggtttttcatctacggtgtcttcctcttcttcctcaactcgtagggaaggtcttaaccatagagtaaggagaaaatgaagtccatgttcttctatgtagagtgttgcaacttgcaagtagaagccgtgggatatttagaaaaaataagatggaatgttaaattaaggggtttgctaatgaacttgggagatttttactagctcgatttagtttcttatagttggtggaccaagagaagaagaaaaataaaagaagacgaaatgggctatagtactatctttgttcctttcgaagaccctcaagngcgatgnttacattgtatctgaatattgatcgtatatcaatgaaaatttacctctgtaaaaaaaaaaaaaggcn

SEQ ID NO: 1647 - DNA, 777 bp, Glycine max
gtttttgatataagaagatatgttctaggttcactttggctctctcaagttgttgatcaaatggcttattcagccgaaccctcatcatctttgagctttacctcatcttcccatctatctaatgggtcggttagtcacaacatatgcccttcttatggctctgatcctggacctaacttagaggctatcagtttgagtaagcttagctccaatttggagcagcttttgattgaacctgattgcgattatagtgatgctgaccttgttgtcgagggaattccggttagtgttcatcgatgtattctggcctctaggagtaagtttttccatgaattattcaagagggagaaggggtcatcagaaaaagaagggaaattgaagtataacatgaatgatttgttgccttatggcaaggttggatatgaagccttcctcatattccttggctatgtatatactggtaaactcaagccctctccaatggaggtgtctacttgtgttgacaatgtttgtgctcatgatgcgtgtagacctgccattaactttgctgttgagttaatgtatgcctcttccatttttcaaataccagagttggtatcacttttccagagacgtctacttaactttataggaaaggcccttgtggaagatgtcatcccaatcctcactgttgctttccattgtcaatcaaatcaacttgtcaatcaatgtattgatagggtggccagatcagaccttgaccagatttcaattggacaagagcttccgcatgaactc

SEQ ID NO: 1648 - DNA, 902 bp, Glycine max
  misc_feature (1)..(1): n is a, c, g, or t
  misc_feature (22)..(22): n is a, c, g, or t
  misc_feature (660)..(660): n is a, c, g, or t
  misc_feature (773)..(773): n is a, c, g, or t
  misc_feature (780)..(780): n is a, c, g, or t
  misc_feature (869)..(869): n is a, c, g, or t
  misc_feature (902)..(902): n is a, c, g, or t
natgggtggatgatgatcgccngtttgtagacaccccaagcgcgcaattaaccctcactaaagggaacaaaagctggagctccaccgcggtggcggccgctctagaactagtggatcccccgggctgcaggaattcggcacgaggttgtctcaggatgtaggatcttctcaattagcaccacaagctcccagaccacccttgcagccaagccaacatccctcactggctgacacggtcagcgccgccgcctctgccatcacttccgatccaaacttcaccgccgtgctcgctgccgccatctcctccatcattgggggagctcacaattcaaacaacaacaacaataacaacagcaacaacaacacgagcaggactactattagcagcttttcaggaaactgaacattttctttttggttccattaactttgtatttttgtacttgggtactataagggaaaatgaaaccataaatgttcatattctttttagtccatgtattgggagggatatatcatatattagatcagaaaaaaaatgtttcatttttttgtatcatcaatttctctttgaataatgttgtatatttgattcacaaattctctttggagtaaatagacaagggcaaatgaaaaaaaaaaaaaaaaaaaaaaaactcnagggggggccccgttcccaatttcccctatagtgagtcatatttacacacgctcacttgccgtcgttttacaacgtcgtgacttgaaaaaccctgcgttaccccacttatcgncttgcancacatcccccttttcccaacctgcctaataccaaaaagcccccgaccatctgcctttcccaacattgcccatcctgaatggcaaatggnacccacccttaatcgcccattaaccccagagan

SEQ ID NO: 1649 - DNA, 675 bp, Glycine max
gagagaactaggctcgagtttctgttagagctcgatcagaggcacctatgataactgatgggtgtcaatggcgaaagtatgggcagaagatggccaaaggaaacccatgtcctcgtgcatattatagatgtaccatggcagcaggttgcccagtgagaaaacaggtgcaaaggtgtgctgaagacagaacaatactgatcacaacatatgaagggaatcacaaccaccctttgcctccagcagctatggcaatggcacaaaccacttcctcggcagcaagaatgctgctttcaggatcaatgtcaagtgctgatggcctaatgaatgcaagcttcctcacaaggacactcctcccttgctcttctagcatggcaactatctcagcctcagctccattcccaactgttacattggacttgactcagtctccaaatccattgcagttcccaaagcaaccaagccaattccaaatccccttccctggtgtccctcagaactttgccaattcacaagcctcattgctgcctcagatatttggtcaggcactttataaccaatccaagttttctggccttcaaatgtctcaagattcagacccttcccaattgagtaatcaatctcaaaggccaccaccacaccttgctgacacagttagtgctgccattgcagctgatc

SEQ ID NO: 1650 - DNA, 588 bp, Glycine max
cataattccagtagagatgggcacggacaatgaagggacattcacaacgcaccaggtgagtggtggtgacccaaacaacaacaacaacaacagcaacattgttcatccattggaggtaggatcaggtggtggaggcctcaccaactgggctgcgctggaccgtttagttgcatctcaactcaatggccaaaccgatgcctcttttttctaggatgtgctttcaacgaccccaccatgtattgcaccagcgtcgaccatcatgatcttcatcatcaaatccccaccctccgatcctcatcaacgtccgctaacacacgaccttcccctgcacccgcattcatcaaccccccaacacaggacttcaccagcgagattgacctttggaacttctcccgatccacgtcctcactgttggcatcctccgaaccactgtgccacgtgtccaacacgtcagtgtagcgagatcaataaaataataatataaaaaaaaatatctcaagtcccccttttcctccatgttcgattgttaaatatagaaataattagcccctacttcatcacatatcatgtttaatatttaatattagt

SEQ ID NO: 1651 - DNA, 453 bp, Glycine max
aagcagtgttcgtgcaagaaagaatcaggtttacaaggaacaaattgatcaactaaaagagaaggaaagagccctatatgctgaaaatgctaggctgtgtgagcagtatggtggtatccagccacagccagcaacaaaggatccgaaagaaattcaaccctatgcagaaagcagtccaagttcagaagtggagactgaattgttcattggactactcaggtctagctattgaacataatttaatccttgcctatgcaaatatcaaataagaagcccaactgcaatgtataaatatcacatgtttcctaatactgagatgaataatattatcgcttgtattatataaagaactttctagccttatgattagggtttaattattgatatgtttgcctttcctcaaaaaaaaaaaaaaaaaaaaaaaaaaaaaaaaaaaaaaaaaaaaaaaaaaaa

SEQ ID NO: 1652 - DNA, 766 bp, Glycine max
  misc_feature (1)..(1): n is a, c, g, or t
  misc_feature (574)..(574): n is a, c, g, or t
  misc_feature (599)..(644): n is a, c, g, or t
  misc_feature (666)..(668): n is a, c, g, or t
  misc_feature (766)..(766): n is a, c, g, or t
naagagtatgtcgctagtatgatcggccaagcgcgctattaaccctcactaaagggaacaaaagctggagctccaccgcggtggcggccgctctagaattagtggatcccccgggctgcaggaattcggcaccaggacattcgactgaagccaaatgaagcctacattttggagcaaatgaagtcccaagatggatttatgcagaatacttttgggaccttggatgacataatgggtgtaatggtcaaaagggagcaaaatgagtcgacattgttggatggagaaatgggatttgatgcctaccctgttggatcatgcaactgatttcttcttaaccagaacgaatccaggagcaataaaatcgtgaaacttgctccagtctctgaaaccgattaatgtacacctatttttatgttctgctactaaatttattttcttggccaacattttgttgtttcacttatggacttttgttagccatctgatctgttccatctttttttcctttcaatctgtagtgtatccccataaaaattgtctttggtttagataaaataattgtaatatgaatgtntcttggtgctcaaaaaaaaaaaaannnnnnnnnnnnnnnnnnnnnnnnnnnnnnnnnnnnnnnnnnnnnnaaaaaaaaaaaaaaaaaaaccnnngggggggcccgtccccattccccttatgggaatttataacccgcctaattggcggttttttacaactgtggactgggaaaccctggtttcccaatttn

SEQ ID NO: 1653 - DNA, 717 bp, Glycine max
  misc_feature (1)..(1): n is a, c, g, or t
  misc_feature (697)..(697): n is a, c, g, or t
nctggtgagtgggatcgcttgtagcatgctcacgccaagcgcgcaattaaccctcactaaagggaacaaaagctggagctccaccgcggtggcggccgctctagaactagtggatcccccgggctgcaggaattcggcacgaggttttccgggcccacagtggagtcaccggtgccttctccagttccggcatcggcaccggcaccggcgccggtgagtgcttcggtgatgaattcaggtagtacggaagggaagaagaagaggggcaggcctaggaagtatggaccggactgcaaggtggcgctgtcgccgatgccgatatcggcgtcgattccgttgaccggagacttctcagcctggaaaaggggaagagggaagccacttgaatcaatcaagaagtcttttaagttttatgaagctggaggtgcaggaccaggtgatggaattgcatactcagttggtgccaatttcacacctcacatccttacagtaaatgaaggcgaggatgttactatgaagattatgtccttctctcaacaaggatgtcaagcaatttgcattctgtctgcaaatggcacaatttcaaatgttacactacgccaaccaacttcttctggtggtactttaacatatgaggggcggtttgaaattctctccttgtctggttcatatataacaactgagaatggattaacanagagcacatctggtgggatt

SEQ ID NO: 1654 - DNA, 310 bp, Glycine max
aaggctgatgtaccatgtcatctcagctagtgctatatagtatgtgatgcatttatgggtttgacgtcaaacgtgtgttgccttgcttttcaatgctttgtaccgaatcatagtgtcatttatttgttcattacatttttattttagtatgtgtgatcttgttacctattacccgtttaattgttttagtttgcatgcaatgcaacaaggaatcagtttgcttgatgtgtttgtacatagttaatgctgaattgttgcttgtaaagtaaaattaggtacttatttgcacggggcatgtaaaaaaaaaaaa

SEQ ID NO: 1655 - DNA, 934 bp, Glycine max
  misc_feature (1)..(1): n is a, c, g, or t
  misc_feature (664)..(664): n is a, c, g, or t
  misc_feature (702)..(702): n is a, c, g, or t
  misc_feature (822)..(822): n is a, c, g, or t
  misc_feature (934)..(934): n is a, c, g, or t
nccgctgagtgatagactgctgctgattacgccccgcgcgcaattaaccctcactaaagggaacaaaagctggagctccaccgcggtggcggccgctctagaactagtggatcccccgggctgcaggaattcggcacgaggtacacttctcctgctacagagaatgaatcaatggaaactggtagtgccctatgggatatctttcagagagaggattctgaaaagttagaaacatatcttagaaaacactcaaaagaatttagacatacttactgttctccagttgaacaggttgtacatccaattcatgaccaatgtttttatttgacatgggaacataagaagaagctgaaggaggagcttggtgtagagccatggacttttgaacagaaacttggggaggcagtatttattcctgctggatgtccacatcaagtcaggaatctcaagtcatgcacaaaagttgctgtagactttgtgtccccagaaaatatccatgagtgtctgcgtttaactaaagagttccgccagcttcccaagaaccacaaggctagagaagataagctggagataaagaagatgatagtttatgccgttgatcaagctgtcaaagacttacaagatttactggagtgttcttgattggcttgcagaaagctcattntgccgtggttgatgatacactagattgctgtgaatatnaacagtgtccagatagaaaattgtgaagtctgatgtttatcgaggattagagtccggatagaaaattgtgaagtaggaatctttatttggagatcagaggcactcataaattgatgtttnccatttgtattaacatagtgattattggtatactacatttagacaacattttagaaagttgtaacagtacggccacaggaattatgaaatattgtttcctggcaagaaaaan

SEQ ID NO: 1656 - DNA, 139 bp, Glycine max
ttttttttttttttttaataagttcattggatctcaagcatgctttgcagttgcaattaccacggcacacaggacatgcctcagcaatataatcctctttcaaatgaggataccaattttctatacagtggaacacaaa

SEQ ID NO: 1657 - DNA, 923 bp, Glycine max
  misc_feature (67)..(67): n is a, c, g, or t
ctcctcccaccccccccccccccccccccccccccccccccccccccccccccccccgccaggtacngtcaagtagatagatacggcgcgcgcgccattaaccctcactaaagggaacaaatgctggagctccaccgcggaggcggtcgttctagaactagtggatcctccggtctgcaggagtcggcacgagggttcattcttccttgcaccttcttctttgaagatcgaaattgtgtttttgaaaaaatgggagttccagagaaagaccctctttcccaattgagtttgcctcctggttttcggttttaccccaccgacgaggagctcctcgttcagtatctatgccgcaaggtcgctggccaccatttctctcttccaatcattgctgaaattgatttgtacaagttcgacccatgggttcttccaagtaaggcgattttcggtgagaaagagtggtactttttcagccctagagacaggaaataccctaacgggtcccgacccaacagagtagccgggtcgggttattggaaagccaccggaaccgacaagatcatcaccaccgaaggtagaaaagttggcatataaaaagccctcgttttctacattggcaaagcccccaaaggcaccaaaaccaattggatcatgcacgagtatcgcctcctcgactcttcccgaaagaacacctgcaccaagcttgatgactgagttgtgtgtcgtatgtacatgaggaactcgagtgcacagcaggcggggcatcacggcgtcgcatcaagcataggacgacgctcatacggtaacggatgctgcttctggtttgaatacagaatcgatacatgcgggtttggcgttctgagactggtgaatggatatgagagtactgcttacgaggatccgtgagttgcgctggtcgatgagag

SEQ ID NO: 1658 - DNA, 960 bp, Glycine max
  misc_feature (21)..(21): n is a, c, g, or t
  misc_feature (383)..(383): n is a, c, g, or t
  misc_feature (839)..(839): n is a, c, g, or t
ggcgctgcaggaacggaatangtaccgactgcacagtgagcgcgcgtaatacgactcactatagggcgaattgggtaccgggccccccctcgagtttttttttttttttttttttttttttttttttttttttttaagagaagctatctcacgcattgatttcctaacggattaagtatcgtatatattgtagctggcacaatgactagatgccatatagttacagtattagtttatgaattgtcctagcaggaaaaagcaggaaaacaaaatccaaaggctaaagagtaggctatataaactacattttggcaaaggtgcttccaaccgtacactaagggttgagaagcaagggtaataatattaaacatgatagaagaagntcagactattagtagtctaaagaccccacagttgttatcccagtgcttaaatttcttgggtcttgacggctcacatagtcatcacagatgccattagagagcctttgatttggaaccgagttcaacagctcaaggccattgttgcccatttgctgcacttcctgaggagaaagtatctttatgcaccatacactatttacgaattccggccaggggccatcaccaaggagaagaacatcattctctcggtctacaaatacaagctgccagcctgatctcacagggtcctccaactcgccttcaggccaaacattcgacgagtcaccacgcagctcatggtagctgtgaattgtgatatcaatgaccttcaaagaccctgacttataaccttcccaaaagtttgttcatggtttcttgcctgatcttcccgacatgaaggaaaacgagtcgcctatntggtgtgatccttgtccaagaaaaacacccccccgtgagatcaaatattaaaaatgatattggcaggggtgggttatccgtaaccccttagggtgaatccattaggctgaaaagggaaagg

SEQ ID NO: 1659 - DNA, 918 bp, Glycine max
  misc_feature (1)..(1): n is a, c, g, or t
  misc_feature (23)..(23): n is a, c, g, or t
  misc_feature (717)..(717): n is a, c, g, or t
  misc_feature (732)..(732): n is a, c, g, or t
  misc_feature (742)..(742): n is a, c, g, or t
  misc_feature (813)..(813): n is a, c, g, or t
  misc_feature (918)..(918): n is a, c, g, or t
ncgcacagcctgctgaatttcgnctgcacgcacctaaccctcactaaagggaacaaaagctggagctccaccgcggtggcggccgctctagaactagtggatccccctggctgcagctcaggtggaaaacttgggaacatcacaatcaaatgtgtctgaacttgctgctttgcctccatttcctggaagagaacattctgcataccatggcgctgctgatcctcagagcaatcttttatttgggattaacattgatccctcttctcttatgctgcaaagtggcatgtcaaacctgagaaatataggcaaagtgaacgattcattatcgttgccattttctacttcgaattgtggtggtgctacaggcactgatttccccttgagttcaaacatgacaacttcaagttgtgtggatgaatcaggcttcttgcagtgttctgaaaatgtagaccaagcaaatataccaactggaacctttgttaaggttcacaagtcagggtcctttggcaggtcactggacatttctaagttcagcagctatgatgaactgattagtgagcttgctcgcatgtttggccttgaaggccaactagaggaccctaagactcagagatcaggctggcagcttgtatttgttgaccgggagaatgatgttcttcttcttggtgtgatccttggcaggagttgtgaacatgtgtgtacataaaatactatctncactagagtgcacanatgggcaagntctagtcttctactctgcccagtgacaactttctactctgcaactctgtgataatattgagtaacagagtngagagtcaaaacggatgattcaatgggtttactctaggcacctccagtccctgtaaggtatagtgaaaattgtggggaattaggtcagttctaagatgatggccn

SEQ ID NO: 1660 - DNA, 313 bp, Glycine max
gaaatacagcagcttcaagaagaacaagaactacaaggcacagccagtgatgatgatgatgatggtgatgaagatagcagtggattcttgaatttctcaattgaatatgatgatgtagatgcttcttcttctagcaaccactcacccacacacacaccacagcacttgtaagtttgcatgctcatccacatgcacttttttcatggttcctcaatgaaaaatgccttttttgtttttcaattgtaaattgtatttatttgtttgtttgtttgttttattaacaatgttgatgaaaagctaaaaaaaaaaaaaa

SEQ ID NO: 1661 - DNA, 468 bp, Glycine max
ggtttttttttttttttttttttgaaaaaataataaagggaaaacaaagaataaagggaacaatcagagaggtacatatatgtaatctgaacaaagaatgaaggaaaaacaaaagaaacatatgaccatgttttcatcatgtatgtgaatgataagaatatgaatccggataagttgatgttgaaatgggtggtgaggggtaacatgtacaccttgggtcatgaattaccttcttcttactgatatcaagctttgaacacaacacacaataccacccttgaaacctttgatggaccaaactattttgatcctcattgtaatcagactcctcttccatgtccgagttattttcttcagtatcttcctctgcttcatcatcatcagtaggtatccaagtcaaaccaaacattggaagaatgacaaggagaattttatcaattttatggttgctccattttttcagtctct

SEQ ID NO: 1662 - DNA, 795 bp, Glycine max
  misc_feature (1)..(1): n is a, c, g, or t
  misc_feature (647)..(647): n is a, c, g, or t
ncggtgagggtgtcgggggtgcgcgcggcgcgcaattaaccctcactaaagggaacaaaagctggagctccaccgcggtggcggccgctctagaactagtggatcccccgggctgcaggaattcggcacgaggaaaaggtccaaagtcactttgcaatgcttgtggaattcgacaaaggaaggtacgacgtgccattgccgccgctgcaacgtcaaacggaacaaatccggtggaggctgagaaatctcaagtgaagaagggaaacacgttgcatagcaaagggatgaagtccaaaactgagggtgcacaacagatgaaaaagaatcgtaaactcggagccaggtatagaaagaggtttggtgcttttgaggatttgacagtgagattgagtaagaacttcgctctccagcaagttttccctcaggatgagaaggaggctgcaatcttgctcatggctttatcttatggccttcttcatggctttcccacggatcgttatatcacttagatttatgagatattggttgtggaaccataattattgtatgagaccaatgcttagtgttatgctagatttagtgaagttaattaattagtatggaaaactgataatatagggacaataaagttatgaggagggtatcgntttatcaagttaattgtatgttgcatctgaaaaagaagaccaacacaaaatactagtgtcttattgttcatgatcatgagtatcctatattaatctcaataaatatttaattaaaatttcaagagattttatattgtaaaaaaaaaaa

SEQ ID NO: 1663 - DNA, 874 bp, Glycine max
  misc_feature (1)..(3): n is a, c, g, or t
  misc_feature (687)..(687): n is a, c, g, or t
  misc_feature (702)..(702): n is a, c, g, or t
  misc_feature (710)..(710): n is a, c, g, or t
  misc_feature (792)..(792): n is a, c, g, or t
nnnaattgcttgtcatttgtaccctcactaaagggaacaaaagctggagctccaccgcggtggcggccgctctagaactatgtgtatcccccgggctgcaggaattcggggcgagattcaatatacaacactgaaactttcaaagctcttttgagaacttgttattgcaatggctgacatagatcgctcctttgataataatgtttctgctgtttctactgagaaatcaagccaagtttcagatgttgaattttctgaagctgagaaatccttattgccatggtgtataatcggtgggagaggtgtctttgattgctggaagaattcctggaagaactgcagaagagatagagaaatattggacttcaagattttcgactagccaatgatcggtggcagaaaacgaagcaaggaaatttttggtgcctacaagtcattacagtgactttgtggggatatgaaatggaaattgatcctattaatcatatgggtacttatatttgcattttgcggtaaccaacaaaaaggggcatgccattctaaaagcccttatgtgtaatgttacttaattttatctttgtaatgttcccaagtgttttaggcaatctatgattcagatctgctcgatcatggcaagaacagtatgtacttaattaatgcagatcacctgcatgtgcatgtgtaaanaaaaaataaataaanacaatatnattaataatcactccgagggggggccaggaactccaattcgccctatagggagtcgtattacgcgcgctcacttggcgtcgntttacaacgtgtgactggagaaaccctggcgtaccccactaatcgccttgcagaacatcccctttcgcagctggcgtatagt

SEQ ID NO: 1664 - DNA, 1234 bp, Glycine max
ttcattctttttgccttgacatgaatcaaaaccagcttcagccccttcctctccttagtagcttcttaggttcatctcctgaagaatctttgctacaaaaccaaaatgaaaatcctaatgcatgccatgctcaagttgaggatgttacagtggccttacacataggcctccctgaccattcaagtggctccaattccaccaataatcatggatttgtgaatgccacaactcaagttcctaacaattactggataccaactcaggagcagatcctcattgggtttagccatttctcttgtcctgtgtgccacaaaaccttcaaccgctacaacaaccttcagatgcatatgtggggacatgggtcacagtatcgcagaggcccagactcactgaaacgaacccatccacggcccttgttggaccttccatgctactgttgcgcaagagggtgcaagaacaacatcgagcacgcacgtgccaagcctctgaaggattttcgcacgcttcagacacactacaagaggaagcacggttccaagcccttcacgtgccgcaagtgtggcaagcctctggccgtgaaaggtgactggcgaacccacgagaaaaactgtggcaaacgatggctttgtatctgtggttctgatttcaagcataagaggtcacttaaagaccacataaaagcctttggatttggtcacacccctttttcttctttttctgatggtatgtaattaattaaacatgcatggcacaaaacttattatatggctcctttagtgttgttggttgtacagtttttcaatcagaattcaagtttcaacttcatattttgcataattatttaacgcaaattttaattatgcaagttatcgaggtgtgaaactgactttgatcgaagaacggtacaaacatgcactttattataacgacttatcttgtcttaatttctagtacttagacaatttaagggtgatctctatgttgttatcaattaataatgaagaggaatgagtttttcttaagttatgttactgtgttagcatttaaatagagaggaataagaagggagacagggtaaagaaactgagaatttgattccaatttattgattccctggttgccttttctgcttcaatatatgtaattagtttgttctgtgtgtgattaaaaagtgaacaaattctgaaatctcaatggacttcttcttatgctagaaaaaaaaaaaaaaaaaaaa

SEQ ID NO: 1665 - DNA, 969 bp, Glycine max
  misc_feature (9)..(12): n is a, c, g, or t
  misc_feature (25)..(25): n is a, c, g, or t
  misc_feature (27)..(31): n is a, c, g, or t
  misc_feature (64)..(68): n is a, c, g, or t
  misc_feature (70)..(71): n is a, c, g, or t
  misc_feature (78)..(78): n is a, c, g, or t
  misc_feature (110)..(110): n is a, c, g, or t
  misc_feature (774)..(774): n is a, c, g, or t
  misc_feature (783)..(783): n is a, c, g, or t
  misc_feature (797)..(797): n is a, c, g, or t
  misc_feature (803)..(803): n is a, c, g, or t
  misc_feature (903)..(903): n is a, c, g, or t
ggggaattnnnnaaaagggttaccnannnnnagagtgagcagtaggcgtacacgaacgggaggnnnnngnnggagctncatccgcggaggcgtgccgctctagaattagnggttctctccgcgctgcaggatgtgttggttaggaatgaacacaatattgcgattcgtagataagtacataaggaataaaaacattgggatcgattcagaaaggtccttccctttgggaagatcgaaaagatcataaacaaaagttacactaatttaaaagggaaaaaatttatatatatagatgattaattaaaggatgaaaaagaagatccacatatatatatggagctacatagctatagctaaccttgccatggcttttgagactgcttctgctgatcatggatgcaatttccaatgccagcgatggtgagaatatcagcatgagagaggggcctaagacccaagaaatctctggtcaacccttcattaatattattcccagctgcaccacttgtttttgagaatgtgtcatgcaaatacaagttatgatcatcatctagtttctttgagctctgaatgaatgcatcctcaaaaggtgttccttcataggcagaaggagaagagacagagttgataacatcgtgaagaagggatggtgctgaagaagacacagcagcagcagcagcagctttattccccaatggtgatgatgatgataagccatggctgaacactgtagcagtgttagcattagtagttgttggtgacggggtggctggntgggtggtntcacgcgatgacangttcancgcatcatgataccacgtgacatgatggtggtgcctgcgcatggctgtgctggacacttctgttatgctcgactatctacctctcttgcagcatgagggntgactgtgtgatatgcctgtccgtagcgcatgatggaccagcctagggtgcgctctcgcgccgcgg

SEQ ID NO: 1666 - DNA, 931 bp, Glycine max
  misc_feature (1)..(2): n is a, c, g, or t
  misc_feature (697)..(697): n is a, c, g, or t
  misc_feature (753)..(753): n is a, c, g, or t
  misc_feature (931)..(931): n is a, c, g, or t
nnttggaattcgcaaatgcatgtgacgagcccaagctctaatacgactcactatagggaaagctggtacgcctgcaggtaccggtccggaattcccgggtcgatctatgcgtccgcgagatacgcatgggatcagtcacatgctagcgctcctccttcttcttctctctccggtggtggtgactcgccggaagacaccaacttccaccttcaacgccgccgctggtgaacacccttctcaaaatctcacctgacccaattccactttctcctttctcttctcaatttcccatctgggtatccctgtttccctcaaagttctcttcttttttcgtgattcagaagtgctcagtgataccctttgtttagaacaatgagagcagggaaagggagccaggaagaggatgagtacgaggaagaagagtttggttcttccaagaaacagggtacttcctctgcccctaacgccaacaaagatggaaaagccatcgacaaggctagtgcgataagatcgaaacattctgtgaccgagcagcggagaaggagcaagataaatgagagattccagatattgagggatctcatacctcatagtgatcaaaagagggacacggcatcattcttattagaggtgatggagtatgttcagtacttacaggagaaggtacaaaagtatgacaggtcatatcaaggttgcngtcaagagccccctgagtgatgccatggagacatagtcattggcgtgtccagagcnttgctggtcaacctacagctgtaaacgaatggttgggttcagtatcaccttctcctgtacagttgacgaaagcaatgctagtatctctccaactatgcttagtgcacccagaataccatagatccttatcagagcagggatattggtcacacgacggctgagaggcaccctgattagn

SEQ ID NO: 1667 - DNA, 777 bp, Glycine max
  misc_feature (5)..(6): n is a, c, g, or t
  misc_feature (741)..(743): n is a, c, g, or t
  misc_feature (761)..(763): n is a, c, g, or t
  misc_feature (776)..(776): n is a, c, g, or t
gtaannaagctaaaaagtatttaccctgtttcgcaatgacttgtgtacaaattttcaaaataaaaagccatggaaacaaactgctttttacaagcctaatccataaaaaatcctgatgcatcaacttttttacagaatcttatacgtgccacctttactatatattgaaaagtcagactgaaggcaatttagcagttcaaccacggaatctttactggatccattgaagtgttccaaaacatcgctcaatgtagccccttcatcaaggttcttcaaccactctacaacagaactctctgtagccttcaatttagttgaatttacttcctttgtttcactgactttttgtcgtttgtttgtgaattccccctcacagactaatggaagcttctgtacctccgaaccattgacaggtagaataggcacctcatcaatttctaggtcccatttttccagagaacttttggcagagatgccgtcttcacaatatctttccacgtggcatgtttctaaagtaggatctgacaaatttgaagcattgtgtgcaggttcgtcatctttcccagtctggttacttccagattgaattgcttctaaggatattccacagtttcgcattgtcaaataagtcttgatgtgctgataacttatctcttctggcaattcattttttataggtttcagcttatctgtagatccaacttttgaaatagcaccctgaatttctgatatgatcccttnnntcagtcctatcatctcgnnnaatctagcccaanc

SEQ ID NO: 1668 - DNA, 916 bp, Glycine max
  misc_feature (1)..(3): n is a, c, g, or t
  misc_feature (603)..(603): n is a, c, g, or t
nnnaagagatgactgctgataggagccgcgcgcagttaactcctcactaaagggaacaaaagctggagctccaccgcggtggcggccgctctagaactagtggatcccccgggctgcaggaattcggcacgagcaacaatatcagtcagatttttcttttaccatcatcactcataatatatctccgagtgaaatgcttgctaaaaccaacgtgccccatgagaccttatctccacagaagattcaggtccaacatgttccaaaatgtgtgtccgataggttgctagagaagttctatgatgagtcagagttcgattttgattatgagcaaagtgggttgtggtctcctccagttccccgcacggtgttcttgagctcaccgggaagaatattcactgagcaagaaatgcttgaaagactcagaagcaaaaatgcaccaagacgtggcaaaagattcagagtttgtttcagtgtgttctgttgtgcctgatactgaatgtaaacaaaagtgggtaggtttttcagcaatgtttcttgttttagaatacaaagggaattaatccaaaaatttcctatgattattttatcatattcacaggaatntacatgtaaaaaaaaaaaaaaaaaactcgagggggggcccggtacccaattcgccctatagtgagtcgtattacgcgcgctcactggccgtcggtttacaacgtcgtgactgggaaaaccctggcggtacccaacttaatcgccttgcagcacatcccccttttcgcagctgcggtaatagcgaagaggcccgcaccgatcgccctccccacaggtgcgcagcttgatgcgaatgggacgcgccttgatcggcgcataagcgccgcgggtgtggggttcccgcacgcgacgctacactgtcacgccctacccc

SEQ ID NO: 1669 - DNA, 804 bp, Glycine max
gggggaccgtgtgtagcggccgccggctctaatacgactcactatagggaaagctggtacgcctgcaggtaccggtccggaattcccgggtcgacccacgcgtccgctgcgactcatccggtgctcttaagcaaattggagaggaacccttcagtgagttcatgaagacagcaaaagattgaccattctgacggattcaaacaacaaagatagtagaagggtttggatcacaggaactcgaaatgctgaacatggattggatgctgcatcaaataagacaggtcctctcagtatatttgcttaatatggtgtggcatggcatcggagacattgtttttagatatgaaaagttgaaggacatagttattactcagttgtaagagatgctaatatgaactgaaaattccatcaatattggcgtctttgttttcgatgtccatttgtagaaaataatgattgttcctgtatgatggacaatgactattctaatattaattaattaattaacctaaaaaaaaaaagaaagggcggccgctctagaggatccaagcttacgtacgcgtgcatgcgacgtcatagctcttctatagtgtcacctaaattgcattccctggccgtcgtttgacaacgtcatgactgggaaaacccttgcgttacccaacttagtcggcttgcagcacatcgccgtttcgcccagtggcgtaatggcggaaaaggacggaccggatcgccgtacgacaagtgaccaagtagaatggcgaatgggacggtgcctgtagcggagcttgagcgcggcaggttgtg

SEQ ID NO: 1670 - DNA, 850 bp, Glycine max
  misc_feature (11)..(11): n is a, c, g, or t
  misc_feature (748)..(749): n is a, c, g, or t
  misc_feature (779)..(782): n is a, c, g, or t
  misc_feature (796)..(800): n is a, c, g, or t
  misc_feature (809)..(813): n is a, c, g, or t
  misc_feature (816)..(816): n is a, c, g, or t
  misc_feature (819)..(820): n is a, c, g, or t
  misc_feature (822)..(826): n is a, c, g, or t
  misc_feature (846)..(849): n is a, c, g, or t
tttctataaanaacaagtacatggacagagcgctaaggtaacaacagctataaagaaattacaataaagattcaaacaatggttctatctacaagaaggatatttcaatatccaaaaatatatcctaataaaggtgaaacttgcatagtcacaagagcctccaatattgcaaactatagactataccagcaaatgatatttagctggctggctgtcctactcaattccaccgttcatctctcctcgagtctaattcttcaaacttccatcaagcatggatcctctttggggattttctccctttcgctgattttgttgtagcatctgcaaaagcttgtgcagcctccgcatcagcttctgctgcctctgcttcctttgctgcctcctctgcttctgcaatggcggcttctgcttcagcaactgctcgagcagcaaatgcagctgcctcttgtggagtcatagaccttatcttttctaactctaaatctatctgagatctagtaaggatgttggtctcatccctgtcaattttcatagaggctttctgcctcccttccaaatataacacggatgagtttcttcttctgtcagaatatgctgctataggtgcaattctatacttgcgatttaccttgatcagttttccacttgctgtcaaaaactttaattttgcagacaacatactttttaagcctggcagtgcccaatattggtcctctatgaaagctgcaatagctgtcttattagnnccaccattctccttcaagcaagtgatcgcnnnnattataagtttatnnnnncttaaattnnnnntcnttnnannnnnaatatgcaccatatctctannnnc

SEQ ID NO: 1671 - DNA, 876 bp, Glycine max
  misc_feature (712)..(712): n is a, c, g, or t
  misc_feature (788)..(788): n is a, c, g, or t
cccccccccagcgcggtcgatgacgtgcccgactgcattacgacaagcgcgcaattaaccctcactaaagggaacaaaagctggagctccaccgcggtggcggccgctctagaactagtggatcccccgggctgcaggaattcggcacgaggaagggttgacccgcgagaatgtcgcaagccatctccagaagtatcgtctctacctgaaacggatgcagggtctctccaacgagggtccttctgcttcggatcagttatttgcgtcgacacctgtgcctcagagcttgcatgactctgctcctcccagtaaccatagcaatggtcatggtcatgggcatggccatagcaatggccgtggtcatggtcatggtcatggtcatggtcatctctctgttccgatgatgtccatgccatatccacctcccctgatgtccatgccatatccacctcccatgatgtcgggcatgccccatggccacatgggcatccccatgcctaattcctccggcacctcagcttaccatccttataatatgttgcatcaaagggattggcctcaccttgctcctaatgataaatgaacctataaggtcagccatcaccatcatatgcaaaagattcaaaggcttgattattggtagtatagctttctgagaagggaggagctgcattgatgattaccctgtaattcactcagaaggattattgangaagtatatgaagaagagtatatggagctagattacaatcttagtcagtagtgtgtatcctgtgggagatttacanacttattgtacacatctctaattcctgtcacctattgtatgacgagaattctggcttatttcctcggtctgcctagccgctgattcaa

SEQ ID NO: 1672 - DNA, 740 bp, Glycine max
gaagacctaagactagtagtagtaacagcgcgcgtattactacatcactatagggcgaattgggtaccgggccccccctcgagaaagtatacatacaagtttataaatataaaaatattgaaaatgcacaaaatgtgaaatcacaaaatcattttattttgccataaaaatgatgattatttgtgaagatggccaaaaagacaactattatgcacaccaaatgcataatatatgaagatactgccaatattaattatctaataaggacaccaaataaaatgcttgaactgcttaaaatgcacttttaaatttactggtagccaattcgttagcgtggctcattatcgttgcaatttacagcactccaacaattcctcagtcaacattttcactaggtcgtacgtgtccactgtcatgctgaattcatggtccatcatagcaatgctggtaatgctgagagcggaattcccaaaaggtaagacattgctacacactatgcatagattatgagcttcaagcttggccagtagcttaagtacaatgtccttttgcttctcacacgttactctgatgagaacatcttttgctgagactcttgcttcaactgtacgacattactttataggtatatcatcacaggttttgtttattttgaaacatcctaatgattccgtctatctcttcttgttctcttgttccagatctttcacatgctgctgaagatatggcacatactcttt

SEQ ID NO: 1673 - DNA, 1730 bp, Glycine max
ctgttaatcagatattagcttgatagcttcagctgtttttcattgcatgaggagttctcatatggagatttcatcaatcagagggctacctgaactggggataatagaggatcctaacttcctccatcagtggcagttaaactctattgatacaactagcttaaaaggtgctgcttttggagatattttgcaaaagcactcattctctgataactcaaacttcaaccccaaaacatccatggaaacatcacaaactggaattgaaagatatgcaaaacagctcggtgataacagctggaatcacaacaaaagtcaacaacagacaccagagacacaatttgcttcatgctcaaatcttctttcatttgttaatacgaattacacaagtgaattgggactagtgaagcctaaggtggagatggcgtgtcctaaaattgacaacaatgctcttgcagacatgttgatctctcaaggaaccttaggaaatcaaaactatattttcaaggctagccaagagaccaaaaagattaaaacacgtcctaaactttctcaacctcaagaccacataatagctgaaaggaagcgaagagagaagctcagccaacggttcattgctctatctgctcttgttccgggcctaaagaagatggacaaagcttcggttcttggagaagctataaagtatttgaagcaaatgcaagagaaagtgagtgctcttgaggaggaacagaacaggaagagaactgtggaatctgtggtaattgtgaagaaatctcagctatctagtgatgccgaagactcttcttcagagactggtggtacatttgtcgaggcactacctgaaattgaagcaagattttgggaaagaaatgtcctcataagaatacattgtgagaagaataaaggagtcatagagaaaacaatcagcgaaattgagaaactccatctaaaagtcatcaatagcagtgccttgacatttgggagtttcatcctggatataaccattattgctcagatggatatggaattttgcatgacagtgaaggatcttgtgagaagtttacgctcagctttttcatatttcgtgtgaagagttatgcatttttcggtcgtccccgaaaggtacatgaagaataggagtgcaatcaatttatatatagcagttccatatatcaactatattatcaagtttaagttcttcaataataattctgtttccaaggccggtctgcaatgtctgccatccacaccatgtttgctctgaggttcatttttgcagaagggttttttgtagcgatattttcttcttgcatggtcaacttgttgacagtgttatattgtcacactcacaccctactgtttcaagagtgaacgtagagcttgttaggcattttttggcaggaagttggaaagttcaactacctgttttccatctatttcttacctaaatcctgacagacaggcctttgttgagtgacttattatcttcttttttttttttcaagtgttctcgagttacttttttatttgaaacaaaatatgcttgtaaaagtttggttgaaattggtagtgatggaataatcgtacttttttatatcttgtgtatatgctcgacatgttgcatggcctcaacatgatattctgcaaaagcattaatgctaccaatttaagcatatgtaaattgtaggtggtggattaagcttaaaaaaaaaaaaaaaaaaaaaaaaaaa

SEQ ID NO: 1674 - DNA, 777 bp, Glycine max
  misc_feature (8)..(9): n is a, c, g, or t
  misc_feature (710)..(712): n is a, c, g, or t
  misc_feature (717)..(719): n is a, c, g, or t
  misc_feature (721)..(721): n is a, c, g, or t
  misc_feature (752)..(754): n is a, c, g, or t
  misc_feature (773)..(775): n is a, c, g, or t
ttgctttnntctaagcactgcgagcatgccttaatgttacattcaaaatcataaaacaaactatttgaggtctaacaatttaaatgaaatcttgtgcatgctctttgtgctcatgatatattgttcgtaaatcatactatttcaaattaaagtatgtagcaatagcataatacctaacatggcacgtttgcacaaattattttagacagaccacagataatttgaatttaatagtagggacgatatgttgtaatagttacaaatataattagggtacaaagatgcaaaccaatacataaagtaagtgctgatattgataacgttaatttcagtaaaattggagctcatattttgcaaaagaagatgaaatcttcagcatgtgattgattgttgttgcccatgtcttgtaacgacggaaatcatctgccatgtctagcttgaaaacgcctcctcttgttgttaaaacgatcagataacacgtatcagcttctgaacctttatacagatccgcatgcagagtcatcacaacaccctccctcttgcttttgaataggttatgcttcctcatcataagtacaaccttggcttcgctgtttaggattacagacactgatctaggcatatacttcccttcgggtgtttctacatataactcagcaccctgtgcaagaattgatctgcctttttcaaagtcaaaatctagatcattnnngtctnnnanggggcagatagggacgcccccattcaatctnnncttgcatcctgatcttacnnnaa

SEQ ID NO: 1675 - DNA, 917 bp, Glycine max
  misc_feature (1)..(1): n is a, c, g, or t
  misc_feature (41)..(53): n is a, c, g, or t
  misc_feature (56)..(57): n is a, c, g, or t
  misc_feature (59)..(59): n is a, c, g, or t
  misc_feature (543)..(543): n is a, c, g, or t
  misc_feature (564)..(564): n is a, c, g, or t
  misc_feature (652)..(652): n is a, c, g, or t
  misc_feature (684)..(684): n is a, c, g, or t
  misc_feature (755)..(755): n is a, c, g, or t
  misc_feature (785)..(785): n is a, c, g, or t
naactgttctcatctgctaactatagggaagaggagggggnnnnnnnnnnnnnccnngntgctattgacgaaagttggatagattgaaaccaattacccaatatcaaagggtagtgatattggtgatttcaagtgcaagacttgcaatagaaggttctcttcttttcaagcccttggtggccatagagcaagccacaaaaaaccaaagctcatggtcacagatctttcgtgccatcaagagttaccgaacccaaccatgaaacaacaacctaggatgcacccgtgtccgatttgtgggcttgagtttgctattggacaagctttgggagggcacatgagaaagcatagaactgctattaatgatggcttgttgtgtggtaaaccttcttcttcgttgtccatcttgaaggaatcatcgaaagatggtgatcaaaagttgaatttgcgcttggacttgaacttgacgccattggaggaggatgatcttaagctcaacctaaggacgcccgtgctcaattgtttcatttgattggaaattaattntgtactaaaccagattctttntttcttattaatatagttaatgtgtatttgtcgtaatttattattatacgtacgacctataggtagctcattttgtagtcatattgtngtcataatacgaaacttcttagtcttatacanaaaaagcttattcctttagtgagggtaatttagctggcactgccgtcgtctacacgtctgactgggaaacnctgcgttaccacttaatcgctgcagacatncccttcgcagctgcgtatagcgagaggccgcaccgacgccttcccacagtgcgcagctgatgcgatggacgcgcctgagcgcgcattagctgcgcgttgtgtgtacgcgcactgacgctacatgctaggcta

SEQ ID NO: 1676 - DNA, 737 bp, Glycine max
  misc_feature (1)..(3): n is a, c, g, or t
  misc_feature (22)..(22): n is a, c, g, or t
  misc_feature (25)..(25): n is a, c, g, or t
  misc_feature (38)..(38): n is a, c, g, or t
  misc_feature (718)..(718): n is a, c, g, or t
nnnaaggagggggggttttatnaanaaattcgcacgcnatgatcatgccaagcgcgcaattaaccctcactaaagggaacaaaagctggagctccaccgcggtggcggccgctctagaactagtggatcccccgggctgcaggaattcggcaccaggagaactagtctcgagttttttttttttttttttcaaggggcgccgccctcccccttaccactcttttccaccctctttccactgcacaccaagccaatctcgaaaagaaaaagtacactcgatcaatccaaacaaaaaagtggacacacaacacataaaagatttccttgttctttttactgcttaaccgttcggctatctcatatatgaacaacaacatgttaggaatgaagagacggagagatgataatgaagggtccttggatttggcaaaatgtcttatgctgttttcttgtccaatagaaagcaacaagacacaacagaaaagttttggttctgtggaatttgagtgcaagacgtgcaaccgcaagttctcttcttttcaagcactgggagggcacagggcaagccacaagaggcagaagctggagggggaagaactgaaagaacaggccaaaagtcttagcttgtggaacaaacccaaaatgcacgagtgcttcatttgtggccttgaattctctctgggcaggctctgggtggcacatgagaaacacagagctncctcaacgaggggttcctt

SEQ ID NO: 1677 - DNA, 792 bp, Glycine max
  misc_feature (1)..(4): n is a, c, g, or t
nnnnaagatgatgactgctgtaggatccagcacgccagcgcgcaattaaccctcactaaagggaacaaaagctggagctccaccgcggtggcggccgctctagaactagtggatcccccgggctgcaggaattcggcacgaggcgaattggaccagcctctaataaaaaccctagcactcagtctcagccaaaagcatcatatcagaatcctcaaggggcacagaacgagcatgatccaaataataccactatttttgttgggaatttggatcctaacgtcacggatgatcatctgagacaagtttttgggcagtatggggagttagttcatgtgaagattccagctggcaagagatgtggatttgtccaatttgcggacaggagctgtgcagaagaggcactgcgggttttgaatggcacacttttaggcggacaaaatgttcggctttcatggggccgaagtccttcaaacaaacaggctcaaccagatgcaaaccagtggaatggtagtggtggtggtggatactatggatatgcgctaggaggcaatgtagattactgctatgccgctgctgaactggatacgaatatgtatgacatatgtcctgtctgtgcgatatgccatccgccccggtcaccccgatcagtcggatatagctatcagttgtcgcacgagtgtccagatctactcggatagtaagctatgctaatgagcgtgtgcgtgctttgtcctgtcgtcgcgtgaacactatctctggttggtctcgtatctgtgctgtaacctcacggct

SEQ ID NO: 1678 - DNA, 749 bp, Glycine max
  misc_feature (5)..(6): n is a, c, g, or t
  misc_feature (593)..(595): n is a, c, g, or t
  misc_feature (653)..(653): n is a, c, g, or t
  misc_feature (655)..(656): n is a, c, g, or t
  misc_feature (658)..(659): n is a, c, g, or t
  misc_feature (670)..(670): n is a, c, g, or t
  misc_feature (674)..(675): n is a, c, g, or t
  misc_feature (697)..(702): n is a, c, g, or t
  misc_feature (704)..(707): n is a, c, g, or t
  misc_feature (715)..(716): n is a, c, g, or t
  misc_feature (739)..(742): n is a, c, g, or t
cgttnntatcatgtgtaaatttcaaaaagcaaagacagctgtgaagggaaggaaaaagcaaattttatctacacatgttttgtctttctcttcctgacaatggaagctgaaggttccaaaccaaagagtcaaaggggttccaaatatatacggtgcaagcaaactcacacaaccaaaattacgaaccagttagaaagggcagatacatgtgttatgtgttaatttccagtccacaaagttactcagaacatctaagtgatggaattacattggaaaatttccttctcagctcagatagatctacactgtcggaattgtcaacctcacactgcaaactgtggagtaatctgccattgactttggttgaaagacaactaacaacttcaagtctctcttctaacactagtttaagtaattttgaaagtggaacctcttcctcactgaatccactaatttcaatccccacagctccaccactattctgatggatagtgaaaccactagatacatgcttgcaattctcatggccttcaggggtggaatttatggagggtttcttcttcagcttatccctcttgtcactcaactctttnnnattcttctgaaggtgatttatgtaattcactgcctcgctcatttgatcagatatggancnntnncccttgatganccgnncagggacaaggcatctaacagnnnnnngnnnnccacccanntcttgcctcctttgcctttccannnncgtatca

SEQ ID NO: 1679 - DNA, 531 bp, Glycine max
gtcaggaaaagctgtgggaagataatttggtccgttggaatcttggagaaggttattttacgttggcgtcgaaaaggtagtggtttgcgtggatttaaaccggaggccaattctgagggaactatgatacaagatgtatcttcaacagatgatgactatgatgtcttaaaagaaggcaggaagcaaacagagcaaaggttgcagaaagccctagctagggtgaagtcaatggttcagtatccagaggcaagagaccaataccataggctgttgaatgttgtaactgagatccaagaaaatcaggtaaagcatgagagcagttataacaattcagaagaaccgagagaattcggtgacctcaacgatcttgaagcattgttggacgaagatattttcatgcctacagcaacttagaagttagctttcattgttcattgtatgactttgaatttcacagcagagttaggtgatcaactgtctcactttgattgttatagtaaattagcaatcttaattctcaaaaaaaaaaaa

SEQ ID NO: 1680 - DNA, 702 bp, Glycine max
  misc_feature (12)..(12): n is a, c, g, or t
  misc_feature (36)..(36): n is a, c, g, or t
ggggtgtgtccnttaacgactctgtagtaatcacgnccagctctaatacgactcactatagggaaagctggtacgcctgcaggtaccggtccggaattcccgggtcgacccacgcgtccggaactaaacactaactggatcaaaactaaagggtattcttccggcgattgtattgtatattgacgctcacagatttctgggagcgacagttgcaacttcgattcgacttgaagagagggaggaaggtggaaattggcaaattataagaatacgctgaaatgtcagcgcttttcaatttccattcatttctaactgtgatacttctgggaatatgtgcctgcacttatttcaagatgcagtttccggcgatccttgaccagaaaactgggtttcgtggtttcttctggaaggcggcaagaataggtgaacgtttaagcccgtgggtagctgcgggttgctttatgatgggcgtttcaataatcttcttctaagttttgttttactcaatagggcgtccgttctatgcttgaccgcagtttgatatgcaaaattcagatttctaaattcaaattatttgcagatctacaaaatgagagcttgtacttttgatttcattggagcccctgaaatcatagagttagctatctattttttttcgttgttgaaacgaattggagttttgccattaatccccaagtttaa

SEQ ID NO: 1681 - DNA, 783 bp, Glycine max
  misc_feature (668)..(668): n is a, c, g, or t
cccaggaggtcgacgcattagtagacacaatttaatacgactcactatagggaatttggccctcgaggccaagaattcggcaccagatgtcaagccttattgtcttgaggaagttgatgccgttagcccaaacgcacagcatgccatggtggctggttcacatgaatgccttgttctccagtaacaaggctatgaacaaattcgtagtgattatgaactaaatattgcttgccatgttacgtttcagttctaataagtgtagtaccttatattatggtccagttactggagtctgaagtatttatgtgttaaggacttaaataattgtggtttgtattttattatatggactcgctgtacggtgcttgattgtccttcgtggtctatgtaaaaatacaatgactgttcttctgagccttgagaaaagaaaggaaaaaaaaagagagggaggaggaggaaggggagagagaaaaataggctgcgccagagactaattacctatagtgagggtgaattgtagcttggaactggcgcgggtataacaagcggcgtgattgggaaaacgctggagtaacccagctaattacgcttgcagaacatgcgcgtgtcgccaagtggcgtaatagagaaaaggcccggaccgatcagccttcccaacagtggctcancctagagtgcgaataggaacaggcctggaacggagcattacacacagaggaagtggtgttaacacacaaggtaagacaatcacatgagagagagcgtaacgcgacgtgatgattt

SEQ ID NO: 1682 - DNA, 812 bp, Glycine max
  misc_feature (1)..(1): n is a, c, g, or t
  misc_feature (35)..(35): n is a, c, g, or t
  misc_feature (696)..(696): n is a, c, g, or t
  misc_feature (716)..(716): n is a, c, g, or t
  misc_feature (751)..(751): n is a, c, g, or t
natgccatctcatcaatgatatacactaggggggnttggggatggggcccggggggggggggtgcgtccgataaaacccgtatcattcacacgcctctggggggggcgttttatcttacccagaggaggagatgcgggggttcctacaccgaatgcaaaacccacaaagccctctcctcttcttgggatttcatcaaacatctcttctccaccaagtcctgcaaaaccccaaacaccgccaccacccaatcctcccctcaatccaccggcaccaccactaccaccaccgcctccgccgccgcagcaagttctttaatttccttatcgcaacccgacccggataggaatcaacccgtttcgtgccccgaatccggcatctctaccgacaccaacctcttcttccctctccgcaacgacatcttcccctgcactgcgtgcggcgagattttccagaagccccacctcttagaagcccatcaaaccctcaaacacgcggtttcggatctacccggatccgacccgggtcacaacatcgtccaaatcatcttcaaatcgggttggcccgaatccaagccattcccaaccataacccgcattctcaagatccacaacagccgcaagatcctctccaaattcgaagagtaccgcgaggccgtgaagtccaaggcggcgcgtcacggcgcccatacgcgccgncgcgacgagcgctgcatcgncgacagaaacgagctcatgcgctgtcactgctcgnacttgttatgcgacttgggacacgacggggatgccgcgattggcggcgcaggtgtgtacac

SEQ ID NO: 1683 - DNA, 962 bp, Glycine max
  misc_feature (729)..(729): n is a, c, g, or t
  misc_feature (772)..(772): n is a, c, g, or t
  misc_feature (808)..(808): n is a, c, g, or t
  misc_feature (918)..(918): n is a, c, g, or t
aaaaaaaaccccccccccccccccccccccccccccgagagtgttgatcggctgcttgaaggcgacgccaagcgcgcaattaaccctcactaaagggaacaaaagctggagctccaccgcggtggcggccgctctagaactagtggatcccccgggctgcaggaattcggcacgagcagcaacaatatgatgagaaaaacatccgccgaagggtctatgatgctctgaacgttctcatggcaatggatattatttctaaggacaaaaaagaaattcaatggaggggccttcctcgtactactgtgaatgatattgaagaactaaagacagagcgtcttgggctcaggaatagaattgaaaagaaaacagcctatctgcaggagcttgaggagcaattcgtaggtcttcagaaccttattcaacgaaatgagcagttatatagctcaggaaatcctcccagtggaggtgtatctttaccttttattttggtacagacacgtcctcatgcaactgtggaagtggaaatatcagaagatatgcagcttgttcattttgatttcaatagcactccttttgagctgcatgacgacaattatgttctcaaggcaatgaaatttggtgagagaccactggaagataatatgacacataatcttactgatggaggtgaaggttctagcatgtcaggcttgtgtcatgccgcagctcctacaattctacatgtgtcanacaggcctacaacatcactcctctccctgcatactaaaggcangagttaaagcagagcattactctgtacggtatcatnatatcgtgtctatgtaaaagcatgttcgtatattttgtagagaaatttgctgcagctgatagaccgtcataatacgtattcatcaggtcagcccaagtcattctggaggntagaagcagatcgggatatccttctttgctaaggggagactttg

SEQ ID NO: 1684 - DNA, 943 bp, Glycine max
  misc_feature (1)..(2): n is a, c, g, or t
  misc_feature (639)..(639): n is a, c, g, or t
  misc_feature (650)..(650): n is a, c, g, or t
  misc_feature (707)..(707): n is a, c, g, or t
  misc_feature (921)..(921): n is a, c, g, or t
  misc_feature (925)..(926): n is a, c, g, or t
  misc_feature (928)..(928): n is a, c, g, or t
  misc_feature (930)..(932): n is a, c, g, or t
  misc_feature (939)..(939): n is a, c, g, or t
nnaagtgcgtttaaaattaccccctgggagcaatcaaccctcactaaagggaacaaaagctggagctccaccgcggtggcggccgctctagaactagtggatcccccgggctgcaggaattcggcaccaggtgcatcagttcacacgtggattaatctgggagcacgaacctttcctcacacttggctgcaagagattacgccctcttgctcccaagcttcccaacaccaaaactatcactacccctttcgatctcaagagcttcatcaggcccgaaagtggccccagaaaacccgtttcctctgacgacactaagaaggatccaccttcaccccaaggccagattgaaacgcacccaggagggacacggtggaatcctacgcaagaacagataggcatattggagatgttgtacaaaggagggatgcgaactccgaatgctcaacagatagagcagatcactgtccagcttggaaagtacggcaagatcgaagggaagaacgtgttctattggtttcagaatcacaaagcacgcgagagacaaaagcagaagcgcagcagccttgcatcttctcatagtcctcgaactcccacaattcacagtgttgtactttggagacaacaagggggggagtggangagaggacacngaggagatagtcgtacaaggagagtgcaggagatgggattgactgcttgaagaacanacatgcatcaactgtgaacagaggacatagactcttgacttttcattgacccgaaggcgattgaagggggtggtgatgctttaatatattttacttggctagtcgaatcgagtgataatggatggatgtgtaatatgcttactttctttttttgatgggaagaaggaacagggcttgacgctcttctttatgtttccgcttgaccaaaaaaaanaaannanannnaaaaaanaaaa

SEQ ID NO: 1685 - DNA, 920 bp, Glycine max
  misc_feature (1)..(1): n is a, c, g, or t
naatgttcctacgtataatcaacggtcacgtagagggaataagctttttttttttttttttttcttttcaagaagaagaagaagacccattagttccactcccgttagtcccactatcattctcgtactcgttcacatcatgggaagcgagattgtggttgtggttgttgtcgccgctaccgttaccattaattccgctgtgttcatgtccatgttcggggacatgaacaccggttctaacggtggcactcccaacagctccatccagagaaatcccgttggcgctgacactcagagtgctaccgttaccgttgttaaggttgtcttttttcgcgagagtgttcttgttgttgtgcatccacactttgagaacccctctttcgacgccaatttccgtgcagaactccttaaccatttcaatcgtcgcgcttgtgcatctttcacccaactttgtcggcgaactcatgcatcttctccttttgttcttgggtgaacttcgttcggaagcgtttacgcgagtggttgtgcgccggtgccggctcgccggtgttttcccgcgcgacggagatgccaccgtcgtcggagagggcgaggagcatgtggtgggcggaggagtaggatgagatcgtcgcgcggatgcggagtctgactccttgctactggtccgtgtagacgtgatgcggtggtgtgctgcactctagctgcattctggtcttacgccataattctatatgagtctattatatcgtaatcatgtatagttgttcctgtggacatgtatctgtacattccccaacatacatccgatcctaagttatgcctggtgctcagagtactactccattcatggtgtctcctgccgtttcatctgataactgctgcagcttataatgattgctactaccggtaagtgttcggta

SEQ ID NO: 1686 - DNA, 375 bp, Glycine max
tgttaacggttctgcggagtggttttgttcggaactctgatcgtggaatgttagggattttacgagatggagagcccatgggagaggaaatgtgattcgccgcttcagccgtcgacgtccgccacagttctgtctgcaccgccgccggagacggtaactcgacgtgctcttctgttttgcttttgtttgagctatttctttcggtgactgtgattacttgtgcgtttcgtgaatgctcttatgtaaatgtaaatgcgtcgtgtaatcgtttgttagtttgttttgatatatcgcgttgttatgcagtgtactgttgcattgttcgtcggcgttgacaacgtaacatttacgtaattttattattttaccattttt

SEQ ID NO: 1687 - DNA, 940 bp, Glycine max
  misc_feature (39)..(44): n is a, c, g, or t
  misc_feature (53)..(53): n is a, c, g, or t
  misc_feature (60)..(60): n is a, c, g, or t
  misc_feature (64)..(64): n is a, c, g, or t
  misc_feature (67)..(68): n is a, c, g, or t
  misc_feature (727)..(727): n is a, c, g, or t
  misc_feature (795)..(795): n is a, c, g, or t
  misc_feature (885)..(885): n is a, c, g, or t
aaagtatcccccccccccccccccccccccccccccccnnnnnnccccagtgnccaaacngganaannaccaggtggtggaccgcgccccccaccctcactaaagggaacaaaagctggagctccacagcggaggcggccgctctagaactattggatcccccgggctgcaggcgtcagcgacatccaatgcgacactgtgaaggaggagaatgcaataacggaggagctatcagagtggcaggacagtgtgagcgagatgatgggcccaggtgcgaacatcaacgacaagatcggacggctggtatgcatcataaagaaagcagatgatctacggctgagaaccttgcggagtgtggtggggctactgtcgccgcagcaggctattgagttcttgattgcatcggcggagttgctagttgggatacgcggttggggattgaatcatgaccgtccacgtggcagatgaaagtggaattgagtttaggccacaatttctctattttgattgaaattcattgtggccttaaaatgattgtgtattatttattactagttactagaactagaacagtccttgctgaacaaatatttctttctgctgattaaaaacaacagtccttcgctattaggctgcagcctaatccaaaaaaaaaaaaaaaaaactcgagggggggcccggtacccaattcgccctatagtgagtcgtattacgcgcgctcactggncgtcgttttacaacgtcgtgactgggaaaaccctggcgttacccaacttaatcgccttgcagcacatncccctttcgtcagctggcgtaatagcgaagaggcctgcaccgatcgtcctatccacagttgcgcaggctgaatggcgaatgggacgcgcnctgtagccgcgcatttagcgcggcgggtgtggtgttacgcgcagcgtgacgctaa

SEQ ID NO: 1688 - DNA, 858 bp, Glycine max
  misc_feature (664)..(664): n is a, c, g, or t
  misc_feature (761)..(763): n is a, c, g, or t
  misc_feature (770)..(770): n is a, c, g, or t
  misc_feature (773)..(823): n is a, c, g, or t
  misc_feature (826)..(826): n is a, c, g, or t
  misc_feature (828)..(829): n is a, c, g, or t
  misc_feature (831)..(831): n is a, c, g, or t
  misc_feature (835)..(836): n is a, c, g, or t
  misc_feature (842)..(842): n is a, c, g, or t
  misc_feature (850)..(851): n is a, c, g, or t
  misc_feature (855)..(858): n is a, c, g, or t
ccgagtgatagatctcttgttgcataccccacgcgcgcaattaaccctcactaaagggaacaaaagctggagctccaccgcggtggcggccgctctagaactagtggatcccccgggctgcaggaattcggcacgaggtgattcgtcttcgtcaagcggtatttacctgcccctaacagtctttggtttgtagttgaagctatttttctatctagaaataacctaagtttgatcgctgttgcagattcggattcggggagttcctcagggagtgattctgaagcagacaacgggcactcgtagtagtcagtgggtttttggaactaatggtcatgtagatgaagaaaatgcttttgcttcattggcttcctttgagggcgtggctcgaatacatggacgaggtatgctcatttcatttgatgtattatttttttacgctgtgaatattgtcgcagatggatatgataggctaaatttgtgattacttttcatttcagggattgtgaccgttgtttgttggttcgttttgggagtagcggtttgcattgtggcgctgtccactccaggatttgtgtgtgacatatttgtacaaacaatttcgggaaccgaagtaatcatcaaaacaatttgtaggccagaaagtgtagacttaaatgtgggaaantctaggatagatcgttaaaaataggaatagaacttgagattagtgttttgagtttacctgtacacattacacagtaaatagaatggagatccttgannnaaaaaanaannnnnnnnnnnnnnnnnnnnnnnnnnnnnnnnnnnnnnnnnnnnnnnnnnnaanannanaaannaaaaanagaaaaannaaannnn

SEQ ID NO: 1689 - DNA, 985 bp, Glycine max
  misc_feature (8)..(8): n is a, c, g, or t
  misc_feature (17)..(17): n is a, c, g, or t
  misc_feature (79)..(79): n is a, c, g, or t
  misc_feature (146)..(146): n is a, c, g, or t
  misc_feature (674)..(674): n is a, c, g, or t
  misc_feature (852)..(852): n is a, c, g, or t
  misc_feature (985)..(985): n is a, c, g, or t
cacccccnccccacccncccccccggacacaaacaaattaggatcaactcatacaggcgacgggcgcgaataattgtgnctacccgcaacaaaagcttgacctccaccgccgaggcggacgctctagaactagtggttttttcgcnctgcaggctcggaatggatccgtgggacaacaattccatcgccttttctgcaacttcaaccaagcgctccaaaaccaacaccaatgatcctgacattttacattccctgaattcggcctcggaatcacaggtcaatcttccacatacaagtctggaaatgtcaaccgtggacaagctattgcacattcctgaagattctgtcccttgtaaaatccgcgctaagcgaggatgtgctactcatccccgtagcattgcccgaggggagagaagaacaaggaaccagggccaacctcaagaaataacaggaccttgtacccaatatggataagcaaacaagctatgcacacatgctcgatttggccgttcaacacattaaaggtcttcaaactcaggctcagaagcttcacacagaaatggagaatcgcactcgcggatgcaaacaaagcaaataacctctttgttttacgagattctatagcaacgcgcatagaactcaaggacttgatggcacagattgaaaactgactntgcaccgatctacttagatgaataatgacggaactgaaactttgtaagctgtccatgctacaactgtacagcgcatgtcggcatatcgtacgctcagagaatctcctcgcttccttcagcactcggcgttcacaaacaagacacaatactcgagggggggctcggtactcatttcggnctatagtgacgtcgattacgcgcgctcgactgccgctgtctacacgtcgggactgtgaaactctgccgtacccaactaatcgccttgcgtcatcctcctttctcagttgggtataacgagaggccgcaccgcn

SEQ ID NO: 1690 - DNA, 653 bp, Medicago truncatula
gtgttttccgggtgtgaaaggaatctctcttattgttccatccggttggcaactgttttataagttttcattttcataatcataatcatagcatatatgagtatatatatctctcaaagataagataggaactagctatattatatagtttaattagttacatgataggtattaggtaggtagggtatggaagaagaagatagggaatattgttgttcgatgaattcaagaacaaccaatagccctatagctatagatcataaaaataacaataacaataaggggatgaaaaaagagaaaaaagctatgaaaccatatagaggaataaggatgagaaagtggggtaagtgggtggcagagattagagaaccaaacaaaagatcaagaatttggttaggttcttacataacacctattgctgctgcacgtgcttatgatactgctgtgttttatcttagaggtccttctgcaaaccttaattttcctgaattgttgttcaaagatcaacaagaagatgaagaaaatctacaacaacatgggaatatgtcggctgattcaataaggaaaaaagctgcacaagtttggtgctaagagtttgatgctatttgaaactaattctctaattaatcatcatcatcatcaatcatgtttcc

SEQ ID NO: 1691 - DNA, 771 bp, Medicago truncatula
ctgattcgccagctcgaaattaaccctcactaaagggaacaaaagctggagctccaccgcggtggcggccgctctagaactagtggatcccccgggctgcaggaattcggcacgaggcctcgtgccgaattcggcacgagggagaactagtctcgagtttttttttttttttttctgttttttttcttcttcagattcagttgttgtaaccatgaacacacttgttcgcaacaccactctcaccttcagcaggagacaaggttatgagcttcttggtttacaagggaaagagaaaacactcaaatcagtcagctacagacgcagaagagccaaacaaaggaaaatctttctcacaacatacaaattatcttctttgaatacttttgtagaacagcctaaaagacctaagataaaaagggttgctgttaaggtcaagaaaattgttaactctgttttgttgtttatgaaaactggttcttttagatcaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttggcaacacatccccctttccgccagctggcgtaattagcgaaaaggcccgcaccgatcggcccttcccaacagttgcccaacctgaatggcgaaatggcaaattgttacgccgttaattatttattgtataaaattacgccgtagaa

SEQ ID NO: 1692 - DNA, 664 bp, Medicago truncatula
  misc_feature (586)..(586): n is a, c, g, or t
atctcatacattaatacccatgatgaaaagacaaagagaaaacgaagaaaaagagagcatagatttagcaacaactctaatgttactatcttctcgtataacccaacaaaacaaaacatattctccagttgagtttgagtgcaaaacttgcaaccgtaaattctcatcttttcaagccctaggtggtcacagggcaagtcacaagaagctgaaacttcttgattcagaagaagcacacaaagtgaatattcataataataagcccaaaatgcatcaatgttcaatttgtggacaagaattcaaacttggtcaagctttgggtggacacatgagaagacataggattaataatgaagggttttcatcttcttcaataaattatcaagtgatagcaaaatcttctcctgttttgaaaagatcgaatagcaagagagttatgatcatggaattggatttgaatttgacacctttagaaaatgacttgaagttgttgtttggaaacaaggcacctaaagttgacaattctttgttctgattttagtctcactaactttttgtacattataattctttcaattatatttgnttgtagtaacatttattgggttatgtattttaaaaaatatttatgatttattgcatttcatcggacttgtaattaaat

SEQ ID NO: 1693 - DNA, 801 bp, Medicago truncatula
cgttgctgggaaatgatggtgttgaagtgtaaccttgctgtgaactctctccaacaagtttttggggtccaattattcatccatgtttccaacatttggaggtggtgtcttgtgtgccaaggcatcaatgatgctgtgaatggatttgtcgatgatggtagttcgtatagaggggcatgcattctccccagaagatgttgcactggcacgtgatatgtatcttttgcagctttgcagtggaattgatgaaaattcagttggcgcatgtgctcaacttgtgtttgcgcctatagatgaatcctttgcagatgatgccctcttactgccttctggttttcgagttattcccttggatcctaaatcagatggtccaaccacgtcaagaactttggatttacttgaaggatctaggaatgctcgtccatctggtgaaggtgctggttcaaatggatacaaccttaggtctgtccttacaattgcattccaatttacctttgagaatcatttgcgcgacaacgtggcttctatggctcgccagtatgtgcgtagcgttgtggcatcagttcaaagagttgccatggcaattgcgccctctcggccaggtactcagctagggccaaagtctcttcctggttcgccagaagctcatgctttagcacgatggatatctagaagctacaggatgcacactggtgccgagctttttagagtcgagtccgcagcgagtgatgcaatactgaaacaactttggcaccattctgatgcaattatgtgctggtctgtgaaaacaaatgcatctcc

SEQ ID NO: 1694 - DNA, 483 bp, Medicago truncatula
tttatttgaatcgacccatcatttattccacttccatcaggtttgtcattgaatggcatttgtgggcatacattcttctcattggaacgctgaaaaaataactagaaacattttcaaacttaattgtgctttctattgatttctcttcgttcttatttggcagggttttgcatgccttcaaggtggtctttgtctctcaagcatggggagacctatttcatatgaaagagtagtggcttggaaggtgctgaatgaagaagagaatgctcattgtatttgctttatgtttgtgaactggtcttttgtttgacattgtttttagacaataggactccaagtggtgttaaagaggaagcactcttattaagacatgttcttttgcttgctattttgctatattcgctgcaaaaacttggattgcatgtaaaaactacttatatattagcctatgttacatttcccttaaaaaaaaaaaaaaaaaaa

SEQ ID NO: 1695 - DNA, 744 bp, Medicago truncatula
  misc_feature (603)..(604): n is a, c, g, or t
  misc_feature (606)..(606): n is a, c, g, or t
  misc_feature (660)..(662): n is a, c, g, or t
  misc_feature (680)..(685): n is a, c, g, or t
  misc_feature (703)..(704): n is a, c, g, or t
  misc_feature (706)..(706): n is a, c, g, or t
  misc_feature (712)..(716): n is a, c, g, or t
  misc_feature (718)..(718): n is a, c, g, or t
  misc_feature (724)..(724): n is a, c, g, or t
  misc_feature (726)..(729): n is a, c, g, or t
  misc_feature (740)..(741): n is a, c, g, or t
cccgggctgcgggaacctgtattggcttctttgagggttgagataacaaaagattccattcttttcttccactaaatatttgtcagttcagatcttaccctcaaagagagttcataatggtgagaggaaaaactcaaatgaaacgcatcgaaaatgagtcaaacagacaagtaactttctcaaagagaagaaatggactgcttaaaaaggcctttgaactttcagtgctttgtgatgctgaagtcgcactcatcgtcttctctaccacagggaaactctatgagttttctagttcaagtataagcaagacagtggaacgctatcaagggaaagtcaaggaactggttctcagcaccaaaggaatccaagaaaatacacagcatctaaaggaatgtgatatcgacacaacaaagaagttggaacacctagaactttccaaaaggaagctgttgggagaagaattgggttcatgtgcttttgacgaattacaacagattgaaaatcaacttgaacgtagcttaagcaaaataagggcaagaaagaatcaattgctcaaggagcaaattgaaaagctaaaagacaaggaaaggttacttcttgaannantaaacgcttatgcaagcagtgtggaattggacaaatgattgtttaataaacaannngaagtgtgcatgacgagnnnnnngagacagaattgttcatnngncgaccnnnnnangaatgntnnnngagctgaaccnngca

SEQ ID NO: 1696 - DNA, 611 bp, Medicago truncatula
tttagacacaaccctttattcctcctatcccttccttggttcattttttcttttatttttccaatttggtgcaaatctgcttccttttgttgctgcaaagaaaaggaaaaaaaatggtgagaggaaagacacaaatgaagcgtatagagaacgcaacaagtagacaagtaacattctcaaagagaagaaatggtttgttgaagaaggcctttgaactgtcagtgttatgtgatgctgaggttgctcttattgttttctcaccaagagggaggctttatgaatttgctagctctagcattctagaaacaattgaacgataccgcagtcataccaggattaataatactccaacaacatctgaatcagttgaaaatactcagcaattgaaggaagaagcagaaaacatgatgaagaagattgaccttcttgagacttcaaaacggaaactcttaggagaaggtttagggtcttgttccattgatgaactacaaaagataggaacaacagtgtggagaaaaagcataaacaaaattcgagtcaaaaagactaagggtttttcagggagcaaattgatcagtctaaaagaaaaggaaaaagccctagttgctgaa

SEQ ID NO: 1697 - DNA, 537 bp, Medicago truncatula
tctcaagtttgtttatgttataattttaattctttccctatttcttgttgccaaggggggtggcagtaagcattttttttaaaaccattttcaaatttccttctttaatatttacttcacacataatgttttatatcattttattaacattattttattctcttctttcattgtagaaaaaatttattgtgaaaatgcggctagttgtccacgccttatgtatcctttagtttataagtgccttgacaacaaatgtgtaaagtttatgatgaagtcacgttttgtttgatataagtatatcgcgcccaagacggtacacaaacgccatgcaaggaggagtgagtccttgcactagcaaaaaaatctatgcaacataccttattgttgtaccgcgtgttgccatttaattttttttactagcatccaataattgtatcttttatatttttcgttttataacttcatggatgttaaaagtatgactctacattcagagatgttgataataaaatgaaattaggcactaaataatattat

SEQ ID NO: 1698 - DNA, 448 bp, Medicago truncatula
aaagggaaaatgtttaactgaagaattccgtcagcttcccaagaaacacaaagctagagaagataaacttgagatacagaagatgatagtttacgccattgatcaagctgtcaaagacctagaagctttactgaattgttcctgactggctgaatgttgcatgaagaaagctacttcatttttccttagtcggtgatcctccaggttgctgagagtgtaaactgcgttcgggatagaaatctttaaagtttgaatgcttcattgagaggttttaatggcattcacaatagagtttttccttttgtcaatgttaaattttagataaatttacaatgtctgtgtttattactatttttgcaataaaaaatgtaattaactcagaaattttcaagaaagtattaataattatggtattcataccaaaaggaaaaaaaaaaaaaaaaaaaac

SEQ ID NO: 1699 - DNA, 708 bp, Medicago truncatula
ttgatacacaatgtgcgtaattaatggtttaaccaagataagcaattaaaatgtcatatctcagtagacatcaaatcctaactgaattatacaattgagttttaacgcaaatgcttgttgcgtcatgccattcatatatcttgtattattattacaaatacagaatataggctatggtggtgcctgtgaggacttaacctggtaatagtattgagatgatgcattgctaccaggagtgaaacagagtgactggggaattgagttgattggttgtgtttgaaagattgcatttggtggaaaggtagctgaaatggagaatcctgatgatgctgcagaagagaattgtggtactggggaaacagtgccttgattatgcccttgccacccccagttggggtgtccttttgaaggatcaatgccaattctctctgccctttcctgctgattgggaaagaaactagaaaacgtggcattccacatgggaggacgctgttcagttacaaccagctttttcaaagacgggtcaccaataactgaattaacattagtctccatctttaaattccttccaggatgcatgttgtaagaagggacggtctgaaattgacaatatcctttgttttctttgggttcatgtcctggagtcgccatgcccaaattaaggtctcagatgtgactgccacctttcattatagctccccgtttcat

SEQ ID NO: 1700 - DNA, 646 bp, Medicago truncatula
  misc_feature (481)..(481): n is a, c, g, or t
  misc_feature (535)..(535): n is a, c, g, or t
  misc_feature (592)..(592): n is a, c, g, or t
gtttacaagtcagggtccttcggaagatcgttggatatcaccaaattctccaactaccccgagctacgcagcgagccttgctcgtatgtttgggcttgaaggtgagttggaggaccctgtaagatcaggctggcagcttgtatttgttgatcaagagaatgatgttcttctcctcggtgatggtccatggccggaatttgtaaatagtgtatggtgcatcaagatactttcccctcaggaagtgcagcaaatggggaccaatggtctagagcttctgaactcagctccaacccagaggctctctaatggtatctgtgatgactacactggccgtgaggactcaagaaatttaagcaccgggctaacaactgtggggtctttagactactgaatgttgtgacaacaaatactgtgaatttcttctcttgtattattattactcttctcaaaccctctgtaaagggtgggaagcggttcctanttgtagtttatagcttactcagatataagcctttctttttccagtttttaccgnctaaaacaattattgagctaaacacttagctatatggcatcttctcattgtagtttngtacactatattggtaaccttttggaactctatgtttgaagttacctctatttt

SEQ ID NO: 1701 - DNA, 272 bp, Medicago truncatula
gcacgaggctaatcatatgaggcttagattaggcagctttaagtctaggagcttttctcttgcagatctacaagaacatgatgaggtggaggaagatgatgatgaggacaatgatgaacaacatttggattaaaagtacaagtctgggtgtaattagtactgaacttttaatttcattttttgtatagatggagcttttaactttttttatttttgttcgtatcatagagggatcttttactttttaaggatataaaaaaaaaaaaaaaaaa

SEQ ID NO: 1702 - DNA, 611 bp, Medicago truncatula
  misc_feature (70)..(70): n is a, c, g, or t
  misc_feature (611)..(611): n is a, c, g, or t
cacgcttggtcgagttagaatattcggcccccaagcacgaatgtcgttctcggatccgcgcatgcacacngtttagattgaaagaagcattcactgcaagcaattacaaacccaaacacaagttccctatgcacgagcttattacatttgcgaatgatgtcgaagagaacttgtggtttggctggaaagagtcagatctgctcaaaggcgagcacactatttactgcttcgatgaacatcccaagggtctgcctccaactaaagtagcatatgacttgaaagaattcatcacgcacgtgtgtctcggagtgcgcatgcaagaactcggattgaagcgttacgaagagcccaaagacaaaccaggctttgctaacagaattcgcaatgctgtagaagatgacgcagagccagtcggtgatgaagacgatgattggacttcgagtgaagaggaagagggtgatgagaagaagaaggtagaggaacagacaccacaatgcgagccaatcaagcctctgttcactggtgacttcgactatccattcaaaatatttaagcctttctcgcagggtctcaattaaacaactattacaccaaaaaaaaaaaaaaaaacn

SEQ ID NO: 1703 - DNA, 788 bp, Medicago truncatula
gatgggatgaaccttcactcactcttgttcatccaacacagttgagtagagcataagcaatgaagatccagtgtgatgtatgcaacaaaaatgaagcttcattattctgcaccgccgatgaagccgccttatgtatcgactgtgaccaccgtgtccacccacgcccaacaaactggcttccaaacaccaccgtctcgctcttcataacccaactcccaaacaacaccctctctgcgatatttgtcaggagagaagagcttttgtgttatgtaaacaagacagagcaattctatgcaaagattgtgattcatctattcattcagtgaatgaacttacacaaaaacatgatagatttcttcttactggtattaagatttcaactacaaactcatcttcttcatcttcatcatcaacaccttcttctgctactaccaagtcaaatcatattccttcttcttctttgattgaaaaatctactactccttcaccaacatctatggaagaaggaagtggtggttctactatatctcaatacttgattgagactctacctggttggcaagttgatgattttcttgattcttcttctgttccctttgctttctccaagggtgatgaattgtttaatgctggtattgaagagaatcttgattcattctttcccaataataaatatgggggatatggggttccctcaagcaccaccacccttctctatattcatcttcacagataatgatggggcagagtgaaactaccaagaaggggagcaacaacaaaagcacatc

SEQ ID NO: 1704 - DNA, 211 bp, Medicago truncatula
atttcttggggcttaggccattgtcacatagtgatattctaagtattgcagggattggaaactgcatgaatgatcaacaacaacaaaatcaatctcaaaagccatcatggcaaggttaggtccaaatatacaagggaaagatattatggattttttgtttaattctattcatcttctatataaattttattctttttaaaaaaaaaaaaaa

SEQ ID NO: 1705 - DNA, 613 bp, Medicago truncatula
gcaccagcctcattatgatatcatgactagagtgcatatttggtatcaccgtatgtatgtcgaagttacagaggcatcgtgattttgtagaaactctataatatatatttttgcaaaattcagtgagcgtgataatttcaaaacaaccgttaatccaaacatgcactagatagtagtaatagtagtttatttcattgtaataagtaattaagttctttttaatttctatttttccttttggaagggtttttttgttttgtctttgagctctccaatggatgaatatagagataagagagggtattgagttaattccaagtaatgactcttaatttggttgtttttggttcccccccccccattgttttaggatgaagcagaagatgatgtatgattgaaaacagtgtcttttctttttcttattcttttgtcatgaacttatgataatgatggtgctgcctattgtaatagatggggaccggtttattatttctcacaaagattcccctcattgcatgtaaagtattagtatattcctttaatggatatgtataaatacagctatatattcaatcaaatttaggtgatattgcctaaaaaaaaaaaaaaaaaa

SEQ ID NO: 1706 - DNA, 339 bp, Medicago truncatula
gaaaccacgaagaggcaacactactcaacggttttgatggccataaacatggtgtaaggagtctgaatgcagttgttgattggctgcgcaatgcggttatctagtatatggttctttgaatatgatttggaataggggaatgtctccctcttccctaccaatgttctaaaatagaacctgattcttccctcacacttagatgttaatgatgttctaaaatagtaccttgaaaagggaattattttgttaatttctttcttcataaatatgtaccaagattgttccactcaatatctatgaagagaaaaaacacaaaatttcacaaaaaaaaaaaaaaaa

SEQ ID NO: 1707 - DNA, 784 bp, Medicago truncatula
ggtatggatgattccaactccgatgctgtttacggcaacggcagtgaaaatcctgaattcgcacttcaaagttttgatgaatctgatcagctggacgctgtcgtttcgtggtcaagtttatgtctttgattctgttacgcccgctaaggttcaatcggtgttgttactgttgggtggatgtgaacaacctaatgttggtgtgaatgcggtgcctcaacaaagtttgagggtggaatcaatggattttcctacaaaatatagtcaactgcatcgagaagcctcattacttaggttccggcagaagaggaaagaaagatgctttgataagaaagttagatatgaagtacgtcaagaagttgcactcaggatgcagcgaaagaagggtcaatttactacatctaagaaacaagatgggtccaatagttgtggtacagaccaggattctagccaggatgccagtccatcagaaatctcttgcacacattgtggcacaagctcaaaatcgaccccaatgatgcggcgagggccatctggtccaaggtcactttgcaatgcttgtgggcttttctgggcaaacagaggtgttttgagagacctttccaagagacatcaggagttatctactggtaccagttgagcagggttgatcaaagtaacagctcagactgtggaactgcaactatccctgcacacaacatcacccctattgagcaccatctactatttgctagtactatactgggtacttggtctgttgggatgcacagcctgtctattggatgca

SEQ ID NO: 1708 - DNA, 527 bp, Medicago truncatula
caggattcggcacgagcatctcgagtgtatactcccaagggctgttgaacaatctgactcaagcgctacagagtgctgggttagatctgtcaaaggccaacatttcagttcaaattgatcttgggaagcgtgcaaacaaagatccaagcggcacagcctcatctcccaagaatcatgataaccctctttgttgcaatcaatcatttgcacattttagagatggtggcaatagagaagactcagatcaagctcaaaaaagaatgaaaacatacaagtgaataattcatgtggctcttttatgagcctacattttcatcctcatttcttactttgtttctctcccttgttcctttgtggttactgtaaatccttccccatttgtttgagcttaattcctttcatgaaggttattttaaagctgcaaaatcctttactacataattatttgtggagatgattaggtttctgctctactgcttatgtcatctattttcattgtatccttactaaaaaaaaaaaaaaaaaaa

SEQ ID NO: 1709 - DNA, 690 bp, Medicago truncatula
  misc_feature (128)..(128): n is a, c, g, or t
  misc_feature (172)..(172): n is a, c, g, or t
  misc_feature (247)..(247): n is a, c, g, or t
  misc_feature (529)..(529): n is a, c, g, or t
  misc_feature (684)..(684): n is a, c, g, or t
attccatccaccgactcaaaaccacttatgtgcatgaagtctgagaatatttcttccgaggaaactcaatcttccaaagaagacgctgcaaatatgccacaaatcactagtattaagctgtttggtcnaacactctctatgggttctcagaagtcaatgaaggatgatgacnaaaatactaagttaataactatcaagtctaatgaaatggaggatgttgagaaggttggccaaaaagaggtatcanagccacttgatatacaattatcactaggcatctgtacacctgatggagctcaagtgagcagcatggaacggccgaaggagagtccatatgtcagcgagtgcgcaactttaccgttatggagtttgtaccaaggccttccagctttccacctcatgccatgcaatcatcaaattcttaatcctgtgcctcttagaccttgtttgaaggtaataacaagagaggaggaaagttcttgcactggttctaataccgaatcagtctgtgatatggaaaatcaaagcnagaacaactcatcagataccgatgattctcaaactcaaaaacatcgtcaggaaggagttgtccttaagaaatctggaagagggtttgttccatataaaagatgtttagctgaaagagatgaaaattctttaattgctggcttggaagaaagaganggacaa

SEQ ID NO: 1710 - DNA, 731 bp, Medicago truncatula
atgactagtttatcatacaatcagcattaagcttctagttatacaacttgaataaaaagatgaaagcttatattcagctgaatagggttaatgaaatttgcagcagcttgttacaattgcacagcaatttgcaggttaatattacaaaaatattattactatatttaatcaacttccacagtcagagaacacaaatgagttgacaaccttcatacttctatgcaatcttgcctccaaaactggtgcactctttcagaaatcattacgctttccaagatatttaatacctacattattcactgagattatcagcagaagtgtctgtgtcctcatcatcaccatcggcatcatctactgcttcctgtattttcgatatttcagcctgagccctatccaaaatctgcttcttctgcaactccaattccctattaaaatccaatctcaccttctccaactccatcatctgttgcctcttagtattctcaatcttctcatatatattcccaaatttctgaatcgaatcagccaaaatcctatatgaagcctcctcctcttccctatcgacatcatcctcgtcaccatcaaaatcctcatcctcatcatcctcagaactctcagactcgccaggactatccctcatctcatcaaaaccattcgacctattcaaataaaccctcgtattcataaacacatactccccagaatcaacaccacacgcaagtccatactct

SEQ ID NO: 1711 - DNA, 791 bp, Medicago truncatula
ccgagagacgatgatgttcgagtgtgggatgataaaagggaagagtctcatgacaagttaatgaatgttgatggtgctcaacaacaaggtcaaattgcagggttgaagttagatcatgcatcctcctcaaccacagaattggatagagggattcaaagtagcgatcattggactaatgtgatggattctagaattgggaaaatgcaaggtgaccaacaaaggtttaacatgaacaatagtccttattcaaatccacctatctcaatcaaccaaaatggtgatggctgcataatggattctactcctacaacttatgatgatttatcagagttgaataactttggtgttggtggccatgtctcacttgcattggagttgaggaactctgaaagtgatggatttggtttgtccaatgatgacatcaataaaaggcgtaatcaagcaatggcttcttcacctgatactgatttgttagactatcacttcacagacactggaaagcaacaacacaagtttgccaaccctcatttgttacatgagtttgttgtctgaattgaaagaactgtgtttggagagcgacctattgtctgcactcagcaatcccatgcattaacgcagttaccacatcaatggtcgcttggatcgagataaaacggtctagatttcgatacaaattttgatttttttttaagaaaaaaaactaaatatcagtttgaaatttcgatcatccgatcccgatccacggtcaatgttgtgatgactgcttgcatgcatgagaatggtggactgtg

SEQ ID NO: 1712 - DNA, 806 bp, Medicago truncatula
actagttttcttattcaacatcaatgcattgcaaaaaattgcctgcagataaaatagaaccaatcatctgtaatattattattacaataagtaaatgaatatatctaacacatatatatacctatctgtatattttgtacgtttgtgaattacatcacttttatgaacaatgagggcaacgcgaatgaatgaatgaattaaaaaacaacagcatatggtttgaggaagtacacctttcagagataagatacctttagtaaaaaatgaaaaatatctttggtagattttcatacgacaaattcatgcaacagatgagtattgccaaacatgtgttgttgctttcctgaatctgtgaaatgatagtctagtaaatcagtactctgtgaagaagaaaccaatgtctgattattattattattatgtcttttatgaatggcatcgtcatcagatgtggctaatccatcgctttcacagtttctcaactccaatgcaagagagacattgttgtggccaccactctccacagttgtaaagttacccaactcttggagtgtatttccagatgaaaaattgcagttcatttcagaaccaccgaactcttctttgtatatttcttcaaccattggtttccaaagacgcacacgtgcattaatgaaccaatttgccacctgattccttgtcaaaccagtttgcctagctagcattattttctctgaatccttggggtaaggattaagaaaatgttcaaagagccaagcacgaagtattgaaacagagttttcgggaagtcctctctgaagtctcca

SEQ ID NO: 1713 - DNA, 528 bp, Medicago truncatula
attgatggtcaattgctacatacacccccaaagcctaaaacacatgagtgttctatttgtggattggagtttgcaataggacaagctttaggtggccacatgaggagacatagagctgcaaatatgaacggaaataaaaacatgcacaattctaataatactatgagttgtagcagtggtggtggtggtgatagtagtatcgattcttcccaaaagatgaaagctagaaacaagagagttttggttttggatttggatttgaatttgactccctttgagaatgatatggagtttctgaagattggaaaggcaactgctaatttgattgattattttcattgaatgttttgaatacttcattatttgatttgagagttagttagtgtatcatagataaattatatcctttttattttagtctatagtttttttccttcatgaaatatagtctatacttatgtatacttttatataatcatactcaatgaaatttcgttcattaaaaaaaaaaaaaaaaaaaaaaaaaaa

SEQ ID NO: 1714 - DNA, 821 bp, Medicago truncatula
aaacataaacattatgaaggtgcatcaattacacgtggattttgggagcatgaaccttccctcacacttggttgcaagcgtttacgtcctcttgcacctaaaatttcttctaataacaccgataattctactactaacaccccttctctttcttttgatctcaagagtttcattagacccgaaactgctcccagaattagtctttcttcctctgatgataacaagaaagatccaccttcaccacaaagccaggttgaaacgcatattccaggagggacaagatggaatccaacacaagaacaaataggaatattggagatgttatacagaggtggaatgagaactccaaatgcacaacaaatagaacagattacagttcaacttagcaagtacggtaaaattgaagggaaaaatgtgttctattggttccaaaaccacaaagcacgcgagagacaaaagcagaaacgtaacagtcttggccttcctcatagtcctcgaactcccaccaccacacttgtgtctatgtcccccacctttagtactattacaactttggacaccccaaaaagggtgcaagtaatggaaagagatcaagaagatagcccattgaagaagagtaggagttggccatttgagtatttggaagagaaaaattggtcaatgtgcaaagtagaggaacataaaactctagagcttttcccattacacccagaaggcagatgaagggagtttgatctataacaatttttagctttttctttcccaaatgtgctttaatttgctttagtaatttcttctttcatttacattgggaaagaaga

SEQ ID NO: 1715 - DNA, 904 bp, Medicago truncatula
ctgattcgccagctcgaaattaaccctcactaaagggaacaaaagctggagctccaccgcggtggcggccgctctataactagtggatcccccgggctgcaggaattcggcacgaggggaggtggaggtggtgaccgtggttatggtggtggaggtggcaggtgatcgctactctcgtggtggtggtgctgatagcgagtggaaactggagggattagaaaattaggtcttcagtttggtggtttatgattatgaatgttgtcatgttgaattagtttgatttagttggttgaatttagtgttttggctatgatatttgttctgttatggtttagttttgctttgtcgtgtttttggtgctgaatctggttttgtataaacgattgattgaaaaggataatgaaaaattggattcaacaaaataaaaaataaagatggaaaagagtacaaggggaggaaatctggagggggggcccggtacccatttgtccctatagggagtgtcgggttgtacaatgagcactgagcccgtggtgtgttgtacaatcgttggtgaactgtggaaaacccttgagtcgcgttgacccagaatttgagtactggggccttgtgtcatcaccctttaccccatttttatccagttataagacgatcgaatatgcgcgaaaaagctcccaaacccaagatgcacagcctctcctcatatagtagtgttgcaatcatctgccctctttagtgatatatactattattatatatgatactgttattatttgtccatatatacacatatcgtatactaacagtttttattgtatgctgtagatattacttttattttttcggttcgtcattgctttagtgcgtcatattgcgattgattatatcagttattatatattaa

SEQ ID NO: 1716 - DNA, 528 bp, Medicago truncatula
tgcatgctctcttggcataaatggttcttatagtttatgcactttagactattgtggtgtatgtcaaattttgaggcatggtttttctactaacaaggaatttcaaggtgcattaggagtttacacaagttccacaagtggaaaagcctttgattcaattatgctatctgatgagagagcatttacaagaaaggcagttataatgtgtagagtaatagctgggagagttcattgtccttttgaagaaattcaagaaaaaattgattcaggatttgattcatttgctgaaaagataagtgatcattcaaatattgaggaactatgtttgttgaatcctaaagctctgctcccttgctttgtggtaatctacaaacaaaaatagatggaaattaaaaggttcaactcaagctcaaggataagtagataaagtatgtaggataagctatgctccctctctttttagatttttcagtcttttcatatatttatataaaatatgtattcaaagtaaaaaaaaaaaaaaaaaaa

SEQ ID NO: 1717 - DNA, 731 bp, Medicago truncatula
aaaattacaaatgtatgaatagggggttcatacaaattacaattaccatggacaagcacaagtgacttgacaaaaaagaatcaaaatccttcaaaagatgtaggccaaagaacctccatataaaagccaaaagtatagagcatgttctgaatcatggtaagttcgacgaaattacagggctaccgtgattttgttgaaactctaaagttctgccaaattcactgtgaatccaaacagcgtcaacactttgatcctgtttttgggctcatgatttgcaaattaccacaaaacaaggaagaagagctctaggattgagcaaataaagctcctcaatgtttgaataaagacctactttaccagccaatgaatcaaatccagtttgagatgccatttcttgaatgttttcaagtggcctatgaaccctaccagcaattaccctgcatactatcaatgcctttctaagtgaaggttcattatcaaaaatctctatagattcaaaagctcttccacttgtagatgttgtgaaaacacctatgccacctttcaattccttcttagcagaaaacccactcctaatgattctacaaacacaacattttttctgataaacaaagacttgaagagccattgagaccaagagaacagcaactgtggttccatagaactttaaaagtcattttcatcagctagacacctagggatgttcttctggagtttgcttgctttaattt

SEQ ID NO: 1718 - DNA, 854 bp, Hordeum vulgare
  misc_feature (226)..(226): n is a, c, g, or t
  misc_feature (634)..(634): n is a, c, g, or t
  misc_feature (753)..(753): n is a, c, g, or t
gttctgcaaagcggccgccctcctacgcaacgcccacgataggccgcccgctcctgccaagatccattacaactttccgctcctcgtccggtcgtggtggagccgtcaccaccgacatccggctgctttcctgccgacacacggaagcttgcagatgctccgctccgacatgctcggagacggcccgacccccgagcggtggcctacctcctgcggttcatcttcnaaacacaagaatatgaccacgagagggattctctgcctggcactacgcctgaccccgtcgtaattaaccagcctccgcaagaaaagttaagaaatcctcatcccgaattctggatgaatggccaagcacagcagtgcctatcacactacctcaaacgagcatgctcattcccgggaaaaatcatccctctacacgaaaaaacgctcaatacagcaggctatctctccttactggcacaacgatctgagaagaccaaataaaccacggcctaccaggggccccggaatacaatgtaagcaaggacgcagagataatcaaaccacatccacgcctaacccctatatgcaataagagatccaacaaaataacatagggcagactccttattcctcgcttatagtacctcanacccagatactgaacaaaccgcagcagtacaccatgccacaaatgcaccaaagccctcccgccaatacaacccaaagccacctaaaaatactagaagcactaccacacagtcacactgncacaagaatgcactacgctcctgggcataaaatccaccaggggacggagaaaaagcacaactctcctttgccacaaacccaaacgcgacataaaaaccact

SEQ ID NO: 1719 - DNA, 1540 bp, Hordeum vulgare
agacacaactcagatctcagagataaattatacagcgaatcatgaagttacaggtagagcttcaaagatgatcacgaaacgttcatgttacacaccaaatatgtcataatgcgtaggccataattcacaagcaccataataattcatgtctctcaagcaaatatatacatatacagagcaaaccacaccatcacaccgcatttctcagtcttcctcctcacatcgccgtaccagctagctagttagccgggagagaggggccggcgccgccgagcgagagagccggagggggcggggtggaggcagggcggagatggggcgcgggccggtgcagctgcggcggatcgagaacaagataaaccggcaggtgaccttctccaagcggcgcagcgggctgcttaagaaggcgcacgagatctccgtgctctgcgacgccgaggtcgcgctcatcgtcttctccaccaagggcaagctatacgagtactccagccaggacagtagcatggatgtgattcttgaacgttaccaacgttactcatttgaagaaagagctgtactggatccaagtactggagaccaggcaaattggggagacgaatatggaagtttgaagataaaactcgatgcactccagaagagtcaaaggcaactcttaggtgaacaattggacccactcaccacaaaagaacttcaacagttggaacaacagcttgatagttctttgaagcacataaggtcaagaaagaatcaacttctctttgagtcaatatctgagcttcaaaagaaggagaaatcattaaaagatcagaatggcgtcctgcagaagcacctcgtagagacagaaaaggagaaaaataacgttttgtcaaatattcatcaccgggagcagttgaatgaagcaacaaatattcatcaccaggagcagctgagtggagcaacaacaagctcaccgtcacctacaccaccgacggcccaagattccatggcacctccaaatattgggccatatcaatctagaggaggaggggatccagaacctcagccgtcaccagcacaagcaaacaacagcaatctgccaccgtggatgctccgcaccatcggcaacagatgaaggctggcgacagcctcatacgactccacctgaaggcgacaatggcgcctgacacgcgcccactatggaagctagctgccggtgtgcagtccatctccggcaatggcttccggtgtagccaccaataagaccatgtgtctttgctacagggtgaatggggtcttcctgtcttgagcttttcctgcactatagggagcagtgtcttgtttccacgtttcagttccctttttttcgctgatcgatgagcacgatcttgtggttggactttcgtgtgtaagctttaatggatttgcggtatggttttacacgttgacacggtttttgtattccatccgttgtaaaaatgcaaaagggcgctgccttctctttatattgttattaaaagagtagggcactgtacttcttgcaaaaaaaaaaaaaaaaaaaaaa

SEQ ID NO: 1720 - DNA, 1196 bp, Hordeum vulgare
ctctcccctcccacttcacccaaccacctgacagccatggctccgccacctcgcctccgcccgcgcctctgagagtagccgtcgcggtcgctcgctcgctcgctcgctgctgccggtgttggcccggtcctcgagcggagatggggcgcaggaaggtgcagctgaagcggatcgagaacaagatcaaccgccaggtcaccttctccaagcgccgctcggggctgctcaagaaggcgcacgagatctccgtgctctacgacgccgaggtcggcctcatcatcttctccaccaagggaaagctctacgagttctccaccgagtcatgtatggacaaaattcttgaacggtatgagcgctactcttatgcagaaaaggttctcgtttcaagtgaatctgaaattcagggaaactggtgtcacgaatataggaaactgaaggcgaaggttgagacaatacagaaatgtcaaaagcatctcatgggagaggatcttgaatctttgaatctcaaggagttgcagcaactggagcagcagctggaaagctcactgaaacatatcagagccaggaagaaccaacttatgcacgaatccatttctgagcttcagaagaaggagaggtcactgcaggaggagaataaagttctccagaaggaacttgtggagaagcagaaggcccaggcggcgcagcaagatcaaactcagcctcaaaccagctcttcttcttcttccttcatgatgagggatgctccccctgtcgcagataccagcaatcacccagcggcggcaggcgagagggcagaggatgtggcagtgcagcctcaggtcccactccggacggcgcttccactgtggatggtgagccacatcaacggctgaagggcttccagcccatgtaagcgtactattcagtacgagtaacaagttgcagcggccagcctggtgtatcatgcggttgcgaacatgctaaccccatggaggggagaggaaaagaaatcagagtaaagcagcaagctgcaggaatgtgtatatttcacttcgtccacctcagtttcctttccacctgggctgagatggctgtacgagtaatctaccatgtaatttatatgtagcatgagtgacgaattttcaactttcgatgatatccgttgctcctgggtgttgtttctgtgaattaacctatcgaatatgagcgttgtg

SEQ ID NO: 1721 - DNA, 1203 bp, Hordeum vulgare
cgtggcgcgcacagcagccgacacctagatcgtgaaatcgggatgggtcgcggtaaggtgcagctgaagcggatagagaacaagataaatcggcaggtgaccttctccaagcgccgcaacgggctcctgaagaaggcgcacgagatctccgtcctctgtgacgcagaggtcgccgtcatcgtcttctcccccaaaggcaagctctatgagtacgccaccgactccagcatggacaaaattcttgaacgttatgagcgctactcttatgctgaaaaggctcttatttcagctgaatctgaaagtgaggggaattggtgtcatgaatacaggaaacttaaggcgaagattgagaccatacagaagtgtcacaagcacctcatgggagaggatctggattctctgaacctcaaagaactccaacaactggagcagcagctggagagttcattgaagcacatcagatcgagaaagagccatcttatgatggagtccatttctgagctacagaagaaggagaggtcactgcaggaggagaacaaggccctacagaaggaactggtggagaggcagaaggcggccagcaggcagcagcagctgcagcagcagcaacaacaacaacaaatgcaatgggagcaccaagcccagacccaaacccatacccatactcaaaaccagccccaagcccagactagctcatcatcttcctctttcatgatgagggatcagcaggcccatgcccctcaacagaacatttgtagctacccaccggtgacgatgggtggggaggcgacggcggcggcggcggcgccggagcagcaggctcagcttcgcatatgcctaccgccatggatgctgagccacctcaacgcttgaggaaggaagaggtttaattgccaaagcagctgaaacagcattaatcggcacactagcaattaagctgctatggttatgtttgcttgcccctacccttatatatatgatttgcaagaaaaaaaatgagcagagagatcaggaatgctggttcgctgtataattttgttgcatgttcagcaacacgtaccaattgatgcaaacatgcatgcttagcaaccaaccaattaccttagcatggatgacttgcttggcttaattatggaaagctaggttgcatgatgacgtgtgtatatatatgatatatttttatattttatctgaaatctaacg

SEQ ID NO: 1722 - DNA, 633 bp, Hordeum vulgare
ggcacgaggcaaagctaccggttccatctgggggtcgagttatttagacaggcagatgaagctggggaatctttattgagaatgctctgggatcatgaagatgctattttgtgctgttctttcaaggaaaagcctgtatttacgtttgcaaacgagatggggattaacatgttggaaacatctttcgttgccactcaagacctctcgttggacaagatatttgatgaagctggtagaaaggcactatactctgagatcccaaagttgatggagcagggctttgtttacctgccaggtggtgtgtgcttgtctgggatgggccgccatgtctccttcgagaatgctatagcatggaaagtagtcggtgaggacaacaatgtgcactgccttgccttctgcttagtcaactggtctttcgagtgatcatcctcccaaggcaatccgtgcccgtcgcacgcagctccatttttgctctctctctctgtaagaactgaaccgctgccgctggaaagtagtttcatgctatctttaactagtttgtttgtagatttgaagagccagcatccggaagaattctgccttgagtaaatctgctcacatttccactaatttacccaggcaaagaactggctg

SEQ ID NO: 1723 - DNA, 397 bp, Hordeum vulgare
ggacaaggtgctggagtacgagcagggggggaagggcctcctgtgcgcggacctgatggccagcgtcgcggagcaggggttcgcgtgcgtcgagggcgggacgtgcgcgtcgagcatgggccggccggcgtcgtacgggaaggcggtggcgtggaaggtgctcgacgacggcggcgccggcgccgcccactgcgtgtgcttcgcgttcatcgactggtccttcgtttaggcgagggaccgatcgttgttgttgtagtcgccgtttgttgccaggtctcgggcgttggtgatgggcgcggtgcaatgcttggacgattatggtggtgttttgtacggcttgatggtgtgtgccgagaatcgtgatgctgtttgattgctttgtagtaaaaaaaaaaaa

SEQ ID NO: 1724 - DNA, 1501 bp, Hordeum vulgare
  misc_feature (7)..(8): n is a, c, g, or t
  misc_feature (57)..(57): n is a, c, g, or t
  misc_feature (588)..(588): n is a, c, g, or t
  misc_feature (620)..(620): n is a, c, g, or t
  misc_feature (690)..(690): n is a, c, g, or t
  misc_feature (799)..(799): n is a, c, g, or t
  misc_feature (859)..(859): n is a, c, g, or t
  misc_feature (877)..(877): n is a, c, g, or t
  misc_feature (901)..(901): n is a, c, g, or t
  misc_feature (933)..(933): n is a, c, g, or t
  misc_feature (1045)..(1053): n is a, c, g, or t
  misc_feature (1055)..(1056): n is a, c, g, or t
  misc_feature (1059)..(1059): n is a, c, g, or t
  misc_feature (1062)..(1063): n is a, c, g, or t
  misc_feature (1084)..(1084): n is a, c, g, or t
  misc_feature (1099)..(1099): n is a, c, g, or t
  misc_feature (1439)..(1439): n is a, c, g, or t
tggggannccgctttaaatcgaagcccgatggatactaacggaacaaggcttgagcntcaccggcggggggggccgctctagaactagtggatcccccgggctgcaggaattcggcacgagacttgatcagtgcttaccattgctttccagttctcatatgagaaccaccttcgagagagtgtcgcggcaatggcgaggcagtatgtgaggactgtggtggcatcagtgcagagggtggccatggcaatcgctccttcccgtcctggtggacagatcgaaatgaagaaccctccaggatcccctgaggctcacacgcttgcgaggtggatcggcaggagctacaggtttcacaccggggcggaactcctttgcacggagtcacagagcgcggacgcatccctgaaagcgctgtggcagcactcggattcaatcatgtgctgttccctgaaggcagctcctgtgttcaccttcgccaaccaggccggcctggacatgctggagacgacgctgattgcgctccaggacatctcgctggagaagatcctcgacgatgatggccgcaaggcgctgtgctccgagttccccanaatcatgcagcagggtttcgcgtacctcccangcggcgtgtgcgtgtcgagcataggggcggccggtgtcgtacgagcaggcggtggcgtggaaggtgctgngcgacgacgacgcgccgcactgcctcgcctttcatgtcgtcaactggtccttcgtgtagcagcttgtagccagcattagaagtgatgagccaccctcggctaccgttcngttgcaaactgcgtctccgaaaaacattgtgtgccgcgctcgtcgctttgtcttggtcangaatcagacccttcagtntatcatcatatcatcattcatcanaaaaaaaaaaaaactcgaggggggcccggaancaatccgccttatagggaggtattacccgccctcactgcccggcgttttacaccgccgggattggagaaacacctgtgggtaccccaatttatattcgttttggcaacaaannnnnnnnntnnggntgnnggggggggcggtgtgcgtctntccactcctcaccantgattaagacgcgtggtacaacgcgtggtcgtgctgctgtggtgtttatatacaaactgtaaaaaagagtatcgactcgtcgcctgcttctccgataagacagtagtctgccagaaaagacacgcccggtgtatgccctgcctactacttatatattaaacgttacgatcctgaagcggtacaccgttgtgacgtggtaagtggctttcatggcgaatcagaaagccgatgagatgctttactgtgcatctgggagatggctgatgcctgtgtcgatgcgtgcgtcatgcaacggattacacggactgtcgtactgacgcactgagtgtaaatgactaancccgatctcgctcatgcgcgggattcgttcgaaagagttgcgtgctctcgctctagatcgcg

SEQ ID NO: 1725 - DNA, 1048 bp, Hordeum vulgare
  misc_feature (981)..(981): n is a, c, g, or t
  misc_feature (983)..(983): n is a, c, g, or t
  misc_feature (985)..(986): n is a, c, g, or t
  misc_feature (995)..(995): n is a, c, g, or t
  misc_feature (998)..(998): n is a, c, g, or t
  misc_feature (1000)..(1001): n is a, c, g, or t
cctctcccacgcgctcctcgatctccttgctgcactgcacctgcagtcctgcacgtacataatagtgccccaaagattgattctcagtttctcgtacaagtgtccttccagttaagttcatgcctccgccgcgtcgatgcttgatcggagtggtttgacgtcaccacttgcttcttgatttgagctgagacagatcatatatatcgaggcgccagcgccatgccggactcggacaacgactccagtgggccgagcaacgcgggcggggagctgtcgtcgccgcgggagcaggaccgcttcctgcccatcgccaacgtcagccggatcatgaagaaggcgctcccggccaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctttggcaataacccccctcggtttgagaacttctcacccgttaatactacttccccaattccccaaatcaaggcaaaggcggttcttcacaacaccacaccgataacaagccgcgaccttcccaaatccaggacacattcccggggtccccgatcggagggagcccctccccccgcggaggttaataataggcttcccaggcaccccagtgggaagaaaaaagtttaaattgacaagcggtcccgaccctaggtacgtgggctaaatataaggggggggacctcctgttgttccaaaaaaaaatttgttcaggggagacacacccccggcggcgaaaataatccctgagtattgtggtgttcaaaaaaaagaaaaaagagggcggcggcgccggcctacggaatagatgtaccggcggatacggcacggcggcgaggacccgcgttttcggccggttgggtattcgaacagcggagtacaggtgcgttgcgcgcgcatgngnanngcggggggnggntnntcatactatagttcgggggcacccgggagtgtgcggctcagggcgac

SEQ ID NO: 1726 - DNA, 558 bp, Hordeum vulgare
aacggcaagatcgccaaggacgccaaggagaccgtgcaggagtgcgtctccgagttcatctccttcatcaccagcgaggccagcgacaagtgccagagggagaagcgcaagaccatcaacggcgacgacctgctctgggcgatggccacgctcgggtttgaggagtacatcgagcccctcaaggtttatctgcagaagtacagagagacggagggtgatagtaagctagctgggaagtctggcgacgtctctgttaaaaaggatgcacttggtcctcatggaggagcaagtgcgcaagggatgggccaacaagtagcatacaatccatgaatggtttatttgccaccttaataccattatggggacatctcaaactgaagatatggaccattctccgtgactggtgctgctcttctaaggggggtttcctcatttggagcagttaagggaactcttaataccctcattaatcctgtgttggtcgggctgccagaactgatgcttcaaggctgttttcccacatgtaaattgctttttcctgggaaatagattcaggtg

SEQ ID NO: 1727 - DNA, 571 bp, Hordeum vulgare
aaagcttggaggtcaaaattgacaaaagcctcctaggcatcagggcaatgaagactcggcggtttgaagagcagctctctgcgttgaggctcaaggagacgaagttgcggcaggacaatgaagatctgtatatccagtgccagaaggagcagcaccttgagttggaggcgccccctgctccggtgaccatggcggagcagggccaggacgacgcggttgaagtggagacggacctatttcttggactgcccggcaccggccgcccctgagatggagtctccaggctttggaggaaaatgcccagaataagctggccatggagttgcaagcagcagcaagcaatcgatgcggacggcgtatatagatataaaccctgtggagccgaaaccttgagagtacatacatgagttagttgatgtcgtcgtttccccgggtccttcctggccgtggtgtgccgatgtcttgatgagatgagaggaacaggacgatcctctggagaagaaagtggcggagaggggcgaaaaggatatttatggtgcccaaaaaaaaaaaaaaaaaaaaaaaaaactcg

SEQ ID NO: 1728 - DNA, 701 bp, Hordeum vulgare
  misc_feature (50)..(50): n is a, c, g, or t
gcgtgtaacagttctgaatgctttcttggttctatagaactttacagggncccatgtagtagtagctgttgttaacattctatcaccaactccgacaagcggcaaaccaaaaaaaattaaaacaagcaacgttcctgtaaaacccctagatattacacgaataattcagcggaaggccaggctctccttcggcgtgtcagcagcgtgccagaaaaatcatctcctctgtgaaacgacgaccacacaaaactgtagtagtatctagcacagccagccgttcatcgggcatatgcagatcacagatcgacacacaagggaggccggccttgcgatgttccttggcgttgtgttcagctttgtccagccgcttgtcggaagctgatgaggcccgaacggagcagcgcggcaggcaagcagcacttcgtatgcgccgtctacttgttcgggcagtctgatgctctgtgccctgattgcccgcatgtgaagcacgcgccactgaagcttctgtccctgctgccaaaggacgagccaccgcgaccaccgtatgacgatgagcgttcaccaaaggaggaggatctgtcaccgaaggatgacgagccaccacgcccaccataggacgagcggccaccgctgggggatgacgaacggtttgatcttctcgcaccaccacctgaaaagtcatcatctgaccaaatgtcgtc

SEQ ID NO: 1729 - DNA, 1387 bp, Hordeum vulgare
  misc_feature (984)..(984): n is a, c, g, or t
  misc_feature (997)..(997): n is a, c, g, or t
  misc_feature (1097)..(1097): n is a, c, g, or t
  misc_feature (1168)..(1168): n is a, c, g, or t
  misc_feature (1170)..(1175): n is a, c, g, or t
  misc_feature (1177)..(1177): n is a, c, g, or t
  misc_feature (1183)..(1183): n is a, c, g, or t
  misc_feature (1212)..(1212): n is a, c, g, or t
  misc_feature (1266)..(1266): n is a, c, g, or t
  misc_feature (1306)..(1306): n is a, c, g, or t
  misc_feature (1337)..(1337): n is a, c, g, or t
ttcctgctacggttttagtccttcgttttcggcggcgcaagatgggggagagagtgaagggaaccgtgaagtggttcaacgtcaccggggggttcggcttcatctccccggaggacggcagcgacgacctcttcgtccaccagtccgccatcaaggccgacggctaccgcagcctcaacgagaacgacgtcgtcgagttcgatgtcatcaccggcgacgacgggcgcaccaaggcctccgacgtcaccgcaccaggaggaggcgctctagccggtggctcccgccctgtcgacggcggtggtgaccgcgggggccgcggcgggggcggctactgcggtggcggctacggtggtggcggtggcggctacagcggcggtggtggcggctacggcggtggaggtggcggctacggcagcggtggcagtggcggccgctacagaggaagaggcggcggccgtgagtgctacaagtgcggcgaggagggccacatctccacggactgcccccaaggcggcggtggtggtggtcggcatcggcctctgaagttgtaccttcacagtggcggtagacgatcttcactattgttacttatacttacctacaccgatcatctacactttatcgtccttcaccacgtcactagctacgttcgttctccaaccatccttctctctccactctacgcccttaacatcatccatcatcgctcgatacaactatccttcgctatatgattcaacttacgcactcagtcatcgattcgtcccttactctcataacacaaatccacacatcgcatcggatcgctcgtatccatctcaccatccgatcacatcgtcttctattccatctactccatcatcacatcatcgcactcatattctccatactcatatctactctgcacgtatccctcactgtgcacatgcgaccgtatacagtactcgatcttttgacaatcttactccacttcgcatcgctctnacactcgacatantactgcgtcacataactctgcatacgctctctctactctcactcgacactcgattgcatacagacacgacatctattcgctctcgcactctcatcgcatnccttatcacatcgtaactcgctcgtttctcgactttgttacttaccgtaatcttcaacgtgctatcatcangnnnnnnanatatgnattcgcaatccgtctcccaaccactaatngacactctacctgtactccgaactccatcctacatcgataccgcgaacatatangtgtctacatctggtctctactctaatctgacatctatangaacatccttatcggatacataactgcatcngtaatctgcatcgatgatacgaactcgcattcgcatctctagtacactcg

SEQ ID NO: 1730 - DNA, 585 bp, Hordeum vulgare
  misc_feature (29)..(29): n is a, c, g, or t
  misc_feature (47)..(47): n is a, c, g, or t
  misc_feature (511)..(511): n is a, c, g, or t
gggactgcttcaacggcggcgccggcggnggaggaggcggctactgnggaggaggaggcggcggcacctgctacaactgcggcgagccgggccacatcgcccgtgactgccccaccagcagcggcttcagcgggggcggcgggggcggccgcttctgcggcggatgaggccgcggcggcggcgaccgctcctgctacaactgtggcgagcccggccacatctgccgcgagtgcaccaagtgaggggatctctgcccctcccgctctatagacgtcgcctaaatacctctcgtcttagttttgccgatcgatcgcagccgcctcgcagcttattttaccttgctcccttctccccccttccgtgcttaggggaagctcgtccgaaagttaagtcagtcagtcagtccgtgtggatggttaattttgctatgaaatggtccggtacccgtacccgtactctcaattgatggttaaagtcgtgatgatggattattgtcgggggaaacaaaccncctaacatttacaatttgggtaaaaccaggcggcccccacctgttagggggccccggggggggcgcccgcccct

SEQ ID NO: 1731 - DNA, 655 bp, Hordeum vulgare
  misc_feature (30)..(30): n is a, c, g, or t
  misc_feature (37)..(37): n is a, c, g, or t
tgattcaacgccttcaactaatggaacagnaaccagnaagcagatgatggcacttctagcaatcgttgtccagaaccctagtcttctcaaccagcttgtgcagcagcagcagcagcagcagcgcaggaacagctggcgttatgaggatggaaacaagaaaaggaggttccctgctctagagcagggtcctgtaactgatcaggagacttctggcgcaggggctgaaattattcagtatcgcccccctgtccctgaaacctctagccaagtaatagcagatgaagcatatttgtcggccacagcagaaccaatctcaagtcctccacttaacatgcccatggacatcgacactgaaacgacctcagacaacctcaacacacaaggttcatccggggacatttttgctgacatgcctgctctaccagactttgatgacatgcaactgtggtttggcgaagacggggaacttactttaactattcaagattatgatgaatctccacagtcagagcaggactgtcagatggaagcacagcataaccacaataaccctcaatatgcttccaggtgatcaaggatgcgtgaggtgggcgccattggcagcgaaaacggcatctgtgcttaggtcatagtgtcgtatagcaatgtttgaaag

SEQ ID NO: 1732 - DNA, 579 bp, Hordeum vulgare
ggtcctccgactcggtggacgccgggcagttcgcgcagcctaggcagcccatgggcctgccaggccagctgtccgacagcgtcagtgcagcggcggctgcgatcaccgcagacccaaacttcacggtggcgctcgccgcggcaatctcgtccatcatggccggccagcacgccgccggcaacagcaacgcgaacaacaacaacaccactaagaacaacgtgacgacgaccagtaacaacacgacgagcaacaacaccaacagcgagactcaatgaatggctttggtcaagttggaaaagagttgagaaaccagatagctagattgcaagttatacatggatggtgttccattcttctttggtcaggattagcttctcgagaagtttgtttggtcttgataccaagcatgatatacgatcactccttttcttttgtgattttgcggcagcaaaaaaaaaagttgtattagttcattccttccccttagttctttttcatcgcccacagctgttgatatttcactgtaatgaatatagttatagtaataagtaaaataatggtgcctcgggaaaaaaaaaa

SEQ ID NO: 1733 - DNA, 528 bp, Hordeum vulgare
tttttgtaggtttttgtatatttaataatgcaggaagagagggaagaaagtttaagaggaaaagaaaagaaaagcaaaacttttgggagcacggcccgcggcacccaatggaagagatgggaacgggactgaatgtatttctgctcgtaggccaagtatgaacgggtaaccggtgtaaagccccatgtagccctctgtgaccgacggttttgcgatcagcaatcagacaaaaaactttggttaagtgttggaagtgtccttttgcgtatccagagacatgcaggtgttggttggtgatactagcgtgcatagacgcttgttggatgggggatattcatgcctagctttttattatatgttggtagtaagttttgatagtgaacttgaacttgcggtggccgacagtctgcggatgcttgagggttttacggagaatgatgcgacagtagttccctgtttattatttggtggaaaagtacgtaacagctgatgatgaatgttttttatgccaaaaaaaaaaaaaaaaaa

SEQ ID NO: 1734 - DNA, 2263 bp, Hordeum vulgare
ccccctccctctccctcctccctcaaaactctctctccctccctgaaaattctccgcatactggtgcccaagtggtgccggcatcccgctgagggcagagagagagagagagaaagagatcctcctcccctgtccccactcccctgatccgccgccgagccgggacgaggaggaggaggagctgcagctcagctccgccccagctcagcccccggagcccgagctgatcgacccgccggcagcgagattcggccagggcacgatcgacggagagatgtaccgggtgaagagcgagagcgactgcgagatgatgcaccaggaggaccagatggactcgccggtgggcgacgacggcagcagcggcggagggtcgcctcacaggggcggcgggccgcctctgaagaaggggccctggacgtccgcggaggacgccatcctggtggactacgtgaagaagcacggcgaggggaactggaacgcggtgcagaagaacaccgggctgttccggtgcggcaagagctgccgcctccggtgggcgaaccacctcaggcccaacctcaagaagggggccttcacccccgaggaggagaggctcatcatccagctccactccaagatgggcaacaagtgggctcggatggccgctcatttgccagggcgtactgataatgaaataaagaattactggaacactcgaataaagagatgtcagcgagccggtttgccaatatatcctgctagtgtatgcaatcaatcttcaaatgaagatcagcagggctccagcgatttcaactgcggcgagaatctttccagtgacctcctgaatggaaatggtctttatctgccagattttacctgtgacaatttcattgctaattcagaggctctatcttatgcaccacagctttcagctgtttcaataagcagtttgcttggccagagctttgcatccaaaaactgcggcttcatggatcaagtaaaccaagcagggatgctaaaacagtctgaccctttactccctggattgagcgacaccatcaatggcgcgctctcctcggtcgatcaattctcaaatgactctgagaagctcaagcaggctcttggttttgactatctccacgaagccaactctagcagcaagattattgcaccatttgggggtgcgcttactggcagccatgcctttttaaatggcaccttctctacttctaggaccatcaatggtcctttgaagatggagctcccttcactccaagataccgaatctgatccgaatagctggctcaagtataccgtggctcctgcgatgcagcctacggagttggttgatccgtacctgcagtccccgacagcaactccgtcagtgaaatcggagtgtgcttcgccgaggaacagcggcctcttggaagagctgcttcatgaagctcagggactaagatctgggaagaatcagcagctctccgtgagaagttcaagttcctctgtcagcacgccgtgtgataccacggtggttagcccggagtttgatctctgtcaggaatattgggaagaacgtctgaatgaatatgccccattcagtggcaattcactcactggatccaccgctcctatgagtgctgcgtcgcctgatgtttttcagctctccaaaatttctcctgcacaaagcccttcactgggatctggagagcaggcaatggagcctgcatatgagcccggggcaggggacacttcgtctcatcctgaaaacttgaggccagacgcgttcttctccgggaacacggcggactcgtccgtcttcaacaacgccatagccatgctcctgggcaacgacatgaacacggagtgcaagcctgttttcggcgacggtatcatgtttgatacttcggtgtggagcaacttgcctcatgcttgtcaaatgtcggaggaattcaaatgagttcctcaccgaacctccagcggagtcgaaggagattcttggtatccctcaccctgattgttttgaggaaaaattcagagaaagcctcatcgattgtatacgctgctgcgtgcgtacgcggctgctaccagatgcgctctccgttcaactaagccccttttccccaataaagttggcggagataagccggttatctattttttgtttgtttgtttcgaactagagaacccttttttgtcatctctgtggcatttatttgaacaatgtaagatcagttactgcttaaaaaaaaaaaaaaaaaaaaaaaaaaaaaaaaaaaaaaaaaaa

SEQ ID NO: 1735 - DNA, 815 bp, Hordeum vulgare
gaactctgatcctcaaaatcatcttctgttcggcgtcaatatagactcacactcacttctgatgcaaggaggtcttcacgacgagaatgattcgacggcgattccctattccacttccaactttctgagcccttctcaacatgatttctccttggatcagactctaaatagttcaggatgcttagatgaatcgggatatgtgccgtgttcgcacactcctgatcaagtgaatcaaccgcctgcaacctttgtgaaggtttacaaatctggaacctacggaaggtcgcttgatatcaccaagtttagcaactatcatgaactacgtagagaactggggcgtctatttggccttgagggccagttggaagaccctatgagatcaggctggcagcttgtattcgtcgaccgggaggaggacgtcctcctggtcggcgacgacccttggcaggaattcgtgaacagcgtttcctgcataaagatcctgtccccgcaggaggtgcagcaaatgggcaagcagggcctggagctcctgagctcggcccccgggaagaggctaagcggcggcggcggcaacaacagctgcgacgactatgcgagcaagccagagtccaagagcctggacaccgggaatcgcctcggtggctcgggccaaaatcagttcttaaaagaacaaaagcccctgctcttaaggctataaccttccccgcgtatgttttttgaaaccctttttccctttttttcccccagggtttcagaacccggaaaggttccggagaagcagccccctatgacccattccctacctaaccttttta

SEQ ID NO: 1736 - DNA, 862 bp, Hordeum vulgare
cagcaccgcgccactgacccgaccgcgccgtagcctcgacccaccgcgccactgccccgactgtgccggagccctaacccaccgcgccgccgtcccgacccaccgcgttgccgcccctccacaccctacacagcgatgtacgctactggtcctgggcaccaccctttcaggagcagcggcaccgtcctccccgtggatctgaagttcatcctcgtgctcctgcttgggcccttcccgggtcctcgttcattggccttcgatctcatcccgccgtggatatcgcgccttggtcttcttctcttcaggcaggtgagccccgaggtcccaatcgagcctagctgctaaggtatgtttgctcgtactcggtgacgtactcatccaagactaggatttggggctatattcgcaagtggcgactggcgaccagctctccagattttttgccaacgccagaaaactagctgaatcatatactacatcaaactgcttgttgtttaagagtgtgtggggaaaagataaggcaatgtttctcgggttgccggccagagagaacgaagagtataagctttatgcgtatcaaaaggaatccggttaggtttcaggctcaagctgctttcagattggccttaggaaaaaggtacaggaaaccgaagggaaaatggtgccgaaggctggaaaatcctaaaggttttctagagaccgtaccccccctgagggagagaacgaaagaaccggcaatttcgatagggctaactgtatagacacaagactcgactaccccctgtgaaaatttatagaagtattgagggacgaacccgtgtaaccaaaaaacccacctttgtaaggatagaaccacctgttc

SEQ ID NO: 1737 - DNA, 582 bp, Hordeum vulgare
ggctctatcaaactgggtaataaaaacacagttgccaaacatcttgccaggtaagagtgtcaaatggcttttgggttttggtttacacaccttacgttgaccctctcaagtctcgactctcaataaagaaacgaaatcaatgaccatttgttttctacccccctttagtctttagatctgtatttcatttttcctgtacacgggaaaacattcagaccagatgagctctttgagcatcaagctacaactgattggcttgcccgctgccatgacgcaagcattgataatgaaaatggtgtgcaattcgcatgagtttctgcacagaacggagggctaggtctaagcgaacgactgaaggatcgatcactcaaggtgatgagtgtctcagcacatcaaaacatgtgcacatgcagaaaagcatgccaagtagctgtcagcggattcaaaagatcttcttcacctcttggacatcctgggccctgtgggacgaattggagccatcagattgatcttcatcatcctcttcctctgcttcatcctcatcactatcaatctccagcagactcaacctgcactggtttg

SEQ ID NO: 1738 - DNA, 586 bp, Hordeum vulgare
gtttagcccacgcaccaccagttgccccatcgccaagctccatttgctctgctcctcccctccgtctccctccaaagctatcgtctccagcagatcgaggaggccaggagcaccaacaagatcagcggctcgactgtgctaggcaggtaagcggcggatggagttcgtgctgatcatatccctgccgctcctcatcctgatcctcatcatcgcggtcgtcctctgcatcgtctgccgctaggcacatgcggacgccgaagcgctcagtctgcgctgactgtgatcacaccatatgttgtgttaatcaacccaatattaattacaccatgactcgatagagaaaaagaaagctcttctcctccaccatttctacttttctgttctgtcactgtggtgtgattagctggctctaaactttattggctttcgtggtggcaacaaaagcatcaatcccgggtgtcgatgctcaacgcatatgatatatgtggctgtaaaaaatagcaaattcccttcctgctccgattgattcggggaggttggatatctgaaagtctcatcttatttttttaaaaaaaaaaaaaaaaaa

SEQ ID NO: 1739 - DNA, 186 bp, Hordeum vulgare
  misc_feature (164)..(164): n is a, c, g, or t
cgagtatcgctgtgactgcggcacgctcttcaccaggagagacagtttcgtgacacatcgcgctttctgtggcgctctcgtcgaggagacaggcagggtgcttgctgttccgacgccgccttcgcctcggccacctgatttggaggaggttgaggagaatgtanacaaggacaaaaaaaaaaaaaa

SEQ ID NO: 1740 - DNA, 180 bp, Hordeum vulgare
gttttttttttttttttttttgggttggacatattagttaaaaaattctacccccaaacacttttttttccattttatccataggcgcccacaaaaaagggttatccagatttatcccatgggggaaatatataagttttttccttggacccctctttttttttttgaaaaaaaagggga

SEQ ID NO: 1741 - DNA, 570 bp, Hordeum vulgare
  misc_feature (251)..(251): n is a, c, g, or t
  misc_feature (561)..(561): n is a, c, g, or t
ttttttttttttttttttttttttttttttagaagtatgaaactagtttaacgaaagttttagcctgcgcatgcgaagctagttccgcgagtgatggtcacacacacgctgtgcaactgcctcaaccttagactacaagaaagtgttgtcatcctattcatgctttactgcaggttggcatgtttaagagctgccagggtacaatctctgaaacatagcaatgcccatgatcattcactcacgactagctnaaggtgcagagggttcctccggctttggcttggtgaacgccctctgtttctccagtgtgggtgcagagggttcctctggcttcggtttgatgaatgatttctgtttctcaagtttaggcatggatgccaccgcgttcttctggagagcatcagcacttgccttattgtctggctgatcccgagggctcactagctgcttctgaaggacatcaaactttgctgtcgcccaagggagcggtaccgacattcccaaccaagaacttgggagtaatcgaccggtcagccgatgagatgggatctccttggacgnaaaaccatg

SEQ ID NO: 1742 - DNA, 833 bp, Hordeum vulgare
  misc_feature (511)..(511): n is a, c, g, or t
tacacacacacactcactcgcctcgcccccctcctccatcttctacttcttcttctacctcccaccctcctcccctccacttcctcgtctcgtgttggctcttcgcgcgcgcccaagctcgctcttgatctctcccaccgacgccggccacccaccgctggacgacccgtcgtccgttagctagcgagcatgcagagcatggatttggtgtcgccgtccgagcacctctgctacgtgcgctgcacgtactgcaacaccgtgctcgcggttggggttccatgcaagaggctgatggacacggtgactgtgaaatgcggccactgcaacaacctctcctttctcagcccacggccgccgcccatggtgcagcccctctctccaaatgaccaccaccaccccatggggccatttcaggggtgcactgactgcaggaggaaccagccgctgccaccgctggcctcgccgacatcaagtgatgccagccctagagctccctttgttgtcaagcccncggagaagaaacaccgcctcccatctgcctacaatcgcttcatgagggaggaaatacagcgtatcaaagctgcgaagccagacacccctcacagagaagccttcagcatggctgctaagaactgggcgaagtgcgaccctcgctgctcatcgactgtctctacatccaacagcgccttcggagcccaaaatagtagtgccccggtcctcagctgcaggagagggcaactgagcaagtcgttgagaggttcgacatcttcaagcagatggagcgccacggcttaaggcttcttagcttaatgcgatatattagtaccggttcc

SEQ ID NO: 1743 - DNA, 849 bp, Hordeum vulgare
ttgggatgaaccggacctgctgcagaatgtgaagagggtgagcccatggctggttgagctggtctcaaacatgccggccattcaccttgctccattctcgcctcctcggaagaagctctgtgttccgttctacccggaccttccggtcgacggccagtttccgtctccgatgttccacggaaacccactcggacgcggcggcggcggcggtccgatgtgctatttcccggacggcactcctgcaggcatacagggagccaggcatgctcaatttggtatatctttatcagatctccaccttaacaaactgcagtcgagtctgtcaccgcacgggcttcaccaggtcgatcacggcgggcaaccgaggatcgccgcggggcttatcattggtcaccagtctgcgcgagacgacatctcgtgcatgctgaccattggcaatcaccagaacaacaacaattcagatgtcaagaaggcttcaccccagctgatgctctttggaaaacccatactcactgagcagcagatcactttaggtaactctcggggtttctctccatctgctgctaggaagagcacctctgatatgagcgccgaaaagtcggcgaataactctgatattccaagcccacaaagcaaccagaatggctctatgaaaaacttgtcctgtggaagagttccattgtgccaggacaacaaagtactcgatctcgggctggatatcgggcacttgaaggatttcattgcatcggaagacgtcgggcgcacccttgatctaacagttggtggctcgtatgaaagattatatcgggggctttcccacatgttcggattgaaaaacctagctgatat

SEQ ID NO: 1744 - DNA, 872 bp, Hordeum vulgare
  misc_feature (243)..(247): n is a, c, g, or t
  misc_feature (317)..(320): n is a, c, g, or t
  misc_feature (322)..(322): n is a, c, g, or t
ggcaaattgatgaaggtgaatcggaagtacaggatagcccctaagtcgtcttatctagaaggacgaagctccaaaatggtgctgcttgatgatataaaaaaggagccaaccaaggtagagaaggtagagagggatggctttacagcccacactaaatcacaggtagatgctgaacttgcacggatgagaaacatgaacgcagaagaggctgcagctgcagccgctcgtgcagttgctggggcnnnnnctatcatggcggaagctgaagccgcagtgtgagaagcggaggctgcagaaactgatgctataatcttctnnnntntttgcggagtcgttgtgttgaccttaaaaaaccggatggcatttcgccacgacattccgaggtgaaaattgaggcgaaagaaggttagaggagcacgttttgagtaacgtcagagtagcagatgggccgtcgtgtgggaagagcgcaggaggagacttgaggtgagataggacacgcgagtagagaggcgacgagaggcgaggacgacacgagtagagagatgcgaggcgacggaggagagatggtgggacgaagtaggcgcgagaggagtggacgagacgacgatggccggagtggagaggggaggagagcgagaggaggagagtagagaacggctggaggaggtggagaggaggagaggacgaggaggagagggactatgagaagtagttggaggaagaagagtgggacggacggtgagtagaaggaggaattggtccgagggaggggtagtggaggcagtagcagaaggaagaacgaggaggatgatgtaggagcgcggaggacaaaacaagcaggaggtgggagcgaggcggagcgaggaggaggc

SEQ ID NO: 1745 - DNA, 721 bp, Hordeum vulgare
cggcgacgaagcggtcgcggctggtgtggacgccgcagctgcacaagcggttcgtggaggtggtggcgcacctggggatcaagagcgccgtgcccaagaccatcatgcagctgatgaacgtggaggggctcacccgcgagaacgtcgccagccacctccagaagtaccgcctctacgtcaagcggatgcagggcctctccaacgaggggccctccgcctccgaccacatcttcgcctccacccccgtcccccacagcctccgcgagccgcaggtccccgtccctcacgccgccgccatggcccccgccatgtaccaccaccacccggcccccatgggcggcgtcgccgccggccacggcggctactaccagcagcagcacagcgcccacgccgtctacaacggctacggcggcggcgtctcctcctacccgcactaccaccacggcgaccagtgatcgatccctcccggaattcagtccacggatgctctgctctctgctcatcagtcaggtaacagatgtcgtaattgtaacctgtaatcagtcagtcaatcagtccatgatccattatcaccactgtagcgtagatgtgcgtgtgtgtgtgtccatcaatccatcagtttacgggtgcggccgcgcataattgttaagaagacgagaagatttatttacaggggggctggagtgaagcttgccccatggtaaaaaaaagactagccata

SEQ ID NO: 1746 - DNA, 643 bp, Hordeum vulgare
gactccttcagcagactactactaccataacagtcttaacatagctactagggtggttgccttggatgaaggcacgagctcgagttacatcgcaacacagctcgccaaaggatcgatcagctcctaatctagggggtgcggtatacactgcaacgccctgtcgtccataattacttaggggggataggcctttgacatgtccacatcatgtcacaaaaacacaggcggcgaacacaaaaacactggagggtgtcggtgtggtcgtcaggcgccaggcctgccgcccgcacgaggttggctcagctggtgagcgtcgagagcatgccgccgccagcagccaacacgacctcccagccaggccctttcagggggaagtgcgggacggcatcagcagccgcacgcgcaccggtgaggtccctccggtccatcaccttcaggaggtcctcgtcgctgatgtctgtctggatcatcctgtcttcctcgtcctgctcgtccctcagaagcgccagcagctctccctcatctaaggcattaggcttcgcggcatcttgctggaactgtcccttcccaatcacgacgtgctctagcttcaactttccaaaagctttcttgataatccgtccctcaacagaattggatgtcg

SEQ ID NO: 1747 - DNA, 546 bp, Hordeum vulgare
  misc_feature (68)..(68): n is a, c, g, or t
  misc_feature (123)..(123): n is a, c, g, or t
ttgccttgtcagtaacaatggccggcttctgctgccaaacaaactcccatgtgtgaccgcacacaggnagccacagctcacaaaacgtagtactactggagggggtgtggggggtacacgagnatgagcaggcaagaaatgttcctcctacccaactaatgcacaattgcatccactctggggctcaaaacctctaaccatgggcgctgcggtgggccggaccgagacggaggcgcggcatcccatcacgcgccgtagatggcggagagcctccgcagggcggccaccttgagctcgaggatgcagatgtactcggcggtctgccggagcagcacgtcgacatcggcgtcccgggcgtccgggactatcttcttgagctccctcagcctcctcagcaccatgtgctggaagggcctcctgtgcatcagcgatgccaccacccccttggcctttcccaccgtgaaggtggccttccttctcatctctctctgtgtatctctccctctctccctccccaggttgctgtgtcactaacttgtgctgtgc

SEQ ID NO: 1748 - DNA, 811 bp, Hordeum vulgare
gtcagtttctgtgataaatgtattcgagattacattattacacaatcgaagtgcatttgtggagtgaaggtacttgcagattccctcatcccaaatcccacagttagaagcacaatcagcaatttgttaggaacaaggacttgcagcactgccagcggtacagggaagcacagaagttcttcaggaagcaacgctgatcccaaatcacagagccacaccacctcggctgctttggaaagggacacgaagcaatgtttggacagccagctatcgccagctgcttctgacgcccgcctccaggtcgccacagaacatgatcaagtcgaccggcctcagaagaattctgatctgaagagcaacactgaaggctctgcagggcgttcagcatagaaagctgtacctagcgctgacctccccaagccaaaggatgtgagcgaatcaacattgaagggcactgcagtttcatcagggaccttggaaccaaaagtggctaggtctgatcagtttaataataatcggaagaaggcttacttatctgaggctgtgcacccatacaatgcttgctatggtggcagcggggcattggatccttggtatgtattccctttttatggaggttattatttaggtactatttttaatcctattccattccttttccatttgtagggtcatagacttttgaggtgtacgatcgtataacgtttcttcgatatgcgcctgtaagttatatgttcgtcgatttttactcccattaccttatctcctataatattggcactcgaacagtttttctgaaaaatcaataaag

SEQ ID NO: 1749 - DNA, 480 bp, Hordeum vulgare
gaaagcaaaacgtagtctatcgtactgtaaattcgtaattacaatgtccaaccaataacctatctcaaaataccatcctaatcaaagacatgtacaagtgatttcctccctgaaaaaattgtgacaactagtgtacccagctagctacctagacgaatagctcgagcaagacgggcggctggtaattggcggcggtccggtgccccaccacctcctgatccggctccccgacgctgcgccacacccactgatcgccgtcgtcgccgccaccgccgccgccgcgcagcgccatctcctcgcggtgtcgccgcatgtggcccccgagcgcctggcccatctcgaacccgagcccgcagatgtggcactcgtgttgccgctcctcctgcttcttccgctccctgatggccctggcaacgccgacgccgagctccagcccgtgacggccccggaggtggctggtccggtgcccgcccagcgcct

SEQ ID NO: 1750 - DNA, 890 bp, Hordeum vulgare
  misc_feature (62)..(62): n is a, c, g, or t
  misc_feature (776)..(777): n is a, c, g, or t
cccgggctgcaggaattcggcacgaggcttgttgtgctggggacaagcggggtgacgatggnttctgatcacacaatatttgttggtgatttggctgccgatgttactgatgccatgttggaagagatattcaaagccacctacccatcagttaaaggtgctaatgttgttactgacagggccactggtcgctccaaaggatatggttttgtacgctttggagatctaaatgagcagacacgtgctatgactgagatgaatggagtgccattgtctacgagacaaatgaggattgggcctgcagctaacaagaagaatatgggtgctcagcagacatactcaactaatgcagggtaccagagctctcaagtaaatgaggcggcgaatgatcccaacaatactacaatctttgtgggcgggttagattccaatatagatgagaactatctaaggcaagtttttactccatatggcgaagttggttatgtgaagattcctgtaggcaagcgttgtggatttgtccaatttaccagcagggcgtgcgctgagcaggccatcagtgcgctgaatgggtctcagattggtagttccaatgttcgtctttcatggggccgtagccaaaacaaacagcctccccagcaggatgcaaaccagggtaatggcaacagctactatggatataaacagggtcctgatgcttactatggtgcacccaatgcgcaagatcctagcatgcaaaactatggatactctggttatgggcagttacgatcagnncacacagccaccacagcagcagcaaccttcacagcaggcaccaccacagcagcaacagcagccagccccccagcaggcaatgaccatcgaaggcgatgggagctcaatcagag

SEQ ID NO: 1751 - DNA, 644 bp, Hordeum vulgare
ctcacgcgcgtgcacgtcgacttggtgaatccaacaattcggcacgagataagttggtaatttggattctaacgtgactgaagaccatttgtgagaggtcttcagcccatatggtcagttggtgcatgtgaagattccacaaaacaagcgttgtggatttgttcaatttgctgataggagttgtgctgaagaagcactccgaatactgaacgggactcagttgggtggacaaagtattcggctttcatggggtcgtagcacatcaaacaagcaggcccaagcagatccaaaccagtggaacgctggatattatggatacagccaaggatatggttacggctatggcgctgccccacaagaccccaacatgtactatggagggtatcctgggtatggaaattatcaacagccacagctacagcaacaagtcggatatagcttagtgctgatattaacgatctttcgtggctgctgttctctctttactagtattatgaacttatgctacttgatttctcctttggttcgctatagggggattataaactaaaggctgtgttattcaattgttaaatacatatgcactgtttaaacgctcttctattacaaaaatttggactaaaaaaaaaaaaaaaaactcgaag

SEQ ID NO: 1752 - DNA, 527 bp, Hordeum vulgare
ttttttttttttttttttagcacaagaatttacaactagtctggtaaaacgaacaagtcacagcctaactggtctagtaaaagcccatcaacgtcacaaaatagtggacatcggtgtgtctaaaagctcatctgcgcacaaatcctccaaatcaaccatgaaatcacctccatcgaccccagctgcgtcgcttagcatcttatcctgtatcgccttggactcttgtagttctgtaacacaggcttgcagcctactgtattgttctcttgcttctgggtattgagtcattgatttcacacgagctaatgacctctgtagtctgccttcagcctgcttcctaccgtccttcaagaaatcatattcatcttcaccttctgcagttccaccttctgcaggttggatctgcgaggacggcccttcaagttgtttgtcaggttggaaaccacgcaagccccttccctttctcctccacctcagtataactttctccacgatgcccactgaccagattacctttctctgggtgc

SEQ ID NO: 1753 - DNA, 611 bp, Hordeum vulgare
  misc_feature (507)..(507): n is a, c, g, or t
  misc_feature (550)..(550): n is a, c, g, or t
  misc_feature (600)..(600): n is a, c, g, or t
ttttttttttttttttttagtccaaaaaaacatgcagcgtctgtctctgctctgcattttattacttgtctctcggtcaacagcacgccctgacacggcccagctacgacgaaacactcaccgcgcgacagccgtcgatccaccgatctggcggacaatcgtcgcggcaacaagattacaagagtggaaagcctccctgtcccagtcaaaccagcagctacacctggaaaaaaaaccgggctgggcctgccggcgccggttgccgatgatcaccgagctggctgcacgtcaggagccgccggcgcctacgccgtcgtacttgagcccgaactcacggaacccgatctccatgtccgccgcggcgacgagcagctcggcggcctgcgccggctcgaggatctccactgcgcgcttcatggtgcgcagccgcagcgcgtcggccccggcgaccactgcgccgacgcggtcgacgagcccgcccaaggtccaacagctcccccgccgggngcccaccaagccgtccgccctcctgcacccggcgccattctcngcgcgaacaggttcgtcctcctgcggccacgggtggcgggcggctgccanctccgttccga

SEQ ID NO: 1754 - DNA, 392 bp, Zea mays
gcacgaggcggagggtggaagaggcagctcgagcgacagtggcaccgtgtctatggccgacagcatggctgcctcggctgcggcgctcgagctgatcagcgaggacatggacgaggaggacatcgccaacagcgtggtgttctcgcagctcgttcacccgactggccggtaaggggtgtgcgtgtgtggattgggacgtggatgctgaaatctatgggtgcgtgcgtttgttgtccgttggggttcatctgttcttgttaatatgtactcagatcatgttgtgcgtatgtgtgtgtcgtcgttgttggttgattctttaatttggttccttttgctgtacttttgtgggccatgaaaacgggggaaacttggtaagaaaaaaaaaaaaaaaa

SEQ ID NO: 1755 - DNA, 1262 bp, Zea mays
cccgagccggctcattatatcgtccgtcgcgcagacaacgcaagtttgctagcggccggatcagcagccacagcgcgaagagagcaaccacgctgcacacagaggcgccgtgtgtgagatagagcaagctcgatcgaaggaaggagggaagctagagatcgtacgttcgccatggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccggcataacaaaaactttagaaaggtaccaacattgctgctacaatgctcaagattccaatggcgcactctctgaaactcagagctggtaccaggaaatgtcaaaactgagggcaaaattcgaggccttgcagcgcactcagaggcacttgcttggggaggaacttggcccactgagtgtgaaggagttgcagcagctagagaaacagctcgaatgtgctttgtcacaggcaagacagagaaagacacaacttatgatggagcaagtggaagagctccgcagaaaggagcgacacctgggagaaatgaacaggcaactcaaacacaagcttgaagctgaaggttgtagcaactacagaaccctgcagcatgcagcctggccagctcccggcagcaccatggtggagcatgacggcgccacctatcatgtgcatccaacaactgctcaatcggttgcaatggactgtgaacccactctgcaaatcgggtaccctcctcatcaccagtttctgccttccgaggcagccaataatatcccaaggagcccccctggaggcgagaacaacttcatgctgggatgggttctttgagttgctctgttaatcatccatccatcagatggatgtccaaactaataaaaggcactcagtgctaccatatgcatatccatgcttaagtgcttgatttgccacgacgtggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttatt

SEQ ID NO: 1756 - DNA, 1262 bp, Zea mays
ctcgtgcgctgatattccgctcctgtccctgtgtcctccccggatggagctagagccggctctgctcatcattatatcgtcgcgcacaaatgcagcacttgtgttcgtgggggtgtgtggcatattagctagcggataagcggccggccgggcagctagcagaagagagcaagctcggacctcggatcggaggaggtcggcatggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccggcgtaactaaaactttagaaaggtatcaacattgctgctacaatgctcaagattccaacaatagtgcactctctgaatctcagagctggtaccaggaaatgtcaaaactgagggcaaaattcgaggccttgcagcgcactcagaggcacttgcttggcgaggaccttgggccactgagtgtgaaggaattgcagcagctagagaaacagctagaatgtgctttgtcacaggcaagacagagaaagacgcaagttatgatggagcaagtggaagagcttcgcagaacggagcgtcacctgggagaaatgaacaggcaactcaaacacaagctcgaagctgaaggctgtagcaactacacaaccttgcagcatgccgcctgctggccagctcccggcggcaccatcgtggagcatgacggcgccacctatcaagtgcatccgcctgcccactcagttgctatggactgtgaacccactctgcaaatcgggtaccctcatcaccagtttccgccccctgaggcagtcaataatatcccaaggagcgccgccacaggcgagaacaacttcatgctgggatgggttctttgagttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtggcacttatactgtttattcatttggaccatgaatcggggtagtttgtaaaaacacatctatatatgctgccggtgcatagaattaaagttatctgcaccgtaattattat

SEQ ID NO: 1757 - DNA, 1268 bp, Zea mays
tctcggctagcttcctcctctctccctcctcttcgtcttcctctttccttctcccttgggaaacctgctgcctttgagctttcttcttcgagtgctcccaccagatctcctcctccttaccttctttggcacgttcggcggcgcgcgcggagatagatagatcccgccatcgtcgtcgccgtccttgcttccgatcggagggccacaaccacaacctctcgctccttagcgtgcgcgcgcgagccagggtcaagaagagagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgtggaattcagaggatgattgctttctagttgcatttgatgtttgatgagacttttctcatgtgaaacgtttattaaaacttcaaaatggtgcagatgttgctaaaaaaaaaaaa

SEQ ID NO: 1758 - DNA, 636 bp, Zea mays
ttttttttttttttttgactgactaattgttaataataaggatctgtccctatttttttggcaaaaaatgtggcccctagattttgttaatctgctatacatctagctactagagatagcaagttaattaattatacgcaaagcaaattacagatctgttaaagttgaaccaagtctgatcatcggtaagaaattacatacagatatatgtctagctagctagggagagtcacgacgtagatgaatcgtacttggtgttggagaaatcgtagagcctgccggtgctggagaagatgatgaggccaacctccgcgtcgcagaggatagagagctccttcgccttcttcagcagcccgctccgcctcttggagaaggtcacctgcctgctcgtggagttgtctatcctccttatcactatcttccccctccccatccctccttctatctctcagatctagtctaggccggaccggatgggaaggaaggatcacacgggaagacgaagagctcgccggcggccggggggacgagcgatgactggtctgatgggggaattaaaggcggaagctatagcctagctactagaggccggttccattcctagccaccttccaaagagcggaacgggaagtgccg

SEQ ID NO: 1759 - DNA, 620 bp, Zea mays
cctccccttccctccccactgttacatccagcgagctgttcacggccgtgccgagctcagtgaggcagcgtttgcgagtccgggacgaggggagcggcgggcgacatggggaggggccgcagcgagataaagcggatcgagaaccccacgcagcggcagtccaccttctacaatcgtcatgacggcctcttcaagaaggctagggagctctccgttctgtgcgacgtggacctgctgctgctcctcttctccacctccggcaagctctaccactacctctcgcccaccgtcccctccgtcaaggacctggtcgagaggtacgaggccacgacgcacaccaaggtctggaccgacatccgccaggagcggcgcgcggagctggagaaggcggagcagatgtgcgagctgatggagaaggagctgcggctcatgacggtggacgacggggagcagtacacggtgccgtcgctggagctgctggagcacagcctggaggcggccgtgcgcaaggtgcgctccgagaaggaccgcaagatcggcggcgagatcaactacctcgagaacattatcagaggacgccacgaggagcgctacgggttgtgcaacaagcttgcgcactc

SEQ ID NO: 1760 - DNA, 654 bp, Zea mays
  misc_feature (28)..(28): n is a, c, g, or t
ggccgcgtcgacgttctcatttccgcanaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccgggctgtccccgcttctccgcctggtgcagtatcgtcgtgatcgcgagaagcagcagcagcggtttgccgtattttt

SEQ ID NO: 1761 - DNA, 1345 bp, Zea mays
gcacgagtcctcctcctcctcgcatcccaccccaccccaccttctccttaaagctacctgcctacccggcggttgcgcgccgcaatcgatcgaccggaagagaaagagcagctagctagctagcagatcggagcacggcaacaaggcgatggggcgcggcaaggtacagctgaagcggatagagaacaagataaaccggcaggtgaccttctccaagcgccggaacggcctgctcaagaaggcgcacgagatctccgtcctctgcgatgccgaggtcgccgtcatcgtcttctcccccaagggcaagctctacgagtacgccaccgactcccgcatggacaaaattcttgaacgctatgagcgatattcctatgctgaaaaggctcttatttcagctgaatctgaaagtgagggaaattggtgccacgaatacaggaaactgaaggccaaaattgagaccatacaaaaatgccacaagcacctgatgggagaggatctagagtctttgaatcccaaagagctccagcaactagagcagcagctggatagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcagcaacagcagcaggtgcagtgggaccagcagacacatgcccaggcccagacaagctcatcatcgtcctccttcatgatgaggcaggatcagcagggactgccgcctccacacaacatctgcttcccgccgttgacaatgggagatagaggtgaagagctggctgcggcggcggcggcgcagcagcagcagccactgccggggcaggcgcaaccgcagctccgcatcgcaggtctgccaccatggatgctgagccacctcaatgcataaggagagggtcgatgaacacatcgacctcctctctctctctctctcgtcatggatcatgacgtacgcgtaccatatggttgctgtgcctgcccccatcgatcgcgagcaatggcacgctcatgcaagtgatcattgctccccgttggttaaaccctagcctatgttcatggcgtcagcaactaagctaaactattgttatgtttgcaagaaagggtaaacccgctagctgtgtaatcttgtccagctatcagtatgcttgttactgcccagttacccttgaatctagcggcgcttttggtgagagggtgcagtttactttaaacatggttcgtgacttgctgtaaatagtagtattaatcgatttgggcatctaaa

SEQ ID NO: 1762 - DNA, 1250 bp, Zea mays
gaacctcgccggcggccgcagccgcatagaccggaagagaaaggaagcagagatcggaggcaggcgaagatggggcgcggcaaggtgcagctgaagcggatagagaacaagataaaccggcaggtgaccttctccaagcgccggaacgggctgctgaagaaggcgcacgagatctccgtcctctgcgacgccgaggtcgccgtcatcgtcttctcccccaagggcaagctctacgagtacgcctccgactcccgcatggacaaaattctagaacgttatgagcgatattcctatgctgaaaaggctcttatttcagctgaatctgaaagtgagggaaattggtgccacgaatacaggaaactgaaggccaaaattgagaccatacaaagatgccacaagcacctgatgggagaggatctagagtctttgaatccaaaagagctccaacaactagagcagcagctggagagctcactgaagcacatcagatcaagaaagagccaccttatggccgagtcaatttctgagctacagaagaaggagaggtcactgcaggaggagaacaagattctacagaaggaactttcagagaggcagaaggcggtcgctagccggcagcagcagcagcagcaggtgcagtgggaccagcagacacaggtccaggtccagacaagctcatcgtcttcttccttcatgatgaggcaggatcagcagggactgccacctccacaaaacatctgcttcccgccgttgagcatcggagagagaggcgaagaggtggctgcggcggcgcagcagcagctgcctcctccggggcaggcgcaaccacagctccgcatcgcaggtctgccgccatggatgctgagccacctcaatgcataaggagggcgagcaaatggcgtgcgaagtgattgattgctcaccgttgattgaacgctagcctaagttcatggcggcagcaaactaagctaaaactattgttatgtttgcaaggaagggtaacccgctgtgtaatctttgtccagctagcatgtaccaactgagatgcatgcatgcttattattgtccaattacccgtgaatctagcggtgcttttggtgagaggccggccggacgggtgcagtttacttcaaatatggtttgtgattttgtgtaaatagtattaactaggagtcctatggtaagtaaattaattaatgggaggatgcatgaataaaacctctcttgtgctgcaaaaaaaaaaaaaaaaa

SEQ ID NO: 1763 - DNA, 1039 bp, Zea mays
cttggatcgaccgaccggccggggtggtcgccatgggacgcgggaagatcgagatcaagcggatcgagaactcgacgaaccggcaggtcaccttctccaagcgccggggcgggctgctcaagaaggccaacgagctcgccgtgctgtgcgacgcgcgcgtcggcgtcgtcatcttctccagcaccggcaagatgttcgagtactgcagccctgcctgcagcttgagggagcttattgagcagtatcagcatgctaccaacagccacttcgaggagataaaccatgatcagcaaatactgctggagatgacaaggatgaagaacgagatggagaagctggagacgggcatcaggaggtacaccggcgacgacctctcctccctcaccctcgacgacgtcagcgacctcgagcagcaactcgagtactccgtctccaaagtccgtgcaaggaagcatcagctcctgaaccaacagcttgacaacctgcgtcgcaaggaacaaatcttggaagaccagaacaccttcctgtaccgcatgatcaacgagaaccagcaggccgcgttgaccggcgaggtgaagctgggggagatggcgccgctggcgatgctgcagccaccgccggcgttcgcgcactccgccaccgcctactacggcggggagtcgtcgtcgtcgggcacggcgctgcagctgatgtcggcggcgccgcagctgcacgccgacgacctcgggttccggctacagccgacgcagcccaacctgcaggacccggcggcgccgtgcggcggcctccatggccacggcctgcagctgtgattaactgcgatcaattgggaggactgtcacatgctgcatggaagagggactattattggagcacgcagtttcaaggtcgcaaagctcgtcatgcataatttcgatcatatgttagtttgtcatctgaatagttttatatatgcatgcaatgcaatcaattctctggataataattcaactattgttatgtatctaattaagataggttcgtagactaaaaaaaaaaa

SEQ ID NO: 1764 - DNA, 1282 bp, Zea mays
gcacgagctcgagtcgagactcgagaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgtaaaaaaaaaaaaaaaaaaaaaa

SEQ ID NO: 1765 - DNA, 666 bp, Zea mays
tttttttttttttttccaagaaacttatatatacacaattaagggctgtaatacatgtagtaccagtgcgttggcatgcaatcacaattcacagatttacagttacaagcacagcgtctcactgaactcgctcacgagtcacagatacgtactggggtacctaagctagctcactacgagtacgtacggttaatgtagagttaacgctccaaaccaatcgcatttatttacagcatcaacatgcatgttctatcacgacgaacagttccagattgatcgcagttcttcacaaatcacaaccgaaacaaatcaaatccacgacgaattacaaaccgatcattcatcattggtgggcgggcggaactggttggaccggccttaatcactcgtccttcttgccgcagcagcagaagcactccaggcagtgctcgcaggcctcgtagcagcagaagcagcagcagaacatgaaggcgcaggcatagaggaatcccttctcctcgtggcgtttcttgacgtgctccatggccgacagcttccggtcgtcgtcgctctgtggcggaggctcatccatcgtcgctgcctcttctctctcttcccgacagaaacgaacactgcagtgtgctgacacaagatggctggcagctggtaattaggtagctagttaac

SEQ ID NO: 1766 - DNA, 472 bp, Zea mays
gatgccttttttttttttttttttggtcaactattgcaaattatctccacagtcgggctaacaacgggattaagaattatcatggactgcaactaattacaactgatgctttggtggacacaagtccggctacgtgctgtgctaggggctagggccggacgaagacggtggcagatgagacgaggcaccgtaaatcctgcggctgtgtcgccatgtcggcttaagactttcctccatgtcggcttgttcggttagaggtggatctctttaatccatctcaaaccgaactaaggccttattgggcatggcggctgcgaccttgcgccgcggccaggacggtcacgggccaacgggtggctccatccaatccaaaccttctgtccgaggacaagtcggagaggcgggctgcattggcccggccgatcttgctgctaaactcaactaatttatctgatataacccgatctattta

SEQ ID NO: 1767 - DNA, 129 bp, Zea mays
accaactacctccgccccggcatccggcgcggcaacttcaccccgcacgaggaagccatcatcgtccacctccagtccttgctcggcaacaggtgggccgccattgcttcttacctcccgcagagaacc

SEQ ID NO: 1768 - DNA, 129 bp, Zea mays
accaactacctgaggcctgggatcaagcgtggaaacttcactcctcatgaggaagggatcatcatccacctccaggcgttgcttggcaacaagtgggcagccatagcctcctacctccctcaaaggact

SEQ ID NO: 1769 - DNA, 129 bp, Zea mays
accaactacctccgccccggcatccggcgcggcaacttcacaccccacgaggaaggcatcatcgtccacctccaggccttgctaggcaacagatgggcggccattgcttcttacctcccacagagaacc

SEQ ID NO: 1770 - DNA, 410 bp, Zea mays
tttttttttttttttttttttttttttttttttttttttttttttttttaaaacaaaccggttcctcataaacaagtcaggaaacttgtacagtatatttccacccgttcccctgaatatttatttatcaaataaaaacgaccagtaataacataacccatagggacgtccagtttaaagcacgacagccaattgtccatttcaaaggatcggcaagcactgatacatcgggtccgcaagtcgagcagaaaatcacacgattgtttaagcagcgacatcctggggagggcactgcgcaggttgggcatcaaaaaacaggtctgggagggacataagtttcgatctgaacttgtccgccccatcgcccggtttcccgttttttgcgctggaaatcgggggggtcctcaccg

SEQ ID NO: 1771 - DNA, 652 bp, Zea mays
gggatcaccatacaaaaaaattggcctgctcatcacacaggccatgggatgttgtgtcaaacgaaggaccagttgacgaagcagaacgccaggcagtggacgctgctgtcctcgccgagcaccttccacgctacagcttggtcgaatgagacatgccgacccattcctgacatgcacacgcccgattttaggtacgcgtatccctgttccattagttttgagatatctgagaatattgctttccttcctgactcgtcgaagatcttgtctagcgtcaggtcttgcagcgcaataagagatgtttctaacatgtcgagccctgccttgtttgcaaacgtaaacataggtttctcttgtcaaagggatctgcctctgctttagaagattggaatattgcggacttgagtacaactcttctggtaccttaaaagagcagcacagaacagcatctggatgatgccagagcattttcaacaatgcttcaccagcttcatctgattgattgagtaattccacacctagatggtagtgataactctggcaaacccatctagcaagtgtggcagcttcagggaagccagaaagcatcctctgcccagcatttagaccagattgggagggagatatagccatcgacaccctttgcacagca

SEQ ID NO: 1772 - DNA, 1122 bp, Zea mays
  misc_feature (2)..(34): n is a, c, g, or t
  misc_feature (173)..(178): n is a, c, g, or t
cnnnnnnnnnnnnnnnnnnnnnnnnnnnnnnnnngcaagcagaactagcaaatagtaatactgcaacctgcaacagtgatcaatgtcgccggcgacaggccggggagacgagaccacgaccaggcacgcatacagctgttgtagttgtttgtcacgcacacacacaaacagannnnnngtcagttctcgatcatccacacagtacacaaattcttaacataggcggcacaacggaaaagcaactaatgatacgtagtaaggcaaaaggcggcatccggtctggcgctgccgagcgatgttgcgagcctcagatgaaggtccagttggcgagcatgagcgccaggcactgcggggcgccgtcgtcgcccaccaccttccacgccactgcctgctcgtacgacgcctgccgccccatgctcgacctgcacacgccaccggggaggtacgccaggccctgctgcatgatcgcggggagctgcgcggacagggccttctggccctcctcgtcgaggaccgcctccagcggcaggtcctgcgatgttcaccatcgtcgtctccaggatgtcgaagccggcgctgttggcgaacttgagcgtgaaagccggcgacttcagagagcagcagagtatcgcgtcgctgtgcttccagaacagcatcagcggagagtccgcgccttcggtgtccgaccagcggatctccgttccggtgtgcgccctgtagctcctgccaatccacgtagctagtgcaagtgcctcgggagagcccggcggatgcttcagttcgatacgcgaaccgaggcgagaaggagcgatcgccatggccaccctctgcacggaggccatcacgcccctgacgtactgcctggccattgccgcaacgctctcgcgaaggtggttctcgaacgagaactggaaggcgatggtcaggaccgatctcgtggcgcccgtgccggaaccatcgcttgaagcgcgcatgccgcctccacctgatccaacctcgagcgcagaggcaaggtcaagggtgcgtgtggtggcggcagttggcacatccatcttagcatcaagcggtatcacacggaagcctgagggcagcaacggtgcatcgtcggcaaaagattcatcg

SEQ ID NO: 1773 - DNA, 627 bp, Zea mays
  misc_feature (9)..(11): n is a, c, g, or t
  misc_feature (223)..(227): n is a, c, g, or t
  misc_feature (564)..(564): n is a, c, g, or t
  misc_feature (596)..(596): n is a, c, g, or t
ccaatcaannnggccccgccaggagcaaaccaggacccatcataagatagcaagcaagcgaagacgaacaactagtacaaagctgtttgttccacggggatgatgaacaactacaaaggtgtgtttcataggttgcctggacacaggcaaaagcgacggtacatggggtacagagttcaaacaacagagccgcaaacgctaggcaacttggctctactactannnnnaccgggttctcacacgaaggaccagttcacgaacatgaaggcaaggcagtgcggggtgtcgtcgtcgctcaggaccttccacgccaccgcctgctcgtacgacaccggccgccccatgctcgacacacacacgccaccggggaggtacgcgaagccctgttgcataatcttagggtactcggtgcagagcgccttcctgccatcgtcgtcaaggatcttctcaagggagatgtcctggagagcaatcagcgtcgtctccagcatgtccaggccggcttggttggcaaaggtgaacacgggagcagccttcagggaacagcacatgatcgagtccgantgttgccacagcgctttcaaggaagcatccgngcattgggtgtccgtgcggaggagttcggct

SEQ ID NO: 1774 - DNA, 1102 bp, Zea mays
  misc_feature (34)..(109): n is a, c, g, or t
  misc_feature (287)..(308): n is a, c, g, or t
  misc_feature (763)..(771): n is a, c, g, or t
  misc_feature (843)..(848): n is a, c, g, or t
  misc_feature (982)..(986): n is a, c, g, or t
  misc_feature (989)..(1015): n is a, c, g, or t
acgaggtggtaggacgctagatttggcatctagnnnnnnnnnnnnnnnnnnnnnnnnnnnnnnnnnnnnnnnnnnnnnnnnnnnnnnnnnnnnnnnnnnnnnnnnnnnnacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccnnnnnnnnnnnnnnnnnnnnnnagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgcgctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgaagtccaacccgtcgggtggttatggcgagctgaccccnnnnnnnnngtatggaaaatcatcagctgtgacaaaaggcatatgttgcatgccctagttgaagaaactggtccaattgcnnnnnnggtctgtcattccattcagatgttgctaggtgtggagtggaaatggggcaatagtgatgcacggctacacatgacccagcattaaccaaacaaccgcgtcgccagtttctttctattcgatcagggagatgcannnnnctnnnnnnnnnnnnnnnnnnnnnnnnnnnaaatttggtctgtatatggaactgctgctggacgccgagaaagcaaaacatatgcggaaactcactatggctcgagagtcttctaga

SEQ ID NO: 1775 - DNA, 1851 bp, Zea mays
ccacgcgtccggaggtccatcaggacccaacactccaaattttgtcagagctgaggtgcttcctagtggctatctaattcgaccctgtgagggaggtggctccatgattcacattgtggatcatgttgatttagatgcttggagtgtgcctgaggtccttagaccactttatgaatccccgaagattcttgcacagaaaacaactattgctgcactgcgtcacattaggcaaattgcgcatgaatctagtggggaaatgccctatggaaggggacgccagccagcagttttaagaacatttagccagaggcttagcaggggtttcaatgatgctgtcaatgggtttccagatgatggttggtcactgatgagcagtgacggtgctgaggatgttactattgctatcaactcttctccaaacaaacttattggtcctcatgtcaactcctcccagctgtttactgcaattggaggaggtatcctgtgtgctaaggcatcaatgctgcttcagaatgtgccacctgccctactagtacgatttctgagggagcatcgctccgaatgggctgatcctggtgttgatgcttattctgccgctgctttgagggctagtccatatgcagttcctggtttgcgtgctagtgggtttacgggcagccaggttattctgccgcttgcacataccttagagcatgaggagttcttagaggttattaggcttgagggacacagcctctgccatgatgaagttgttctgtcacgagatatgtatcttctgcagctgtgcagtggcgtggatgaaaatgcagctggtgcatgtgcacagcttgtctttgcacccatcgatgaatcttttgctgacgatgcaccactgctgccctcaggcttccgtgtcattccactagatgcaaagacggatccaccgtcaggcacacgcacgcttgacctagcatctactctcgaggttggatctggtgggactactcgcacttcaagcgatgcctccagcacctgcaacacaagatcagtgctgaccattgctttccagttctcatatgaaaatcacctacgagagagcgtcgcagccatggccaggcaatacgtcaggactgtggtggcatcggtgcagagggtagccatggcaatagctccttcgcgcattggtggacagcttgaaatgaagcaaactccaggatctcctgaggcacacacgctggcaaggtggatcggcaggagctacaggtttcacactggagcagaactgcttcgcacagacacccaatgcacggatgcttccttgaaagcactgtggcagcactcggactcgatcatgtgctgttccctgaaggctgctccggtgttcaccttcgccaaccaagccggcctcgacatgctcgagacgacgctgatcgctctccaggacatctccctcgagaagatccttgacgacgatggcaagaaggcgctctgcaccgagtaccctaagttgatgcagcagggtttcgcgtacctccccggcggtgtgtgcgtgtcgagcatggggcggccggtgtcgtacgagcaggccgtggcgtggaaggtcctgagcgacgacgacacgccgcactgcctcgccttcatgttcgtcaactggtccttcgtgtgagtgaggaccggccccctagcatttgcagctgttatttgttgaactctgtatccaagtactggtcgctcttgcctttgcccaggcaaccctgtgaaacgcacctgccccccagttcatcccgtggccgtggaacaaacaccttttgtagttgcttgcttgctatgttatgatggatcctggtctgctgcgtctcctaaaaaaaaaaa

SEQ ID NO: 1776 - DNA, 870 bp, Zea mays
gaattccggataagcgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctacagaagtacagagagatggagggtgatagcaagttaactgctaaatctagcgatggctcgattaaaaaggatgctcttggtcatgtgggagcaagtagctcagctgcagaagggatgggccaacagggagcatacaaccaaggaatgggttatatgcaacctcagtaccataacggggatatctcaaactaatgaaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgatttgattatatgtatttgtatcgggaggcataaatattgtgtaattgtgt

SEQ ID NO: 1777 - DNA, 734 bp, Zea mays
  misc_feature (712)..(712): n is a, c, g, or t
ttttttttttttttttaatcaccattatttaggcctaggactactatattatatttatgctgaataatacatatctgtaaatgtaaaaggttgccaaaagtagcaacagtcaaatcatcctaaatatacggacaaaagcagcgctaaaccgaagccaatttacacctgagaggcagccatcgcagagattaacaccctttgtaagtgcctcctgttttctgccaatacacatggtaagcaatgcagagacttccctagcataaattgctgctgtattagccctttattaggtttccccattgtggtactgtggctgcatatagcccatcccttggttgtagactccatgctgaaccaactgattacttgagctactggtgccaccatggggactaattgcatccttctttacagagccctcgccagcctttgtagacagcttgctatcaccctccatctctttgtacttttgtaggtaaatcttgagaggctcgacgtactcctcgaatcctaaagtggccatcgcccagagcaaatcgtccccgttgattgtctttcgtttctccttctggcatttgtcgctggcctcgctggtcacgaatgatatgaactcggagacgcactcctgcagggtctccttagcgtccttggcgatcttgccgttggccgggacggccttcttcatgatccggctgatgttggcgatgggcangaaccggtcctgctcccggacg

SEQ ID NO: 1778 - DNA, 651 bp, Zea mays
ttttttttttttttttttttaccgagaggttatggagctatcttaaccatatcactggctccattcagcacaacattacttaccacgaaaagaaaaggggggaaaaaccgaaggttaacttaaccagcgctaattaccgacaccaagcaagaagccggcggcgggactgagccatgccatggccatgcaagcatggacggcgacggtcacaacctggcctacctgccgagccctgacggcgacgacgacgagcctccgccgtagccataggcgccaccttttccgcccatggccatctggtggtgcgggtacgacccggacgacgcggccggcggggagccgccgtacatgggctgccccatcatcatgatcataccgcttcccccgcccgcgccgccgtacatgccgtatcccccgacgggcccgcccgcgccattgtgcgttgacgacgacggcgtcgtctccctgtgcagcggcggctgcgggccggaggaggcgctcgtcgtggccgccttctcgccctcgagctcgcggaacttgtgcaggtagagcttgagcggctcgacgtagtcctcgaagccgagcgtggtcatggcccagagcaggtcgtcgccgttgatggtcttgcgcttctcgcgctggcacttgtcg

SEQ ID NO: 1779 - DNA, 612 bp, Zea mays
gattttttttttttttttttgggagaacagtggtggcatggcaggcattgccactacccttgctttcatcacatttcagagaacacccaccactcactcgtcactgctcactactctacttgctcccacacactcactagctactcctccaagtggctgccacccaaagaattgaaagaatcaaattttgtatatatcagtttcattgatatacatatttatatatatcccaatatattgatcccaatatatcgatatataggaataaattgtaagtatagttgaggatagacctattaatttatccccaaggaggagagagaagaagaagaattaaagagatcaatcagtacgttgcgtgtttgttaacaagcaaaagaattcatgaggctggctgctagctaaggccaggcatgcagatgcagggccgcgctcatgtcgtcaataatggcaatccaccagtgctgaggctgtcagcatatgcccagccttgctgccgtcgttgaactggccgagaccgagcatgacggccggcggcggaagaagcgacacgacggcttcctcgtcggacggcgccggcaggttgaggtccagctccaggttgactcgtgc

SEQ ID NO: 1780 - DNA, 300 bp, Zea mays
ttttttttttttttttcgtgaatgtgatacgccaggcacgagacgggcgaacgcaagcgcgccggacatcgagtgtctgaacgaaaaaaagcaacgccaaccgacgaaatgactatgaaaaatacaaagaaatttcggcacaaaagctttgcgccgggacggcatcatcaagggatgccaggggcggggggcttttacggggaacttgtcgttatgacaggtaaggcttgcgaagctgcttgggcgaatctggctggaaatcctggaaaccagggttcacgtccgattcgcctgtgcatc

SEQ ID NO: 1781 - DNA, 445 bp, Zea mays
  misc_feature (395)..(395): n is a, c, g, or t
  misc_feature (435)..(436): n is a, c, g, or t
tttttttttttttttttttttttttttttttttttttactgcacgaataatccttctgatgaaccgtctgctgtagctacacacaagacagccctcacgacgcaccagccttaactgacctactcgctccttacactagctaatagcactagcacagagacccgaccttggtaccagctggtgctggatatgctcaccttcacttcacctccacacacctcgcctcgcttgccccaccccacacacaacaaaagcacacacatgacatgcatggttttctcgtttcgcccgcttcttattctgtttcaactttcaaaacatacagctctagcacggctgggctgtgccgccgtgccgtgctccggcgcggcggccgcgatcagtggccgcccgcnctgacggcgcggaactggcgcttggagatcttgggcagcnngaacacgcc

SEQ ID NO: 1782 - DNA, 938 bp, Zea mays
  misc_feature (345)..(345): n is a, c, g, or t
  misc_feature (348)..(348): n is a, c, g, or t
  misc_feature (351)..(351): n is a, c, g, or t
  misc_feature (582)..(582): n is a, c, g, or t
cccgggctgcaggaattcggcacgagcagggggagaggggaaaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggangangangcggcggcggctacggctcccgcggcggtggcggatctggcggcggcggtcgcagctacggtggtagctggggcggcggccggagatccggcggcgggggcggtcccggcgcgtgctacaagtgcggcgagcccggccacatggcaagggactgccctatcgccgacggcggatgcggctacggcggaggcggctacggcggcggcggctacggatgaagaagctgttaancgttgtggttgctttcaattgtggtgagccttgacacatggccacggcactgctccaccagcccgccgcggctttccgtcgtgacccgccctcgctggtccgtatctttttctcttacaagtcgcaccgccctgcttctctttctttgtatcctcccaccactcctcttgttccttatccccccgtgttatttcccccccgtcgcactccgcttgtacccccgaccttcctcgcttctctcattccttcttttccccgctgcccgttgtttgttattctgtcacctccttgcgattcttctccgccttctgtcccttcttattttttcgtcgctctccttctctgggtgcctagaa

SEQ ID NO: 1783 - DNA, 730 bp, Zea mays
ttttttttttttttttttccgcaactagagtgggaataagcatacagatttaacaagtcacagtggtgttctcaagactgccaacatcatagattgatacaagcaggtggctgtggcattcagagctcagctggaagactgcccctcccgcgcatataggtcgagcgagtggttgatataccggcatatcattttttggccaaaaggaaaaataacaaaaactgcaggcgacgcttattaccgataatcccagtctaccgtatattaattaagatacactacagcccattccctgagtcgcggtgatttgttgatgacagaaggcccatctgttctgtaagatcaccgatgttccccactttgctccatccgttctcctgtggcgaccccgaatcaacttcatcgttatcggcagagagagggctgcctaccaggaactgctcccagaaggagtcgatgatgcctggaaggctctgagtctcgtcgttgttgttgtacatggtctcatcggtctcgatggggacactgtcatcgccttctggcagaggaaactcaggaccaggcatctcaaaggcccctccagggatatcgacggagccttcattcaccaagtctgccagagctgagaattcaggaatacccatgtcaattgtagccttcgaaacaggaggcacagcactcatgctgggcacttggttagacgacatgttgtccatcacaactgggcact

SEQ ID NO: 1784 - DNA, 785 bp, Zea mays
ggcacgagggaagttggacaagtacgaggagaaaagtaaggcttacttgtgtatcgacattttggagcaagaactcaagaggaaatccttcgttttggaccccatctctatctctatagaggagtcgattgccacgcctttgctggtcgataattttcacatgaggctcataaacttggaaaacagagttgcgtttgctcggatattcttcccttctgaagccaagcttgtcatgcgcatcgcacaagccgattcaacccaagagtttgccggcatcaccaacttcagcagactcaaggaagttgatctaaacgaaaccccaacgatgcagaataggaggcttcgcgaacgccttgatgccttaacaaagacagttgagctagggagacgatacttcccacactgttcggacgttctggataagttcctcaacgaagaatccactgatccgatcttccttgagactgggaccccggaggatcagcaagtcaagaggatgcgtttctctgagctcagagaggacgtgcgcaaggcgttcacgaaagataaggcagcagtggctgcaatagcttcctcggcgtcctcgtcttcgtctccgaggtgcagacgacccaataggaaatcacggtgatgtcagtctgttcaggacacctgcactgggttgtgtgtgttttgacatgtaacactgtttcagtagataatgctgattgtcagatttgctgccgctctacagaagattaagcgaccgtctgtttcaagaattattcagacagttaaaaaaaaaa

SEQ ID NO: 1785 - DNA, 434 bp, Zea mays
ttttttttttttttttttgaaaaaaaagctaacaagaatatattctggggcgcacggagtattatttagcatacatactagtaggtgtaatgtatctagctagcagaaacgaaataaagtaaaaaaaaagttagggaacaatgaatcaacaatacagcttaattttgaacatcactgggtctcactgttgctggtggcagtgttgttgctgctgctcgtgaccaccgcattgttgttgttggcgttgctgttactcgtcggggtcaggccctgctgctgtcgtccttgcccctgcccgccatgatgaattggaatcggaactggatggcctccgccgcctatgatggaggtgatggccgccgccagcgccaccgtgaagttggggtccgaggcgatggccgccgccgccgcagcggtgacggtgttcatgtgcg

SEQ ID NO: 1786 - DNA, 928 bp, Zea mays
cggcacgagtgggttccggtcccggccgcccggccggctgcgcgattcgattgtagctctcgtccccgggcggcgtccaggatggtgcggggcaagacgcagatgaagcgaatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtttgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaaaaaaaaaaaaaaaaaaaaaaaa

SEQ ID NO: 1787 - DNA, 1341 bp, Zea mays
ccacgcgtccggccaaaacccttacgcgcgacgcggccccctcctcttcttctctctcccaccaccgccctccccttgccatttttggtgagtgccccctttcccttccctagaccagatcctcgccccgttttccacttttgcctccaccgcgccggcccaattcggataacaagctccctccgcctcgccgcgtctcctcccagccgcaggagccgccgccatccgatccggaagagggaggaggggggagggaggaggatctgtgtcccgattcgattgcagctctcgtccccggcggtccaggatggtgcggggcaagacgcagatgaagcggatagagaacccggccagtcgccaggtcaccttctccaagcgccgcaacggcctgctcaagaaggcgttcgagctctccgtcctctgcgacgccgaggtcgcgctcgtcgtcttctccccgcgcggcaagctctacgaattcgccagcggaagtgcccagaaaacgattgaacgttatagaacatacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagagctgcacagtttggaagtgaaactcgaaaagagcctgcattgcatcaggggaagaaagactgagctgctggaggagcaactccataagctgaaggagaaggagatgaatctgcgcaagagcaacgaagatttacgtgaaaagtgcaagaagcagccgccgccgccgccgcctatgctgatggctcctccgccgcctccagcgccggcagccatcgatcacacggggccgaaggatgtcgggatggacgtggagacggagctgtacataggattgcccggcagagattaccgctcaaacaacaaagacatgactgcacagtagctgtcaggtcaggtcaggtcaggctagccagcagtgcagagaataatcttagatctgtggtgcggagaactggagatgcaagccaagcccaagccaatcaacatgataaggatcatgagtgtcgcgtcgtgttttacaaacctgtccaccgtccgtcaaaggcacatgcgccagaacgtccgtcagagaacacttaccccctcatctccctctattagctagctgctccggcctgctcatgtcgaaaccttctgttcaagtatgttctcctcctgatgaattccctgcccggcatgcattggtgagcttcttctcgagaagaagtgggtggggtggggacactgtcg

SEQ ID NO: 1788 - DNA, 2262 bp, Zea mays
cttgcttgggtgatccgggtgcctggtttctcggttccgcggcttccgctgctgttggattcgccgagccggagccggagccgccggagatgaccgtcgacgagctgaagctgcaggcgagggccagcggcggccacggcgccaaggaccagttccccgtcggcatgcgcgtgctcgccgtcgacgacgacccgacctgcctcaagatcctcgagaacctcttgctccgctgccagtaccatgtgacaacaacgggacaggcagccacggccctgaagctgctgagggagaagaaggaccagtttgaccttgtgatcagcgacgtccacatgccggacatggacggcttcaagctcctcgagcttgtgggcctcgagatggacctcccggtcattatgctgtctgcaaatggggagacacagacagtcatgaaggggattacccatggagcatgtgactacctgctgaagccagtgcgtattgagcagctgaggactatatggcagcatgtggttaggcggaggagttgtgacgccaagaacagtggcaatgacaacgatgattcgggtaaaaagttgcaggtggtgagcgttgaaggtgacaatggcggtgttaatcgcaacaagagaatttcacgcaagggtagggatgataatggtgatgacggtgatgattctgatgacaacagtaatgagaatggagactcgtcgagccagaagaagccaagggttgtgtggtctgttgaattgcaccgaaagtttgtggctgctgtcaaccagcttggcattgacaaggctgttccaaagaaaatattggatcttatgaatgttgagaacatcacaagggagaacgttgcaagtcatctgcagaagtatcggctgtatctgaaaagactcagcgcagatgcaagcaggcaggctaacctaactgctgcatttggaggaagaaaccctgcttatgtgaacatgggactagacgccttcaggcagtacaatgcatatgggagataccggccagttccaaccactaaccattcacagccaaacaacctccttgcaaggatgaactctcctgcatttggtatgcatggtctgctgccttcgcagccacttcagattggacacaaccagaacaatctgaacacttccctagggaatgtcggggggatgaacaacggcaacttgatcaggggtgcgcatatgccactgcaggatactagcaaatgctttcctactggcccttctggtaattcgttcgcgaacatatcaaacagcacacaactggttacgacaaacaacttgccattacagtctcttgagccaagcaaccaacaacaccttggtcggctgcattcctctgcagaccctttcaactcatttgttggtgagcccccccagtttgcagatcttggaaggtgcaacaccacctggccaaccgcggtctcatcatccaatgttcaggagattggccagaaggacaggatcgtgaataggcccaagcttgagcctctctcaagctttacagaagcatccagtcagatccctttgctgggaaatgaaatgcagagccaccaagtagcatcactagccagcaacggtcttccgatgccgttcactcaggaagcggtgcccttcgcttatggaagcagcacgaactcgagagagatgctgaataacaaccttgcgcttagtaattcaggcgtcaactctacattgccgaaccttcgcatagacggttctgttgttccagggcagacactgggtggtagcaattcaggtggttgtgttgtcccccctctgcaagatggcaggattgatcaccaagctgtcagcagtcatctaaactacagcaacgaactcatggggacaagtaggctgcaaaggggactcagtggtggtctggatgacattgtcgtggacatgtttaggccggaccgcgcagacgatggcgtccccttcattgatggggactgggaactggtctagcaggtttcagttctctacatcaagtctgccttcgtgtgagattttccgcatttgtggttgtggaggggttcggcgcttgattggtccaaagttgtttatagtagcaagattgcatcacaaatgccctttgcatttggtttttcagtttagcgaccaggttccagtgtcacgtccgaatatcaactatgtggtatttgctaccttaactcgtatggctatgttttcaagtcaggtgttaactgtggctatcgtgatatatacagcatggttatgagcc

SEQ ID NO: 1789 - DNA, 600 bp, Zea mays
ttttttttttttttttggccggctttgtcaattcctagctgattgacagcagcaacaaattttcggtgcagttcaactgaccaaacaacccttggtttctttggagctgaaggatcatcgttatcttggccattactctcttctccttcatcttcctcttcactatgatattccttcctctttttgctgggcctcccactttggtcaggtggcccagctgtaatttggctgtgagcaagatcaaaatctgcatttgatggcctattgcactcctcatagccatcattgttagcacgatcacagttactgaatttcctcctaacaacatgctgccagatattcctaagctcttccagccgaaccggttttaagagatagtcacaggcaccatgagttatccccttcattacagtttttgtctctccattcaccgataacataatgacagggaggtccatttcaagccccacaagctctagaagcttaaagccatccatgtctggcatgtgaacatcactaataacaagatcaaacaggtccctgttttgcctcagcatactcaaggcgacaacagcctgattcgtcgttgtcacatgatac

SEQ ID NO: 1790 - DNA, 614 bp, Zea mays
  misc_feature (550)..(550): n is a, c, g, or t
ttttttttttttttttttcagagcttcgcgacaaaaccatgcaagtactgaagtacatatcaatatcatccatatcacacttctctacatcgctaaactaccatccatgctcaccaatgacatgtagtccatgtccatgaccatgaccatgaccatgaccatgtagtacacaatgtgatcccgcaagcctctgtcttctgctcctagcggcgttgcatccgtacggtggcgtctccgggaacgcagccttggccagcgcctgcctgacgccctcctcgagagccttcagcgtgcggcagccggcgccgtcctctctgcacagtacgaagtcacactgagccctgcctcccagggcggccatgtccgccctcagcggcctcagcctcatggcgcgtaacgctccggcgaggtcagcgtggagccccggccggtcgtcacagctgacggaggccctgatgtacgtcgccgccgctctctcgtaggcagtggaggccgtgccggtgcagcagacgacggcgatctcgttggtctctccggggatggtggccantggtggctgcgtggtttcggccgatttcttcttgaggtccttgagttggcaaaccacccgggct

SEQ ID NO: 1791 - DNA, 759 bp, Zea mays
gcacgaggtcgagccttggacatttgaacagaagctaggtgaggcagtatttatcccggcaggatgtccccaccaggttagaaatttgaagtcttgcataaaggttgcactagattttgtttctccggaaaatgtccgagagtgcatcaggttaacagaaggtttccgtctgctgccgaagtggcataaggtgaatgaagataaactggaggttaagaagatagctcttcatgcattcaatcaagctattaaagatatcactgatgaatcatctaatagcaatgaaagcaaatggatccggagataatgaggatcatgaaggccattgaatccatgcttgatgtcatggaagttagcaccacccgcattcgacatcttgctatcgagaacctgaatgaaaaccgtagtggcttatcggatgccgacaagataacaaaacctgattttagtgtactatgcatgatattagtaccttatataatacgtagcttggagaaaaggccattcaccgtttctcattgttgggaggttctaaagaatgaagccaaatggttacacttggagcagggctcacaaaatattgatgtgctggtgaacaaaggtgtagggttttctccaagatgtcggatttgacactgaagaagattgagtattggaagaggtccgattgaacatttggcactgacattcaccaacttgttcaaatagaggaaaaggatatggaaatggagaaagagcgcatgtatgcatgtgtaggtc

SEQ ID NO: 1792 - DNA, 836 bp, Zea mays
ctcatggatcgttacagagcctgcctggctacattcacaggattagtgtttctccaaacaatagccaagtttcagcatgtgtaccgacagcggctgctggtagtttcttctacttgggagttgggtgtcatatacgactggacagaattattagatggtagtacataacctggaaggagagctaatgctgggtctggtgctgcttccacctcgacgccatggactgcaaaaaacataggaagcgcgaccgagcgagcgggtccgtcacaggccagccctaaactaagctcggggcgcgtaacgagctcctgccttctgtttcagaactcgaccgaacccacggacgcgatcccggtgcttaggctcctcgactcctgcctgctaacgtagccgtcgcagctgctacctagcctccgcgccgcggggccgagctcaggagctccaggccctgcttgcccatctgctgcacctcctgcggcgagagtatctttatgcaggacaccgtgctcgcgaattcccaagactgatggacggtcatggtaaattactgccaagggtcgtcgcccacgagaaggacgtcctcctcgcggtcgacgaatacaagctgccagcctgatctcagagggtcttccaactggccctcaaggccaaataggcgccctagttccctacggagctcgtgatagctactaaacctggtgatatcaagcgaccttccgtaggttccagatttgtaaaccttcacaaaggttgctggtggtcggttcacttggtcagaattatccgaacatggcgggacgtaccctgaatcatctaagcagcctgaagaattcagc

SEQ ID NO: 1793 - DNA, 708 bp, Zea mays
ttatccttcccattgtgmcagagaaattsccgaaacaggmcaaaytcaagcaggtttgcsaacctttkvtgaaggdtttaccaaattccgggacccgtcggaaaggkttgcctcsacatcawctagatttcagacagctamcgacgagcctccgtagtcgaggytggggcgytctgytttgccctcgagggcccagctagaagacccctctgagahtcaggctggcagcttgtatttgttgcacagggaggacgatgtccttctggttggcgatgacccatggcaggaattcgtgaacagtgtgtcctgtataaagatactttcaccggaggaggtccagcggatgggaaagccgggcatccagctcctgagctcggctccttcaagaaggctgggcaatggctgcgacastacgcgagcatgcaggagccgagaggcctggacgctgggatggcgccggtgggttcggtcgagttctgaagacggcggagggaagcccaccatggccctcgggtcgaggattactctccctcctgtatgtttctgcagcacttgctagctctgcgacttggaacaaagcacgtagatcaaatggagctctgtgctgctccccgtctgatgatgttttatggtatagactcgtagcagtaactactacatgttgtatacatgccggcacttcagttcttatcgagtagcaataccrct

SEQ ID NO: 1794 - DNA, 620 bp, Zea mays
  misc_feature (44)..(44): n is a, c, g, or t
gaatctcttgctggtcatgagatccaacctctgcagcacaagcntgagaaagttagtcaccagagtactgtgtctcactgttctggcaccttgccgccactatcagcaagagacggttctagtgcccaggcttgtggtacaaatgttcagagtcacctgcttccatcatcatttgcaattcatgtatggattgtcaaccatcaggagtggtggtgttggcagtggaactgatgcgataaccatagcttcgttgagatatagtgatgcgaatttgctacctgaaaactccatagcaacttccagttgtttgggtgaatcaggaaccttcaattctcttgacgatgtttgtggtgtaaacccatcacaaggtggaacctttgtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtagggtgcataaagatcctctcgccgc

SEQ ID NO: 1795 - DNA, 635 bp, Zea mays
  misc_feature (594)..(594): n is a, c, g, or t
acaaaggtgacaggtaagagttatggaacccatggattttagatatgagaagatatagagaactacagggctaggtcacctctacagtgagtgcctgcatccatactttcatagaccaattcttgcctgccatttagagcttaggctatggctacacgtagctacaacagctatcgtacaacatgtccattaccataatgatacaatggatctagctatattaacgactaggttatttctgaccaacacaacttgagagaagatagatcataggaaccgaaaagactcgtggacggcaatcctgcggtgctgaattgccggttttggttcagaacttcagtttctggtcttcatctcggtctcagtagtccagaggcaccacaggtgcgatgctgccggtgagattctgcatgtcgtggcctgcagaataatcatcgcagacactgccctgcagtgtcctcactccagttgtagacagaaggtcgcctccgccgcggaccatctgctgcacgtcttgcggcgagaggatctttatgcaccatacactattcacaaactcctgccacgggtcatcgccgacgagaagaatatcgntttcccggtcaacgaatacaagctgccagcctgatcttaca

SEQ ID NO: 1796 - DNA, 1555 bp, Zea mays
  misc_feature (27)..(27): n is a, c, g, or t
  misc_feature (40)..(40): n is a, c, g, or t
agcagaagccccagatgcaacaccagncaagaatcacagncagcagcagcaaccacagtgtctgccagtcccccaacatcagcaaatgcaacaacagaatatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtttggagaaatactaatcatctggatgtcaacaaaaaaaaaaaaaaaaaaaaaaaaaaaaaaaaaaaaaaaaaaaaaaaaaaaaaaaaaaa

SEQ ID NO: 1797 - DNA, 1067 bp, Zea mays
aagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcggtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccctgggagtcatttgtgaatagtgtatggtacatcaaaatactttcacctgaggatgtgcataagatgggaaagccaggaaacgatccacgctacctatcttagctacctatcttaaatcgatacatggagctctttctggctcccatgacgattctgcggcacactgcagcactgttcacgacggcctgctctactgtgctcgcatgttcgcccgtgtcatctctactctctagcatgcacaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtacttcaaaaaaaaaaaaaaaaa

SEQ ID NO: 1798 - DNA, 555 bp, Zea mays
cctctgaagcaaggagggagcaattttattacaaggatatgttagatacgcggccacatttggctgaatttgttgtactggcatacatcaagtccttcaaggtaaaccgccacaccaaaaaaagaagaagaagaagcttaattacagctgacaacagaagcatgttatgatgaggtggctcgatccaaggcaaatttctagccaacaaggtcattatgtgaggcaaggtaaccacacttcgcccgccccaattggctaaacctccatgatcagaaacattagctagcgtcttcagaaacgctggccatgctttcggtctcgttgtcgtcgtcgtcagcatcatattcactgccggaactatcttcctcgtcggattcagaaacatcaccaatgtgaagatcagagaaatgattcgtagccaggtgaggctcttggcccttccctcgatccaatccctccattttgagcaaagaagcttctctatcatcaccgcaaacaagatcagatttctgggattgtgaaattccataaagtgcgacatgccggtaataaagc

SEQ ID NO: 1799 - DNA, 352 bp, Zea mays
tgtagatgacggtgaggacaacgacgaggaacaagatgaagacgacgagaggcaaacggcgcggaagcagggggttaaagcggccaggaggaacgagacgtcggatctggacgtgctgacgctgtccgtgcgggcggtctttttttcgaggacgggcggaggatcacgtgaccgcaaaagccccattaccgcccaccccgataggagcctcagcctagggctgaaatgactgacactcgtgtagagtactgtagtatcgattgtagtattgtattgagtggtgctgcacgcttgaattgaatcatctagaaatcaaaatttaaaaaaaaaaaaaaaaaaaaaaaaaaaaaaa

SEQ ID NO: 1800 - DNA, 521 bp, Zea mays
ttttttttttttttttcgcaaaaggtcgtcaattaattaactcaatacaaatcagctgctcgttttgatttgcattacacgctgcttctacagttccactacctctttatcatcttcttctctctaccactaacactgggggtcactgaactgaacgtgagctactacataaagcatcatgtagttcatcataaggaggattgcgaaaggggggaaaacgagggggagcgattaaattagagcaaaaggaacctaagctttggggttggactttctgggcgtacggtggtgcgttactcttctgggctggagtcggacaccggctcgtcgtcgtcgtcgtcgtcttcttcctcctccggatggttgacgtcgctgcgaccgccgcgctgctgctcgtgggacccggaccccaggtgcagatgctccgagttgctgttgtgagacaagctaaatatgggctgctggccctggaagtcggcgacgttcaccgccgcggggaacacggcggcctgcgcgccgcg

SEQ ID NO: 1801 - DNA, 532 bp, Zea mays
gcacgagggggaaagaaaaaaccaaaggtgggagaagaggtgggagaagatgaaatcgaagagctctcaagttcctcccaggataacgacgcagatgatgatagtgacgaggactgggccgaataatgcgatggtacaggcggcggattggttggggaagcatatgcataattgatgtgcggttgaagagaaggatggattgggggatggcacagaagctgcctgttttcatggactggtttggctggtcatgtctgacgacggatctagaatatggaatatcctgatccgttgtcaagctgagtccatgaaacgttggttgatgaaacattagttagtcagaagcgggtttgtttgtagttaggaactaggaacacacacacccgaggtggtgatggggttgcatacttggactagccattcccattccattcgtctgtactctgttcctttgtgtggctcacacctgttgtgtttctgatggtggtcatttctccagccaggggctaagaaaaaaaaaaaaaaaaaaaaa

SEQ ID NO: 1802 - DNA, 579 bp, Zea mays
ttttttttttttttttacagaagacttgtattttagcttttgaatattttcagctaattttaggagctgtgcattcaaacacgcgttagtcaaaggttcgcctcagttaaaggtttcttcatgcacgccgcagaagactagaatcttgcagcagtatttgcatggcaccgaaccgacggctgggatgatagaactgaaccgacctgatagaggccatccgagcaggcgccgacgtcgccagcggacgcgtcgtcaatgaggaagtcctcgacgtgccacccgggcagcgtcttggtcaggtactcggagatgctgctcccgtcgctggcggtcgccgtggtcgcgccgccggcgccgctgccgctgctgcaggattcgtcgttgcaggggccgcggctgttctcctgctcctcctcttcggatgggcccgcagagtccaccggcgctgacgagaggcgcacgccggtgagcaggaaccggctgtgccgcctcgtcatgtcgctggcgctgtgcaccggcgcgtcgcactcccggcacaggatcgccctgtcctccttgcagaacaagaagcccctccgc

SEQ ID NO: 1803 - DNA, 533 bp, Zea mays
gtcacctttttttttttttttttttggtgtgaagtttatcacatatgtgcactaggaatccaagctcggccttgaattcggtacatctgtgacacttacacagtaaccaccacagcacaggacgcatggatctcacaccttacatacgtgtgtatatatatatatatatagttacaacagcttacaagcgactcattctcaacgggcgactcatcttccatgggcacttcatgagcaccagttccagcagccaaacgacggcggcacccggccggtcctcctgatgtgctctgcctgctcagcggtcctcgcggctgcgcggttccgtttcagctccgccgtggcacgcttctcgtctgcgctgtgcctcgccgacgcgagcttggtcatcagcttgtcttgcgcgcgggcacgcatccgctccacctcgacctcgattttcctcatctcagcttctatctgggctttctgatggtcctcccaagcctggatcttgatctcttctcgcttgaatctcgctaaatacttggcct

SEQ ID NO: 1804 - DNA, 482 bp, Zea mays
  misc_feature (150)..(170): n is a, c, g, or t
aaatcaaatccagtcacaactagcatggtgtgaagtttatcacatatgtggactaggaatccaagctcggccttgaattcggtacatctgtgacacttacacagtaaccaccacagcacaggacgcatggatctcacatcttacatacgnnnnnnnnnnnnnnnnnnnnnacaacagcttacaagcgactcattctcaacgggcgactcatcttccatgggcacttcatgagcaccagttccagcagccaaacgacggcggcacccggccggtcctcctgatgtgctctgcctgctcagcggtcctcgcggctgcgcggttccgtttcagctccgccgcggcacgcttctcgtctgcgctgtgcctcgccgacgcgagcttggtcatcagcttgtcttgcgcgcgggcgcgcatccgctccacctcgacctcgattttcctcatctcagcttctatctgggctttctgatggtcctccctcg

SEQ ID NO: 1805 - DNA, 678 bp, Zea mays
tttttttttttttttttggtaaaatttaacatttatcttgctgactgaaataacaaaacccgatcagcaagttgagaactgacacaaaaaaagtaaagaaagaaggaaacaaaaggtaatgaaacaagctattcattaagatgttctaaaagccctgttggcttctgctactgcacagttcttaggaagaggctcctctgctcctccctcctgtcatggagacgacgacagggctgctgccgatccgatcagacgtgtatttgatgctcttctcctaatggatagcagaggcttggcactgcggtgtcaataatgtcgacttgtattggacgctcttctcctcatggatagtagaggcttggcattgcggtgtcaatgtcgaaggtatggtcgaatccaaagcactcgagaggcatgaattcgtcgtcgagcaccggcaggggcgcaaccgacgagacggcggcgaacgcagatgacaccacctcctggaggtcgccgtccgaggtccattccctgtacccgggtaccgggcacggcgagacgtcctggtgcatgcagccgttggagtcggaggcgacagacgacgcgagcgaccacggggatgatgcgccccgcacggggcagctctcgggcgtcatgggcgggagcgcggcggcgtccgtggcggtggccaccgtg

SEQ ID NO: 1806 - DNA, 681 bp, Zea mays
tttttttttttttttaagacacggacagatggatgatatgcatggttatacacacacgcacacaagcatacgtttgcatttggctacagatcgactggttgctgtgtaggatgtatgtagtaggaccgtacgtactcacccttgtcgatctatagtagtcggtcgtcgccggagcctctgctcgacgacgacagtggcggcggcggcggcttccagctggtgtggtgatggtggtgagcattggcggcggcagcggtagtagtggtgctgttactagtagtgttggtggctgcgtggtcgacctcggatgacgacgggtcgtcgcggtcgtcgtcgtcgtcgaagcagtcgtcgacgccgcaggcggcgtggccgcggccgaacgcccggatgtggtccttgagggagcgcttgtgcttgaagtcggagccgcaggcgcagtaccagagcctgccgcagttcttctcgtgggtgcgccagtcgccgcgcacggcgaagggcttgccgcacttgcggcacatgaagggcttgatgccgtgcctgcggcggtagtgcgtctgcagcgtgcggaagtccttgagcgggcgcgcccgcgggtggtcgatgttgttccggcagcccgccgcgcagcagtagcacggcagccgcagcatcgccgtcggctgcgtgccccgcagcgac

SEQ ID NO: 1807 - DNA, 684 bp, Zea mays
tttttttttttttttttttctgtaaaggtaatcaagcacggatggttagatatgtctttgtatcgcggcactatatcattaagggctccatttcgcggcaggaaacctcgtcatttccctgtaccgacaacctagtatgaaatttacacgggacagagattcaacctctttggaagacaggttcgtgcggatatcagcccatcccaaggcaaatttctgcgtggaaacgcatccggcctctggacgtcgggcgactttccacttctcgagcatgtcgcgtctcctctcgcctctcgctcagagtcgctcgagcacgccgccgccccgcttccgctcgcctgagcacgctgccactagagtcgcccgacgttgccgtctccgtcgactgccgttgctcgagcacgcccccgctcctctcgcctggaggctggagtcgcctgagcacgtcgccttctctggcctagagtctccgagcatgttgtcgcctcagtcactccgcctcctcaggtgaggggttagccagcgctgctcgcatcttcatgccctttctactttctgcttgtccttgctcagtttctcatagatctagggaagaaaaggtgcgggcagaagtagtttcttgtagatgtaaattggtggtagctagcctgtcgttctggatcttgggaagaaaggctcgtgccg

SEQ ID NO: 1808 - DNA, 718 bp, Zea mays
ttttttttttttttttgacacaagtttatcaagattttattatacctcatcggagtgattacaaaagaaagtgtttcaaaagaattacactttaaaatgttatagaatatttgtaaatttgaaatacatgctagcttaagtgacaatcctcgttaaagaaactataggagggatatacttatataagaaggccgatcccaccggcacttagcaccatccacaacagaacaaaattacaatcctgagataacactatgttagtgttgttagatgatggccacttgacgatcaacttttattctgacacccgcttagtccatctagcttcaggatcatcggccgacatcgtcttgtgggttgttttgatccacacccctcgcttcgcacgattttcagctagcgtacctgcacggcgaacgtgtctggtgtgagcacacgagccgaaactggaagacgaaggcggggtaaatcagtggagcggttcgagctagaagatgttgtgctggcgatgcttcaccgacgaggagacttggagcagggcgcacggttctagtgtgtgcacggctggaggcgaggtcgaagtcgaggacgcacagcccgacgaggaacagggaggggcgatggcgagctggagcgcaggggcgagctcacatctggggaggtgaggagggcggctggagattgaggaagatagaggctgggcggctagtgctccatg

SEQ ID NO: 1809 - DNA, 599 bp, Zea mays
gcacgaggccacttcagtgcttgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtgggggtggtgctgccgggcggcggcatcgacctcgacggcgacggtgacgaggacgagctgccgcagttccagccccacctcatgatcctcggccatggccactgatgagtgtaaatggttggttggttggtcgtcctcagccgatctactggacgacacgatggcggtcacatttgcgtccgaatttctcttgttaaattgaggccagagtgattaaatgagcatatgatggtaatttattcaccgtgtattgcctgttcaaacatgaaagtgcactgatacaattttaaaaaacttaaaaaaaaaaaaaaaaaactcgctcgtgc

SEQ ID NO: 1810 - DNA, 725 bp, Zea mays
  misc_feature (719)..(719): n is a, c, g, or t
tttttttttttttttttttggcagttcactggtaaggaccacgagaggcctgaaaggaaccattttggtcaagatggtcatgtacttgacctttccttttttgagatttgtgatccagaattctccaaaatcaaggaatctgggaatgtgtgggcttcaatcactgatcttgaaccaaagttacttgctcatcagagaaaagccttcgaatttatatggaaaaacttggcaggatcattacagcttgaagaaatggatggctcaacaagtagaggtggttgtgcggttgcacatactccagaagcgggtaaaactcttctgctgattttgtttcttgtcagttacttgaaagttcacacccaagaagccggccattggtcctcataggtatgctcatggaatcaatagtatctcgtgcttggtctccattgatgatctggtaaatgatgttgtcgtcgaccatcttgatgttgaattccattcccctcaggctagacaaaactatggtatgcgaattctagggagaatctttgcacttagcagcttgcttctgttatgatggaagcagtccactacagaattccatcgcacgctcccatcctggagctatgtaattaaggcctgatctatctcgccaactacacgctccttcgtcttcccaaggcctcgacattagatccactctggccagcacaaacgcggcgacgtgtacggacggngatcgc

SEQ ID NO: 1811 - DNA, 234 bp, Zea mays
atcatcaatcaccatgtgtgcagtgtgcgtataatatctgctgtcaagggatcgattattcctctctctctctctctctgctctcgtagctccttctgatttatcgttattatgtagcgacaacaacgaccacgaccaccatcatcatcagtgagaaacctcttgcctctgtctaactcaaccgacatatatggttcagcttttttctgaccagcttttctgaaaaaaaaaaaa

SEQ ID NO: 1812 - DNA, 795 bp, Zea mays
ggtaactattcccaagagttgcttaactcgttgactcatgcccttcaaagctcaggtgtagatttgtcccaagccaacatctctgtgcagatcaacatgggaaagcgtgccgccaagagacccgctgctggtgtatccagcaactccaaggaaccagctgatccggcatctagcaacgaattagggcatcagttgacgctgtcgggtgccggtgccgactgcctctctcacgcaacaaagcggcataaacggagcaacagctgatggccgctctccctcacctcgctccccgaccgacggacggacggatgacggattggtgacattcttcttttccctcccagccaacggggaggctcgtggattggctggctggctgtacattgtgtgctgtgcttggtgacaagctgagacctccggcgtattctttgattcgatcacccccccgcccgccatcccattgtttacgtagagaagaggaaccgtggagctttccatcgcggattgtgaagccgctcttgtacacaggcttccattcaatgtgagaagcttccccctccttgacagatctccgtgttgtagacctgtagccacctgtaagatatgtgatgatgcccaacaaacaactctgccagaccactggctagtcgagttgttgggttacttatgtacggtgttctgttatgctgggagtgtaattgccctgctgtctcagtgaactgatcgtcagttgtgtgcctgttgtgccaaaaaaaaaaaaaaaaaaaaaactcgagactagttctctcctcgtgc

SEQ ID NO: 1813 - DNA, 661 bp, Zea mays
ttttttttttttttatttcttttgaaaacatatgatggttcacatatttcgcaacataaccataagtatccagccactaaagttacagaaagaacctgggtaacacccctaagacaaagtagcatgacaattgttctgaaacagcacatataaggaagcttcctacaattgttaactgacaataatggccaaaattcttattacggtacattgcccacaccattgcttagttctgacatatttcactaattgcgcgcaaacataaatctctggatatctaatggaagtggcaacaccttgttgatgcgatggaatgtgagttgatgaagggcatgagcacgtaggtctcgggaattgtctggttgattgaaagaagatatgacacctgcattgtgatcataagacttcatgtaactcatcacaaaaaatccacagtcatttgacccgcgcacgtgcagcatatgatccagatcacctttcgctgacagcgtcgttggcatgcggtacgaaggtgcgtactcagggtaattttcagtaaaacccatattttggacggtgaaattctcctgctgctgggagtagtggtggttctggacaggaagtgattggatgagtcctctcaagttcaccgacagcaggctagtgcagtgcccacaacgga

SEQ ID NO: 1814 - DNA, 1001 bp, Zea mays
gcacgagcacacagctagcagacagccagacacgcgctgctttctgatctctccccggatcggaggctcctcccaacataccaccctgccagccgcgccgccacgtccacgccggccggccaccaagcaagcatggatatggtttcgcagtccgagcacctgtgctacgtccgctgcacctactgcaacaccgtgctcgcggttggggttccatgcaagaggctgatggacacggtgactgtcaagtgcggccactgcaacaacctctcctacctcagtccacggccccccatggtgcagccgctctcgccgactgatcaccctttggggccattccagtgtcagggaccctgcaacgactgcaggaggaaccaaccgctgccgctggcttcgccgtcatcaactgagctaagcccgagaatgcccttcgtagtcaagcccccggagaagaaacaccgcctcccatctgcttataatcgcttcatgagggaggagattcagcgcatcaaagctgcgaagccagatatccctcacagggaggccttcagcatggctgccaagaattgggcaaagtgtgacccgcgctgctcgacggctgcctctaccgaaacttctaacagcgctcctgctgagcctagagttgtgcccactccccagttaactgagccacgctttgacctggaggatagggccaaggggcaagtcattgagagcttcgacatcttcaagcatattgagcgcagcatctagaggtcgttcgatgccgctgttgtagcccagtatcgatcgagtaccatcagctatatgtataacctatcccgtatcgccgtcgtcgcctcgcaatcatgcatccccatcctgtacttttacccccgtacgtgttactgttgctgttattctcgttatggttggattgtacgcaccatttaattatgaacagctgctacctatatatataatatttgccttcttttttgttcctaaaaaaaaaaaaaaaaaaa

SEQ ID NO: 1815 - DNA, 1401 bp, Zea mays
ggcacgagcggatagatgtggttagttgctctactgtttatgataactttctgccgtttaggatgtctgtgggtaccagttcataaataggcgtgcgtgccgtggaccttggtgttgctacttgctaccaatggtcatggcgaagcagcaccatgacaaggggttgccgaagcaagctcgcaatgagcccgcgccgttccggctcgagcagtgttgccgctgcgacgatgcccaccgtcaggccgacgacgagtccatggatgctgctgggtctgctggcccgctgcacctgactctcggcccgctcggctcggccgccggcccccgctgctcgtgcggtgtcgcgccggcgccggcgccggcgctggcggcgcccgcaacggtggccgtcctccgcgggtcccggtacatgcggccggcgcaggagctgctgggcgaggttgtgcgcgtggccgacctggcggctgccgacgacgaagacgaggaccaggcgacggagcggctcgagggcggcggtcaccgggcagcgcgtcgggcggccgggaaggccgggaacgacggcgacggcgtccaggccaagctcctctacctgctcagcgagctggagagcaggcgggagcgctacttcggcgagctggagcgcgtggtgtcgtcgttcgagccggcgctgggcggcggcgcggcggcggcctacacgaccctgatggcgcgggccatgggccgccacttcggcaacctgcgccgcgccatactgcgcaggctcaggctccaagccgccgccgcggcgaggaggtctctgcggcgcggcggcgaggaccaggacgacgacgacgacgacgacggcgacagcgacggcgaggtgaccgaggagctggtggacaggttggctcggcggacgaagctggccgcggcggcgcgggcggagcaagcgtggcggccgctgcgtggtctgccggatggctccgtggccgtgctccgggcgtggctcttcgaccatttcctccacccgtaccccaacgacggcgagaagctgaggctggcggtgaccaccggcttgagcaggcgccagatatccaactggttcatcaacgcgcgcgtgcggctgtggaagcccatgatcgaggagatgtacaaggacgagttctccgacggttccgccgtctccagctacgacgacgccagcgccagcggcgcctcctcatcctcctgagtcttgaccacctcgccctcgagaaagtttatctagctaattcatcactcggttgattggtcctgttgctttgggattatattaatttatttatatccatgcttaatcatgtgcctctcttgtatttttttttagaaaaggacatactccttcaaaatctagcgacttttcgaaaaaaaaaaaaaaaaaaa

SEQ ID NO: 1816 - DNA, 788 bp, Zea mays
  misc_feature (332)..(332): n is a, c, g, or t
aaactggcgatagataaccggccacaagtatgctgatgaaatgaataagtgttgtcaaactgtaataacagatacacgcattttaactaaatcgacagtgacaactgaattgccatgttgccatggcacttaccataacacaacaactcgaactttattccaagctaattcgtcaaagaggttattcatcaacttcgaccaagcaaaacacaactgaccacgacagagttctaacgaccaagtcacgaagcgtacaccaaggttttccacacgaccagacaagcatcgcgattctgcttcggcggcagacaattcttttgaaaacacacagncagttacttcgctctaagctcagtcttgcacaagtttcagattgccttgtccgaaccaccatgcaatcaagcccgctcgaccatgtattccacgagaggtttctgcggtctcccctccgtgccctctataatggtgagcctccgtgctactttcatgaagtcattgaacggctcttcaccagtatgcctgacagcaccagcagcatcacggtagcaaaggtgcctcattatttccgccttctcaattccaaacatgtccgctaactggccgtacagctcttcgtacgaaccaaagacagataggtcaatggtgcggccaacatcctctgattccataaacaccttgcagtgcccgtcttctagcccaagctcaaaagccttgcggtcttgggataggccttccctcgatcctccagaatccatctgctgctcagtaaggataggctttccgaacag

SEQ ID NO: 1817 - DNA, 1523 bp, Zea mays
aattcggcacgacacaactacactactccaaaacgaccctcaagcaggaaggccggccacccagcactcaagctagatagctcatcacagccacagcagctagagcctagtagctcactcgcgctcgtgccatgatgaatacccgagcctgtggtagcagcggcagtggcggcaggaacgaccagaccatgatgggcttctccgagcatccgaagccggcggcgtcggggcaggcgcagccgtccccgccgtcgtcgccgagcgagcgtccgccagcaggccgcgggcgccggcgcgcgcaggagcccgggcggttcctcggcgttcggcgccggccgtggggccggtacgcggcggagatacgcgaccccacgaccaaggagcggcattggctgggcacgttcgacaccgcgcaggaggcggcgctcgcctacgaccgcgcggcgctgtccatgaagggcgcgcaggcgcgcaccaacttcgtctacacgcacgccgcgtacaactacccgcccttcctggcgccgttccaccacccgtcgtcggtgcagcagcagcattacggcgccgcgccgcacgttggctcgtacggccaccaccactaccaccaccagggctcggcagcagctgtcggcgcgtcgtcgggcgagtgctcgtcgacgatggcgacggcggtgccgcccgtggagcgcgccgacggcacgctgctgctggaccgcggcggcggcgggcaccaccaccaccccgagttcctgttcgcgagcgcggacgacaactccgggtacctgagcagcgtggtcccagagagctgcctccggccgcggagcagcgcggcggcggtggaggacctgcggcggtactcggacgcggacgcctacgggatgggcgtggggctccgggaggacgtggacgacctcgcgcagatggtggccgggttctggggcggcggcgccggcgacgcggaccagctgtgcggcggagggttcccgtcgggcggagccggggacagcatggccgtggcgtcgtcgcaggggtcgtccgacggctactcgcccttcagcttcctctcccactgatgacaaatgagctagctgccgcgcgcgcatggattgcattgcatctgctgcgcacgtaatgtagatcgatcgatcgatcgatcaccagttagcctagctagctagtttgcttatcatgcatggtgatcgatcggtcctgatcatcggttcttccgatccctgctgtttaattcctttcgagagagtacgttgggtcgaccagtgtgagagtgagcagtatagtagtgttagcatttagcatcagaagtagagggaggagcgatcgagagagaagaagagagagtacgtagctgcgtgccctagcttcttcatgtgtactccgtcttcgttctagtacgtcctacaagacctacgtactctcgatctgtagctttaaccatccaactttattattaagatcatcaactcggtcgaacgcttgctcttataaaaaaaaaaaaaaaaaaa

SEQ ID NO: 1818 - DNA, 522 bp, Zea mays
gaaaattgaagaaccttgagtttttcagcattaccctgtgggagtttgcaggtgaatcggaagtacaggatagcacctagtttgctggaagacgtgcaaagagaacccttgaaattagggagtgatgctagtagaacccttacaagatcccatgtcgatgctgaattggtccgtatggcaactatgactgttgaggcggcggcggcagctgctgctcatgcagttgcagaggcagaggctatcatggcagaagctgaagcagctgctagggaagcagaagctgcggaagcagaggcccgagctgcacaggcctttgctgaagcagcagttttgacactgaagaacagaaatgctgcgaaattggtatagctcgagtccatgaatcttagatatgccctcttgtccttccacacgtagaatccagttccgtagctctgtatgcaactaattggttactaaaagaacctgaaatcagaagttttcacaaacacaccgacttattcaccgaaaaaaaaaaaaaaa

SEQ ID NO: 1819 - DNA, 540 bp, Zea mays
ttttttttttttttttatttaagttaattttatttctcttcaattttctgtatgggactaaaaactcattactttccccttcaccaaaagcttcgaaatttattctctaataaacttgaacaaaagctttggctttaaaaataccgaataccttggaacgggacggacggagtacagtagaagctttggataatttggagggagtagagtatagagtgaggcaggcaatcgcttgttccgttttggatttgtcttccggtcttccccaagaggaaactagattctggagtcgtcgccgaagcgggtgtcatctgtctcctccccctcctccgttgtacaggtagtggtacgcctggccgctgaccatgggcaccatgccgacggcgacgccgtgcaccggtgtgggtgcgaagatgtggtcggacggggacggaccctgcccccgcatccgcttcacgtacaaccggtacttctgcaggtggctggccacgttctcccgcgtcagaccttccacgttcatcagctccatgatggtcttgg

SEQ ID NO: 1820 - DNA, 2643 bp, Zea mays
ggccgcgggaattcgattgtcacagaacagttggctgctcacaatggggacactttcaatgtccgacgccagccctatccctgccaagaactgggatgcttcccctgtcaagctcgaggctcaaggtggtgacgccatcctcggcatgaaggaggaagagcgactactggagctcgtgaaggatgagcaggctgatggaatcttggattcattaccaattgacctggaggccaagaatggcgatgcatcactcataactgaagccatgaaaaaggaggaggagcagcttgaagacacccggatcaaggtgcaggaagaagaggaagccaggaagagggaagaggctgctagacttgcttttgatcctgagacacagtataacaagttagatgagctgctgacaaagacacaactcttttcggagtttctacttgagaacatggatcggattgccgatgaaagtgttgaaactcaagctgaacagccacaggtagaagagaagaagaaagggcgcggccggaagaggaaagcaaagccacagtacaatgataagaaggctaagacggcagtggctgccatgctcacaagatctcgcgaagaacgtcttgcggaagattctactctctcagaagaagaaaggtgggaaaaggagcaggctaatcttgtgccgttattgactggtggaaagttgaagtcatatcagataaagggtgtcaagtggcttatatcattgtggcagaatgggctgaatggaatactggctgatcaaatgggccttgggaaaaccatccagacaattggatttcttgctcatctgaaagggaaaggcatgcatggtccatacttaataatcgctcctctgtccactctctcaaactgggtgaatgaaatctcaaggtttactccatctctggttagtatcatataccatggaggtaaggctgcccgggcagagatccgaaggaaatttatgcccacaaatgttggccctgattttccgatagtagtgacttcatatgagatggccatgtttgatgctaaatttcttgctgcctataagtggaagtatgttgttgtggatgaggggcatcgtctgaaaaatgctaagtgtctattattgaagcagctgaagcgcataccaatggataataagctccttttgactggaacacccttgcagaataatcttgcagagctctggtcactattgaacttcattttgcctgatatattctcgtcacatcaagagtttgagtcatggtttgatttttctggtggaaatgaagaaactgatgagaagaaaaggctgcatgttgtttcaaagcttcacgctatcttgcgtccattccttctaaggcgtatgaaggaggatgtggaacagatgcttccacgaaagaaagagataatcatatatgccaacatgactgagcaacagaagcaaatccagcatcacctgatcgaaaaaacatttgacaactacttgcacgaggaatcagatattatattgaaaagacctggcattagggcaaggttgcataatctaatgattcagctgaggaagaattgcaaccatcctgatcttttggaatctccagttgattcaactggtttatatccacctgttgagaagctcctggaacagtgtggtaaattccaactttttgacaggttgctaaatttcctgatggcgcaaaagcacaaggttcttgtattctcgcagtggacaaaggtgctggacattattgaatattaccttgattcaaaaggccatgctgtttgccgaatcgatggtaatgtgaaactggaagaaaggaggaggcagatagcagaattcaatgacgtgaatagcagcatgcgtatcttcctcctgagcacaagggctggtgggcttggcatcaaccttactgctgctgacacctgtatcctctacgacagcgactggaaccctcagatggatttgcaggccatggaccgatgccaccggatcggccaaacacgcccagtgcatgtgtataggctggctacgtcacactccgttgaggggcggatgatcaagagagcctttgggaagctgaagctggagcacgtggtgatcggcaagggacagttcgagcaagacagagctaagccgagcgccttagatgaaggtgagctgctggcgcttctcaaggacgagcagaccgaggaggacaggatcgtccagaccgacatcagcaacgaggacctccagaggctgatggaccggagcgacctgatgggcccgccgcctggcgctggcggcgcaaacgcggcctcgcctcttgtaccgctgaaagggccgggctgggaggtggtggtgccggccaagagtggcggcggcatgctgtcgtcgctcaccagctgagccgtcgtggctgcggggatctgttgtgcttttggttggtcgcacgcactcagttttggtttgcccccccactggtgctggtggttttggtggcagccgttgcgctgctcaggcgatggctgttgaactggggcgttgcccctgcagaagtagcttttagtttaggatcagcaacaaaacaagcaggactctaggccatgtgtggtcgactcttcgtacggaggccgttgcgttagattacgtgggtgggttatggggcg

SEQ ID NO: 1821 - DNA, 688 bp, Zea mays
  misc_feature (284)..(288): n is a, c, g, or t
  misc_feature (367)..(371): n is a, c, g, or t
  misc_feature (393)..(413): n is a, c, g, or t
cgggaaggaaccggcttttgtcacggcacgggcgtttgcaacatcacaagacagccgaacaagagagcgtcagcacccatgtagacggaggaccgcattgtatcacggacgacgcgatactaactttacaaagcaaccggcgtgtgtccatgctgccgtcgggtctggttcaaccaaccgtcccatcacccacccacgtaatctaacgcaacgaccaccgtacggagactcgaccacacatggcctagagtcctcctgcttgttttgttgctgatcctaaactnnnnngctacttctgcaggggcaacgccccagttcaacagccatcgcctgagcagcgcaacagctgccaccaaaaccaccagtnnnnnccaaaccaaaactgagtgcgtnnnnnnnnnnnnnnnnnnnnnccccgcagcaacgacggctcagctggtgagcgacgacagcatgccgccgccactcttggccggcaccaccacctcccagcccggacctttcagcggtacaagaggcggacgggcgttagcgtcgccaggcggcgggcccatgaggtcgctccggtccatcagcctctggaggtcctcgtcgctgatgtcggtctggacgatcctgtcctcctcggtctgctcggccttgagaagcgccagcagctcaccttcatctaaggcgctcgggttagcct

SEQ ID NO: 1822 - DNA, 966 bp, Zea mays
acccacgcgtccgatgtctttattctgaagcacacgggctggcggacttggtatcaaccttacttatgctgatacatgtatcctttatgacagtgactggaatcctcagatggatcagcaggccatggatcgatgccaccggattggtcaaacacgcccagtgcatgtatataggctggctacctcatattctgttgaggagcggatcatcaagaaagcttttgggaagttaaagctagagcatgtggtgataggcaagggacagtttgaacaagaaagagcaaagcctaacgctttagaggagggggagctgctggcgctgcttagggacgagcaggacgaggaagatcggatgatccagaccgacatcagcgacgaagacctcttgaagctgatggaccggagcgacctgtccggaccacctggtgctgccgatgccgctccactgatcccgctgaaaggccctggctgggaggtcgtggtcccaaccaagagcggtggcggtatgctctcgtcgctcaccagctgagcgatgccggcaccatgtttggggtgcccattttgctagtcactcatcatgtggacgatggggcgcttgttggccggtcgccgatcaggcggatattttgcatgtatgcccccctacaaactgttgatctgggtgttgagcctgcaacagtagggttaggttatttcctcccgtgtccgtgccagtgacacgcaagtcggattgagttatgctgtgaacttctgatgagtcgctgcaagctgcctttctgacttgagctttttgctgcttctgttgctgcgttctatgatgtagtaacagtagctgatggtttacaccaaagcggagatggatgccctctatgatgtagtccttgctatataacttgaacactgatgtgattttctgtagtgtcaactgccaaaaaaaaaaaaaaaaaaaaaaaaaaaaaaaaaaaa

SEQ ID NO: 1823 - DNA, 1821 bp, Zea mays
  misc_feature (149)..(295): n is a, c, g, or t
  misc_feature (307)..(442): n is a, c, g, or t
  misc_feature (1146)..(1150): n is a, c, g, or t
  misc_feature (1473)..(1529): n is a, c, g, or t
  misc_feature (1534)..(1534): n is a, c, g, or t
  misc_feature (1543)..(1543): n is a, c, g, or t
  misc_feature (1787)..(1788): n is a, c, g, or t
  misc_feature (1812)..(1817): n is a, c, g, or t
ccacgcgtccgggtttctctgcctcgccggggaagcgatgcagccgctgcaccaaccgccgatgaacgggcaacacggcccgcctcctccgcagggatccggggttcccacggcttcgcagcagcaggcgccaccgccgtcgtactacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgcccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgggacaacgccgggaagcggtgaggtcaggaccctgtggattggagatcttcagtactggatggacgagaactatctccactacaacgccttcgcgcctgtggcccagcagattgcctctgtgaaaattatacggaacaagcagactgggcactcagaaggctatggttttattgagttttactctcaagccgctgcagaacatactctgatgaacttcaatgggcagatgatgccgaatattgagatggcttttaagctgaattgggcttctgctagcactggggataagcgtggagataatggttctgaccatgcaatatttgttggtgatttggcccctgatgttacggactccatgttggaagatgtgttcagagctaactatccttcagttagaggagctaaagttgttgttgataggatcactggacggcctaaaggatatgggttcgtgcattttggagatctgaatgagcaggcacgtgctatgaccgagatgaatggaatgatgttatctacaaggaaaatgaggattggggctgcagctagcaagaagaatacagatgctcagcagacatatgcaactaatggtgcataccagagttctcaaggcaattgttcagagaatgatcccaacaatacaacagtctttgtgggtgggttagattccaatgtagacgaggagtatctaaggcaaannnnnactccgtacggagaaatttcctatgtgaagattcctgtaggcaagcattgtggatttgttcaatttaccagcaggtcatgtgctgaggaagccatccaaatgctgaatgggagtcagattggtggacagaaagctcggctttcatggggccgtagtactcaaaacagacaggcttctcagcatgatgccaacagccagtataatgggaacaactattatcgataccaacagccgggtaatgaaggttatagctatggtgcacccaatgcacaagacccaagcattcaaaactactatggataccctggttatggtaactatgnnnnnnnnnnnnnnnnnnnnnnnnnnnnnnnnnnnnnnnnnnnnnnnnnnnnnnnnnctccnccggcaccncagtaccaatcatcgtggtgacgattgcttgggcacttctggaatgctatcagattagagggactacagtcagagcagtgccgtgccgaatgagacgtcctgaagatatggagggcatatagtcgcatgggtgttcttgggccggtgttaatctacgatgacactcctgatgtctcttttgtttgtcattgagatcttgacggctgaagtatgcaccgttgaaattgatgtattcgtcgtcgtnngattgtttatttgctcggaaccannnnnngcac

SEQ ID NO: 1824 - DNA, 1599 bp, Zea mays
  misc_feature (1419)..(1419): n is a, c, g, or t
  misc_feature (1452)..(1452): n is a, c, g, or t
  misc_feature (1547)..(1547): n is a, c, g, or t
  misc_feature (1581)..(1581): n is a, c, g, or t
  misc_feature (1589)..(1590): n is a, c, g, or t
ctggatcagaaggcaacctcagcggccgcaagcccgcaactttatccatccgtttggcccacgcgctccgcagtctcctctctcctcgggtggctagggttttgactcctagtcctaaaccagctcccacgccgccatgatgcagccgccgccgccacatcagcagcagcaatgggcaatggcgcccccgcccccgccgcagtactaccaggcggggcaccctccgccgccgcccccgcagttctaccaggcgggccctccgcctcccgctatgtggggccaaccgccaccgcaggcggcggcggcgccggcgccggccggcggcggggcgggggacgaggcgaggaccctctggatcggggacctgcagtactggatggatgagaactacctctatagctgcttctcccaggctggcgaggttatttccgtgaagataattcggaacaagcagactgggcaacctgagggttatggttttattgaattcagcaaccatgctgtagccgaacaagttctgcagaactataatggtcaaatgatgcccaatgttaatcaacctttcaaattgaattgggctaccagtggggctggtgagaaacgtggagacgatggttcagattatactatatttgttggggacttggcctcggatgttacagatttcattctacaagatacgttcaagagtcgttatccatcagttaagggtgcaaaagttgtctttgacagaactactggccgttcgaaaggctatggttttgtaaagtttgcagattcggatgaacagacacgggcaatgactgaaatgaatggacaatactgttctagcagggccatgcgccttggaccagcatccaacaagaagaatactggtggaccacaaccatcgagtgctatttaccagaacacccaaggaactgattctgatagcgatccgaacaatactactgtatttgttggcggccttgacccgagtgtgactgacgagcttctgaagcaaactttcagtccatatggagagcttctctatgtcaaaatacctgtaggaaagcgctgcggatttgtccaatattctaacagggcatcagctgaggaggccataagggtgctaaatggaagccagttgggaggtcagagcataaggctctcatggggccgtagccctgcaaacaagcagcctcagcaagagcagagccaatggagcggtggtggctattatgggtatccccaaggatacgatccatatggctatgctcggccccctcaagatcctgccatgtacgcctacgcagcatatccagggtatggaaattaccagcaacagccaccacagcagcccccgccacaacagtaatgatgtcccgagagtgatcatttgcaagctggtcgcaaagtagctggggggttggggcgcanaactttggtgcgttggcatgagaattttgcggnggttgcttgtgttgtgttgtattgttccgacgcccttgtacacgtagcctgtgttgtaactgatttttgccgaggccttatgagtgactagtgtntcaactgtaactgaattgcactttttgtcgcaanggatgtannaattaattg

SEQ ID NO: 1825 - DNA, 608 bp, Zea mays
ttttttttttttttttcccaaattatactgatcaattatcataatctgtagaagtccatgtattagctggtatatatcattatattatggtgttcaacggtgagtagagaccatttagtaacaacaatttacatctagtctggtaaagaacatgtcactgcctaactgatctatagtaagctccatgtcaagaaatagtcgacatcggggcatcgccatcatcccggcatagctcctccaattcagtcatgaaatcacccccatcggtgccagctgaatcagccagcatcctgtcctgcatcgcctgggactctcgtaggctgttaacacaggcttgcagcctgcggtactggtctcttgcttcaggatactgattcatggaacgcacacgagccagtgctctatccaacctgcctgtagcctgtttcctgccatccttcaagaagtcatattcatcctcagcctcagcctttgcaggttggatctgccatgatggaccttcaagttgtttctcaggttggaaacctcgcagaccccttccctttctcctccacctcagtatgactttctccacgatgccaacagaccagactaccttccgatagttt

SEQ ID NO: 1826 - DNA, 654 bp, Zea mays
gattcggcacgacatccttccagagaaagcaagcgccttatatgaggataaaggtggcatgtctgatgagcgtgctctctcactcctttctgtcaagccacccaagtcagggcagcttgatcctctgcactctgctgcaactcgcatacaaaataagttcagaggatggaaggggagaaaggaatttcttcttattaggcagcgaattgtgaagatccaggctcatgtgcgaggtcaccaagtgaggaagcattatcggaaaatagtttggtctgttgggatcgtggagaaagttatattgcgttggaggcgtagaggggctgggttacgtgggtttcggtctcaagaaggatcagtggagagcagtagtggcggaacaagtagcagttcgatccaaaataagtcttctggagatgattacgattttctgcaagaaggacgaaaacagactgaagaacggctccagaaagctcttgcaagagtgaagtccatggctcagtacccggaagcaagagatcagtaccagaggattttcactgtcgtgtcaaaaatgcaggagtctcaggctatgcaagaaaaagatgccggaggagtcagcagagatggacatgagtgaattcaaggaactgtgggatgacgatgcacctatccccg

SEQ ID NO: 1827 - DNA, 758 bp, Zea mays
  misc_feature (728)..(728): n is a, c, g, or t
ttttttttttttttttataatgaacctagttttagattatatttgaaatttattgattcaaaatttttagcatcctttcagtaccattaaatgggtacaaaacaaagaaaacagaaaaagaaaagaaaaaacgaattctgttaacactgtagctttaggggatcgaatttaggggacgttgctggagacacataagatatagaggacagaatcttttagagtgtcttataaagtacagggaatattcctttaggggacgaaatttaggggacgctgctggagacagcctaaggcgagacaaacgcctaagcctactcctcctccgagggagtgtgtacactctcgccactcagccgagggattcgccctcccacaaagacaaatggtcaaacatgataggtgccaaaaggaacaaaagacccgtctatttcataagcaacggagacggagggagtagtttctaagcaaaaaacaaaaggcccaaagccatggaatggaaacgaaacggaggtcgacagcaagacatacctcacctaccacttttaccacccagcttgaagatcatcctggcgcctacacagtaagacgtgacgtagaattgcaacaagtatccagttccatcgtctcatatccagaatctggtggtatacttgtgcaccgtaaattcttgcgattcttacggtcatacagctagaactggagtacagtacaattgatgagctcaacanttgtcgccgagcgcttcctcaccgatctgt

SEQ ID NO: 1828 - DNA, 566 bp, Zea mays
tttttttttttttttttggagaaaaaaaaatgaatagtccactagatttagctgagcgtagctagatgaaataaaccatctcatattatgagaaccgttagataaaaaaattgaaggaaacggcaggaaccattgaatgaacatgcatgcacacctgaagatggaggctatagaatgtcttgttcccaaaggtggagtatgttgatgagctgatgaggtgaaggcctgcgtcctccagcacctttatgcacttggagagagggagagccgtggctgccacattgctgtgcaggctgacctgaaccatgatctccgtgtcgttgaggcaagtagcagaaacaatgggagtagttacgatctcgctggtgttgagaactcccggcttgcagttggcgttggtcagctcccgcttcctcctctccaggttgtccacctgcttctgcagctccgggatgtacttgaggactcgggacacggtggtggggatgctcagcttcttggtgtggtcagcgtccgggaggagggagcggagcgaggagtaaaggtcgttgagctgcttccgtcgg

SEQ ID NO: 1829 - DNA, 980 bp, Zea mays
aagttgaaagtaaagggagaacaacatataawgagggkgacagatgaacttgttgctgagttaacagaccccaataataatattggaggcaccagmccctgatacccctaatgcgcaacaatatgatgaaaaaaatattcgacgaagagtttatgatgctttaaatgttctgatggctatggacattatatctaaagataaaaaggagatccagtggaagggcttgccgcggactagtataagtgatattgaagaattgaagactgagcttgtgggactgaaaggtagaattgagaagaaaagtgtttacttacaggagctacaagatcaatatgtaggtttgcaaaacctgattcaacgaaatgagcaactatatggttcaggaaacacaccttctggtggagtggctttgccattcatcctagtccagacccgacctcatgcaaccgtggaagttgagatatcagagagatatgcagctggttcattttgacttcaatagcactccatttgagctgcatgatgactcatatgtcctaaaagaaatgcggttctgtggaagagaacaacatgatggaactcaagagtcgatatcaaatggaggtgagagttcaaacgtgtcaaatatttattggcaacaagcacagcatatggagatgccaaacaatggcacagttaggttatcaagctcaccgcctattccagggatattaaaagggcgtgtgaagcacgagcactagcgcttcggttttggttcactggcgttgtcgtctgagagcagtttgttttattacttttctccgttgtgtaaagcgcctgtaaattattaggcaagggggagggtagtagctctgatctgatttasctctgattggtagaacgacgggtgtaattctatatccttgattcggttctttcggtatggttgagaaaagggttgacatgtaatttgtrgrgcattataaaaactaaaattgttg

SEQ ID NO: 1830 - DNA, 1245 bp, Zea mays
gcacgaggcgacagcacgttcctccgcttgaataatctcgacatcaacggcgacgacgcgccgtcgtcgcaggctcctacgagcaagaagaaaaggagaggcacacgggcagtgggtcctgataaaggtaaccggggactgcgccagtttagtatgaaagtttgtgagaaagttgaaagtaaagggagaacaacatataatgaggtggcagatgaacttgttgctgagtttacagaccccaacaataatattgaggcaccagatcctgataaccctaacgcgcaacaatatgatgagaaaaatatacgacgaagagtttatgatgctttgaatgttctgatggctatggacattatatctaaagataaaaaggagatccagtggaagggcttgccgcgtactagtataagtgacattgaagaaatgaagacggagcttgtgggactgaaaggtaggattgaaaagaaaagtgcttatctacaggagctacaagaccaatatgtaggtctgcaaaacctgattcaacgaaatgaacagtcatatggttcaggaaacacgccttctggtggagtggctttgccatttatcctagttcagacccgacctcatgctaccgtggaagttgagatatcagaagatatgcagctggtgcattttgacttcaatagcaccccattcgagctgcacgacgactcatacgtcctaaaagaaatgcgattctgtggaagagaacaacatgacagcactcaagagtcgatatcaaatggaggtgagagctcaagcgtgtcaaatatttattggcaacacgtacagcatgtggaaaggccaaacaatggcacaggtaggttaccgagctcaccgcctattccagggatcttgaaagggcgtgcgaagcacgagcactaacgctagggtgttggttcactttccttttcgtctgagcagttggttttattgcatttctccgttgtgtaaagggccctgtaaattattaggcaagcgggagcgtagcttgatctaatttagctctgcaccagattggtagaacgacgggtgctctaagtagttgtgtaactataactatccttgaatcggtttctttagtatggttgagagaagggttgacatgtaattttgtagagccttgtaaaattaaaattgttgatttctatcagggtgaaatttctgggcacaaaaaaaaaaaaaaaaaaaaaaaaaaaaaaaaaaaaaaaaaaaaaaaaaaaa

SEQ ID NO: 1831 - DNA, 548 bp, Zea mays
gtcttggacggatggagtaaatcagtatgatgtacaagtcaatgatgatagtcatagtgagtccgcgatgagtttcccactgctgtgcatctagcccttagcacgatcgtaatgcatcatataagatgataaaatttttgtaaacaacaaggaaagaggtgaatgcactgagatttgcctaggataaaacactatgttaatgttgttagatgatactcgcttgatgaccatctcccctcctggcactcgatcagatcatccatcttaggttcatccaccagcatcactttgagatcaattcagttcttgtcctccacatcacgtgatcaactagtgtaccataactaaatcagactgcggaaacgacgacgatttcgattcaaccattacgtcgagcaccaggtgtgcgatgcgctggagcttattttcttcttctccacccaaccatcccatgagttgctcataatgacaacaaatctgtcagcaaggaggctcaaactcgatcagagaacaaggcgagtccagtaaccctggtgccgaattcctgc

SEQ ID NO: 1832 - DNA, 236 bp, Zea mays
ttttttttttttttttttaaagctgaaatctagagttcaatccattgacgtcgttttatcaacacaacagtccaaccgtttattgctgccaggcgaaaattcacagtagcaaaaggagggagcacacggcatctcattgcctagagcacctcgactctcatgcagcacctctccgctgctccgtctcgccatgggcgaagcggcaccggccaccaaaagtacaggcacccttcaag

SEQ ID NO: 1833 - DNA, 375 bp, Zea mays
tttttttttttttttttgagaagaaggttggttggttaatttaccagcactaacaatgagacggggtttaattaagcagtactagtaggctagggtttgcagatgaccacgaagcacgggagcagcgccctcgggttcagcaggtacagctcctcgatgttggagtaggggccgaccttgccggcgagcgagtcgaagcccatcgtctgccccgcgaactccttgaggttgtccagcggcttgggcacgcggccggcgatcaccctgcacaccagcagcgccctgcgcgtggtgccactgacactgccagcgccagccccgtcggcgcccggcagcctcgatggactcgaaagcgcggccgctggtggacgtggt

SEQ ID NO: 1834 - DNA, 371 bp, Triticum aestivum
tggacgcctgcggtaccggtccggaatttccgggtcgacccacgcgtccgggggcaggccggcctcaacgggctcgccgtcggcggcggcgggagcgcgttcgcgtccaacacctccgtgccgatgcccatggcctaccacggagccggcgggtactactactagctcctcctcctcctcctcctcgagccgagcagcctctgctcgttcctgattgatcgttgagcttttatctgtgaataataatactctgatcgtgatttgccaccagaaaaactgtaatccgaattgatttgatcctgctcggacgctgaggtaaccatggcgattgagaatttgagattaatggtaaaaaaaaaaaaaaaaaaaaa

SEQ ID NO: 1835 - DNA, 1176 bp, Triticum aestivum
ggcacgagatcccaagccctatgcgctagtaggttgcgcatcagaaccgccgcaggaggaagagcgcagagctagcttgctgatcggtagagctttgcttgcttgcttgcttggaaggaggaggaggaggagatcatggggaggggaagggttgagctgaagcgtatcgagaacaagatcaaccggcaggtcaccttctccaagcgccgcaacggcctgctcaagaaggcctacgagctctccgtgctctgcgacgccgaggtggcgctcatcatcttctccagccgcggcaagctctacgagttcggcagcgccggcacaacaaaaacattggaaagataccaacactgctgctataatgctcaagattccaatggcgcactatctgaaactcagagctggtaccaggaaatgtcaaagctaaaggcaaaattcgaagcgttgcagcgaactcagagacacttgcttggggaggaccttggaccgctcagcgtgaaagaactgcagcagctggagaaacagctagaatgttctctgtcactggccagacagcgaaagacacaacttatgatggagcaggtggaggaacttcgcaggaaggagcgtcagctgggagacatcaacaggcaactcaagcacaagctcgatgctgaaggcagcaacagcaacaactacagggccatgcagcagatctcctgggctgccggcaccgtcgtggacgagggcgccgccgcatatcacatgcagcagcagcagcaacaccctaatcattccgctgctatggactgtgaacccactctgcaaattgggtaccatcatcagttcgcggctcctgatcaggcagccaataatattccacggagcagcgcccccggaggggagaacaacttcatgctggggtgggttctctgagcgagcgagctgctagcgcagctggttagcttgtctgtccatcagccaagaaaccaaataaaatgcgtgtgctgctccttcatgctctacacgagaagtatcctgcgtcgcgcgtgcctctttctttatttttactcgttgtttgtgtgtgtaagaagtaagaaccaagaaccacttctatattttgagtattttaactgcatggatcttgtaaaacacttgcaagttccaagctgtccatgcatgcatgccaagttatccagt

SEQ ID NO: 1836 - DNA, 678 bp, Triticum aestivum
gatccagagcatcgagaaccgccaagttacttacctttttaaatttcaagaaagctactcattcgcagttttcttgtcatttgacatgagatctaatcgagtccaagctccatcttcgggtgtttcgggtgtttcactgttcttttctttgtatgattcgttttggtttgatttgatttcatcgcagaatatgcagcgcacgctgagccatctcaaggacatcaatcggaacctgcgcaccgagatcaggtcaatcactttcctcttaccttctttatatccgaaccattctttcatggggattcttttgcttcatggggattcttttgcttcatggggattctccagctccagcaatttatattgttttgatcccgagatcgacttgaatttacatactgttcgtttttatacccatcgcaggcaaaggatgggtgaagatctggacgcgctggagttcgaggagctgcgcgaccttgaacagaatgtcgatgccgctctcaaggaggtccgccagaggaaggcatgcacgtacaaaaccctagctaccagattagttgatttaggcttcgattcctaggctggatctgtctgtttctgctcgctcatctgctgtccaatccgtgcatttatcatgctaggtagccccatggtagatctatacagtaaaaaaaaaaa

SEQ ID NO: 1837 - DNA, 757 bp, Triticum aestivum
acgtgttgctgaacatgcaacaaaattatacagcgaaccagcattcctgatctctctgctcatttttttccttgcaaatcatatatataagggtaggggcaagcaaacataaccatagcagcttaattgctagtgtgccgattaatgctgtttcagctgctatggcaattaaacctcttcctcaagcgttgaggtggctcagcatccatggaggcagccctccaatacgaagctgagcctgctgccccggcgctgctgccgccgctgctgcctccccacccatcgtcaccggcgggtagctgcaaatgttctgttgaggggcatgggcctgctgatccctcatcatgaaactggaagatgatgagctggtctgggcttgaggttggttttgggtatgggcatgggtttgggtctgggcttggtgctcccactgcatttgttgttgttgctgctgctgctgcctgctggccgccgccttctgcctctccaccagttccttctgtagggccttgttctcctcctgcagtgacctctccttcttctgtagctcagaaatggactccatcataagatggctctttctcgatcggatgtgcttcaatgaactctccagctgctgctccagctgttggagktctttgagattcagagaatccagatytytytcatgaggtgcttgtgacatttttgtatggkctcaatcttcgccttaagtttcctgtattcgtggcaccaatttccctcactttcakattca

SEQ ID NO: 1838 - DNA, 1161 bp, Triticum aestivum
ggcacgagctctctctctctctctctctctctctctctctctctctcctcgtgccgaattcggcacgagcggagatggggcgcgggaaggtgcagctgaagcggatcgagaacaagatcaaccggcaggtgaccttctccaagcgccgctcggggctgctcaagaaggcgcacgagatctccgtgctctgcgacgccgaggtcggcctcatcatcttctccaccaagggaaagctctacgagttctccaccgagtcatgtatggacaaaattcttgaacggtatgagcgctactcttatgcagaaaaggttctcgtttcaagtgaatctgaaattcagggaaactggtgtcacgaatataggaaactgaaggcgaaggttgagacaatacagaaatgtcaaaagcatctgatgggagaggatcttgaatctttgaatctcaaggagttgcagcaactggagcagcagctggaaagctcactgaaacatatcagatccaggaagaaccaacttatgcacgaatccatttctgagcttcagaagaaggagaggtcactgcaggaggagaataaagttctccagaaggaactcgtcgagaagcagaaggcccaggcggcgcaacaagatcagactcagcctcaaacaagctcttcttcttcttccttcatgatgagggatgctccccctgccgcagctaccagcattcatccagcggcggcaggcgagagggcaggggatgcggcagtgcagccgcaggccccaccccggacggggcttccactgtggatggtgagccacatcaacggctgaagggcttccagcccatataagcgtactattcagtagagagtaacaagttgcaccggccagtctggtgtatgttgcggttgctagcacgcctgaccccttggaggggaaaggaaaagaaatcagagtaaagtagcaagctgcagcgatgtgtatatttcactttgtccaccccagtttccctcccagctgggctcaatttaccatgtaatctatatgtagcttgagtgatgaattttcaagtttccatgatacccgtctctagtgggatgttgtttatgtgaattaacctatcaaatatgagcattgtgtatattgtgattcttgaaaataaataaatcaggatctttgtctt

SEQ ID NO: 1839 - DNA, 274 bp, Triticum aestivum
  misc_feature (200)..(200): n is a, c, g, or t
  misc_feature (220)..(220): n is a, c, g, or t
  misc_feature (247)..(247): n is a, c, g, or t
  misc_feature (249)..(249): n is a, c, g, or t
ggagagagagagagagagagttctaggtctgctgtttttatagccattccctgttgctatgccatagctttttctattgttattaggcatcgcccgttatccttctcgacctaaatttttcccgttgttagaagtcattaaacttcacaaaaccgccatgccctgaatgcaggaattgcttttgctgtgaaacactggtnacggtgaagggggttagtanaaaaaaaaaaaaaaaaaaaaaatttananaaaaaaaaaaaaaaaaaaaaaaaaa

SEQ ID NO: 1840 - DNA, 669 bp, Triticum aestivum
  misc_feature (2)..(2): n is a, c, g, or t
  misc_feature (10)..(10): n is a, c, g, or t
  misc_feature (22)..(22): n is a, c, g, or t
gngggcacancaacaacaaagncaggtaggcgtgttccacagggtgatggatgatgatgataaaactgaatgaaagagggtcttgactctagacacaaggcaaaagcgaccgagcgccggcacacgaaggttctttgcagaacagtttgtgaactagtaactacaaactactagacgaaggaccagttgacgaacatgaaggcgaggcagtgcggcgcgtcgtcgtcgcccagcaccttccacgccaccgcctgctcgtacgacaccggccgccccatgctcgacacgcacacgccgcccgggaggtacgcgaaaccctgctgcatgatcttggggaactcggagcacagcgccttgcggccgtcgtcgtcgaggatcttctcgagcgagatgtcctggagcgcgatcagcgtcgtctccagcatgtcgagcccggcctgattggcgaaggtgaacaccggagcagccttcagggaacagcacatgattgaatccgagtgctgccacagcgccttcagggaagcgtccgcgctctgtgactccgtgcataggagttccgccccagtgtgaaacctgtagctcctgccgatccacctcgcaagcgtgtgagcctcaggagatcctggagggttcttcatttcaagctgtccaccagggcgggaaggggct

SEQ ID NO: 1841 - DNA, 719 bp, Triticum aestivum
  misc_feature (20)..(20): n is a, c, g, or t
aaatgtaaatgtacatgatncgactcgagtttcatacatgtaccagaccccacgcctagagctaacgctacaaacaatactaggagtatcattttttcccccaccaaaaactgcatctatctgcccggcggcatatggtacacatcacacgaaggaccagttgacgaagcacagggccaggcagtggacgccgctgtcctcgccgagcaccttccacgccacggcctggtcgaaggacacgtgccggcccatccccgacatgcacacgcctgatggcaggtacacatggccctcttccaccaattttgagatctccgtgaataatgcttttcttccaggctcatcgaagatcttgtccagtgtcaggtcttgcaaggcgacgagggaagtttctaacatgtcaaggcctgccttgttggcgaatgtgaacacgggtacttccttaaaagagcagcacaggatggcatcttggtagtgccatagcatcttcaacaatgcttccccagctacatctgattgagcaagtaactctacccctagatggtaatgatagctctggcaaatccaccgagcaagtgtcgctgcttcaggaaggccagagagtatcctctgcccggcatttataccagattgagatggggatatagcaatcgacactctttgaacagcagagacaatgctacgaacgtactgacgggccatagctgcaacactatctt

SEQ ID NO: 1842 - DNA, 650 bp, Triticum aestivum
  misc_feature (647)..(647): n is a, c, g, or t
tgacactgacagttacacacacatacataggtcttgttcccgatcaacacgggaaggaatgccaactatgtttcggttcacggcaacaaacctcagatcaggttctcaacaaagatgcaaaccatacataccatagctaggatgggtacatagatagataactgaaccatacaaaacggacagacgacaggaaggtcttttgctcaagcagcagatgggtagatggcggtcacaggaaggtccagttgacgaacatgaaggcgaggcagtgtggggcgcccgccacgtcgtcgcccaccaccttccacgccaccgcctgctcgtacgacacctgccgccccatgctcgatttgcacacgccgccagggaggtacgcgaaaccctgctgcatgaccttggagaactcggcgcacagcgccttgcgcccctcatcgtccaggatcgcctccagcgagatgtcctgcaggttcaccagcgtcgtctccagcatatccagggccgcgttgttaccaaacgtgaacatcggagcaggcttcagagagcagcagagtatagcgtcgctgtggttccacaggagcttcaggggagagtcggcttcttcagtgtccgaccagcggatctcttcccccgtgtgagccctgtagctnctt

SEQ ID NO: 1843 - DNA, 527 bp, Triticum aestivum
tccctgaaagcactatgacagcactcaggttcaatcatgtgttgccccctgaaggctgctcctgtgtccagccttgccaatcaggccggcctccacatgctggaggcgccgctgattgctctccaggttccccaagatcatgcagcagaaaaagaacatttagcttattctttgtggttgtctaatcttccataacctcggcttgcgcaaccgttgcagttgtcgtcacctcttcttggttcagtgttcagatctccggtggttttcttctggccaccacaatcatgtgagcttgctggatttttgtccctatgagctggccgaattgattatttcaaaatgcacgtgccacttggtctggtgcagggcagggtgatgcatgtggcgtagctgcccagcaagatgggcctcgtcgacaagaggtgcaggaaggaacgatcatatggtcattgttgtgattgcggatgctcaccaagatcacatcgcccaaagcatgaatttctggacctcaccatctattcctcggt

SEQ ID NO: 1844 - DNA, 570 bp, Triticum aestivum
ggcacgagctcatcaaagccgcagacgctagcagcggcgagtcggcgctcaaagccctctggcagcataccagcgccatcctatgctgctctctcaaggcgatgccggtcttgacgttcgcgaaccagtccgggctggacatgctggagacgacgctggcggcgctccgggagatcaccatggacaaggtgctggactacgaccaggggaggaagagcctgctgtgcgcggacctgatggccagcgtggcggagcaggggtacgcgtgcgtcgagggcgggacgtgcgcgtcgagcatgggccggccggcgtcgtacgggaaggcggtggcgtggaaggtgctcgacgacggcggcgccggcgccgcccactgcgtctgcttcgccttcatggactggtccttcgtttagtcgagggaccgatcgtttgttgtagctgttgttgcaagtctcgagcatgggtgatggacgcggtacaatgttggatgatggtagtgttttgtacggcttgatggtgtgccgagattggtgatgctgtttgtactagtactttaaaaaaaaaaaaaaaaaa

SEQ ID NO: 1845 - DNA, 550 bp, Triticum aestivum
  misc_feature (358)..(358): n is a, c, g, or t
  misc_feature (361)..(361): n is a, c, g, or t
tacaggtttcacaccggggcggaactgctttgcatggagtcgcagagcgcggacgcttccctgaaagcgctgtggcagcactcggattcaatcatgtgctgttccctgaaggctgctccggtgttcaccttcgccaaccaggccgggctggacatgctggagacgacgctgatcgcgctccaggacatctcgctcgagaagatccttgacgacgacggccgcaaggcgctgtgctccgagttccccaagatcatgcagcagggtttcgcgtacctcccgggcggcgtgtgcgtgtcgagcatggggcggccggtgtcgtacgagcaggcggtggcgtggaaggtgctgggcgacgacnacncgccgcactgcctcgccttcatgttcgtcaactggtccttcgtctagtagctctgtagccagcagtaccgttcgttcgcaaaccgtttctccagaaaaacctttgtgtgccggcgctcggtcgcttttgccttgtgtctgtcaagagtcaagaccctcctcctctttcattcaaaaaaaaaaaaaaaaa

SEQ ID NO: 1846 - DNA, 608 bp, Triticum aestivum
ccatccgccatctccgtccatctcccaccaaattaggcgcagcccggcgattcggaggcggtgggcacgccggagagcggcgggtcgaaggagcaggagcggttcctgccgatcgccaacatcgggcgcatcatgcggcgcggcgtgccggagaacggcaagatcgccaaggacgccgaggagtccatccaggagtgcgtctccgagttcatcagcttcatcaccagcgaggccagcgacaagtgcatgaaggagaagcgcaagaccatcaacggcgacgacctgatctggtccatgggcacgctcggcttcgaggactacgtcgagcccctcaagctctacctcaagctctaccgggagatggagggtgacacgtcaaagggttcgaaatctgagcaggctggaaagaaagtgggtgcactgaatgggcagcctggatcatcgttcaacggcatgtacggtggagaatgatactgattggcgtgtgacaaacatacacatataattcgttagcagtgtgatccttgcagtactgtgcatttgtggcccgggcaagtcccttgcactctgctagttctgtgtactcgaaatatcgtgctatctcttct

SEQ ID NO: 1847 - DNA, 720 bp, Triticum aestivum
  misc_feature (2)..(2): n is a, c, g, or t
  misc_feature (10)..(10): n is a, c, g, or t
  misc_feature (13)..(14): n is a, c, g, or t
  misc_feature (690)..(690): n is a, c, g, or t
cnccccccanaannagtttgattacccctgctcgaaattaaccctcactaaagggaacaaaagctggagctccaccgcggtggcggccgctctagaactagtggatcccccgggctgcaggaattcggcaccagccaccaccttccctccctccacgcgcccgtctatataaggaggagggccggatgtcggacgcgccggcgagccccccgggcggcggcggcggcggaggaggcggcggcagcgacgacggcggcggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagagggagaagcgcaagaccatcaacggcgacgacctgctctgggcgatggcgacgctgggcttcgaggagtacatcgagcccctcaaggtttatctgcagaagtacagagagacggagggtgatagtaagctagctggaaagtctggtgaagtctctgttaaaaaggatgcacttggtcctcatggaggagcaagtggcacaagtgcgcaagggatgggccaacaagtacatacaatccaagaatggnttatatgcaacctcagtaccataatggggg

SEQ ID NO: 1848 - DNA, 924 bp, Triticum aestivum
  misc_feature (285)..(285): n is a, c, g, or t
  misc_feature (360)..(360): n is a, c, g, or t
  misc_feature (385)..(385): n is a, c, g, or t
  misc_feature (511)..(511): n is a, c, g, or t
  misc_feature (534)..(534): n is a, c, g, or t
  misc_feature (536)..(536): n is a, c, g, or t
  misc_feature (546)..(546): n is a, c, g, or t
  misc_feature (581)..(581): n is a, c, g, or t
  misc_feature (600)..(600): n is a, c, g, or t
  misc_feature (606)..(606): n is a, c, g, or t
  misc_feature (611)..(611): n is a, c, g, or t
  misc_feature (617)..(619): n is a, c, g, or t
  misc_feature (638)..(639): n is a, c, g, or t
  misc_feature (643)..(643): n is a, c, g, or t
  misc_feature (677)..(678): n is a, c, g, or t
  misc_feature (685)..(686): n is a, c, g, or t
  misc_feature (698)..(698): n is a, c, g, or t
  misc_feature (710)..(710): n is a, c, g, or t
  misc_feature (715)..(715): n is a, c, g, or t
  misc_feature (738)..(738): n is a, c, g, or t
  misc_feature (744)..(744): n is a, c, g, or t
  misc_feature (746)..(746): n is a, c, g, or t
  misc_feature (762)..(763): n is a, c, g, or t
  misc_feature (773)..(773): n is a, c, g, or t
  misc_feature (780)..(780): n is a, c, g, or t
  misc_feature (783)..(783): n is a, c, g, or t
  misc_feature (786)..(786): n is a, c, g, or t
  misc_feature (797)..(797): n is a, c, g, or t
  misc_feature (803)..(803): n is a, c, g, or t
  misc_feature (826)..(826): n is a, c, g, or t
  misc_feature (831)..(831): n is a, c, g, or t
  misc_feature (834)..(834): n is a, c, g, or t
  misc_feature (837)..(837): n is a, c, g, or t
  misc_feature (847)..(847): n is a, c, g, or t
  misc_feature (855)..(855): n is a, c, g, or t
  misc_feature (869)..(869): n is a, c, g, or t
  misc_feature (892)..(892): n is a, c, g, or t
  misc_feature (897)..(897): n is a, c, g, or t
  misc_feature (907)..(907): n is a, c, g, or t
  misc_feature (920)..(920): n is a, c, g, or t
  misc_feature (922)..(923): n is a, c, g, or t
ggcacgagcacagatcgaggaggaggaggagccatgccggagtcggacaacgactccggcgggccgagcaacaccggcggggagggggagctgtcatcgccgcgggagcaggaccgcttcctgcccatcgccaatgtcagccggatcatgaagaaggcgctcccggccaacgccaagatcagcaaggacgccaaggagacggtgcaggagtgcgtctccgagttcatctccttcatcaccggcgaggcctccgacaagtgccagcgcgagaagcgcaagaccatnaacggcgacgacctgctctgggccatgaccaccctcggcttcgaggactatgtcgacccgctcaagcactacctncacaagttccgcgagatcgagggcnagagggccgccgccacatcaacatcaaccacgcccgacatgccaagaaacaacaacaacaatgcccgccggttaccccgacgccccgggaggcatgatgatgatggggcagcccatgtaccggttngccggccgcaccacaaggagcangnacccaacatnaaaattgcaatggggaggggagaagcgggcttttnctattttggaggcgggggngggtcntcgtnatcctnnngggttttgaccgaaaaaanngganaccttttcctttttcttttcttttctttttggannctgaccnnaaggggaggggnttttcaaacttntgttncttctttttgggtgaaaaccctncttgtnancttaaaattcttttcnnccccaggggnggggaanatnttnttttttccccncgttgnttgaaaaccttttttttttaaanttttncgnttnttcccctgcnaaaaaaantttttttttttttnaaaaaaaaaaaaaaaaaaaattngaggnttttttaagnggggcggggcccnannt

SEQ ID NO: 1849 - DNA, 733 bp, Triticum aestivum
ccctttacacatgtgaaatgcaattttacaactcagttggcttgcacgttgcatcacaagtcttaagcacaggtggatgtctgtctggcgagccttgcaccccggagagggcacaggaaacaacgcaccactataagttaacacccagttgcaatatatttatgcttcctaatacaaatatctgaaaacaaaagattgccaaactaccaacggctgaattattctgaatgtacagataaaaacaagcactaaaccataataggtgaatctattctctcggaagcaatttacatcttggaggcagccatcacaaccaactgtttccagccaatgatcatcatgaacctaatgttggggcggcttccttaacagatagataaccactcatggagcaatacccattgccgaaaattgcctgatcttcagtttcaggtgtccccattatggtactggggttgcatataacccatcccttgggcgtaacctccatgctgaaccatcgcttgggcgtttgagctagtcgcaccactatgagcaccaattatatctttcttcacggatccttcaccagattttgaggtcaatttactatcaccctccatatctctgtacttttgcaggtagatcttgagggggtctacgtactcctcgaatccgagcgtggccatggcccagagcagatcgtccccgttgatggtcttgcgcttctccttctggcacttgtcgctggcct

SEQ ID NO: 1850 - DNA, 532 bp, Triticum aestivum
  misc_feature (430)..(430): n is a, c, g, or t
  misc_feature (495)..(495): n is a, c, g, or t
  misc_feature (501)..(501): n is a, c, g, or t
gttacccctaacaatcaccaagatacaaaaacagagcgagagacgagcggcggccggaggagactggtgggatggcgcggcgcgggcgtgtggagctgcggcggatcgaggaccggacgagccggcaggtgcgattctccaaacgccgcgcggggctcttcaagaaggcgttcgagctcgcggtcctctgcgacgccgaggtcgcgctgctccgtcttctcccccgccgggaagctctacgagtactccacctccaggttccataggaaatctactttgataaatattcactgaagtgggaattgctgcaacaactgggagttataggatctttgcttcgtatagtgggtgatgggtgcctacaatgatataaaattactatgttttactagtataattgttggcatgattggttgatatacatatactngaatttatccaacattgtctaatgtaaacttcatacacttgaatattgctactttacaatcatgngacccntcaattgaagttaatttgtaaaaaaaaaaaa

SEQ ID NO: 1851 - DNA, 593 bp, Triticum aestivum
gtctctctctgcacgcgcggacgccatggacaaacctccggcgggagcagcagccaacaaggctggcaatcctccggcggcagcagcagccaacaaggttcgcaatcctccggcggcagcagcggccaacaactttgccaatcctccggtggcttcgctgcaggtggtggtgatagctcctgcagcgaatgtggtcgtcaatcctgcagcgaatgtggtcgtcaatcctgcagcgaatgtggtcgtcaatccaccagcagaggcggcgtcagagcgtggagctgcggaagttctgtggctgattgtttccctcttcattttggtgatcggcgtggttctgctgctgaactggtgcctctaaaagtagagaaactatgtcacgtctggggacgaaacgtactgtagactgaggagtgcgccacccgaccgatgaggacgacggtaaataaagtggcgcaggcatgggttaagttaaagctatcgtgcgtcgcgtactagcgcgcgcgcgcgcgtgtgtggagcttataagctttgtgctgtaaaactgaaacaatctactacgtctgaagaataaagtaaactgaaaaaaaaaa

SEQ ID NO: 1852 - DNA, 620 bp, Triticum aestivum
aatcgacgtgtaacagggctgaatgctttcttggttctgtagaactttacaaggcccatgtagtacctgttgttaacactctatcaccgactccgacaagcggcaaaccaaaaaaattaaaacaagcgtatgtctctgtagaacccctagatattacacggataacttagcggaaggccagcctctccatcggcggggtcagcagcgtgccaaaaatcatctccccggtgaaacgacacacacaaaaaactgtagtatctagcacgccagccgttcatcgggcatatgcagatcagatcaacgcgccaagggaggccgaccttcgatgttccttgccattgtgttcaactttgtccagccgcttgtcgaaagttgatgaggcccgaacggtgcagtgcggcaggcaagcagcacgtcgtctggaccatctacttgtttgggcagtctgatgctctgtgccctgattgcccacatgtgaagcatgcgccactgaagcttctgtccctgcttccaaaggaagagccaccacgaccaccgtatgacgatgagcgttcaccaaaggaggaggatctgtcaccgaaggatgatgagcctccacgcccaccataggacgagtggcc

SEQ ID NO: 1853 - DNA, 680 bp, Triticum aestivum
  misc_feature (2)..(2): n is a, c, g, or t
  misc_feature (6)..(6): n is a, c, g, or t
  misc_feature (11)..(11): n is a, c, g, or t
  misc_feature (459)..(459): n is a, c, g, or t
  misc_feature (557)..(557): n is a, c, g, or t
  misc_feature (594)..(594): n is a, c, g, or t
  misc_feature (621)..(621): n is a, c, g, or t
  misc_feature (635)..(640): n is a, c, g, or t
  misc_feature (642)..(642): n is a, c, g, or t
  misc_feature (644)..(656): n is a, c, g, or t
tngatncgctnagctcgaaattaaccctactaaagggaacaaaagctggagctccaccgcggtggcggccgctctagaactagtggatcccccgggctgcaggaattcggcacgagcgggggcggcggcggcaactgctacaactgcggcgagccgggacacatcgcgagggactgccccaccagcagcggcttcggcgggggcggcggcggcgggaggttcggcggaggaggcggcggcggcaacgaccgctcctgctacaactgcggcgagcccggccacatctcccgcgactgcaccaagtgaggggatatctctgcccctcccccctctatagattgcgcctaaatacctctcgtcttagttttgccgatcgatcgatctgggcccaagcgcccagcttcagccgcctcgcttattttatcttctccccccttccgttctcggagtccgtcctanggaaaagtcaagtcaagtcaagtcaagtccgtgtgatggttaattttgctatgaattggtctctggtacccgtaccgtactctcagttgatgtttaangtcgtgatgatgatggattattggtgatttttgtggngatgatgagaatgcaacagatctctgnttttttggtttccnnnnnnanannnnnnnnnnnnnccccacttgagccaagcatcaaat

SEQ ID NO: 1854 - DNA, 545 bp, Triticum aestivum
aaagactacagatacataccgagagaaaatgcagattactggtgtggtcaagtggttcaacgaaaccaaggggttcggcttcatcacccccgacgacggcagcaaggacgtcttcgtccacttcaccgcaatccaatcccatggcttcaagaccctcgccgagggccagcgtgtcgaattcgaaattcaagacggccaaaaaggcccgtccgccgtcaatgtcaagcccctagaggtagaggaggataagaggatttcgagcaaattgtaagaggatgctccacccatccacccgcgtcgatgtgtaatatcctatgctgcgttcggaaagattgctattgtttgtcttctcttctcacatgtacactgaaatctgcactgtttctcttttcttttttattagtacatcaagtctacaggggttaactgctgctccgttcgggtttgcaaggaatgtggattttgtttgagtcaattcttttttacttttttaaaaagtttatactacaaagaatatcgatgtttaaagtaccaaaaaaaaaaaa

SEQ ID NO: 1855 - DNA, 1029 bp, Triticum aestivum
ggcacgaggcgatctagggtttcctgctagggttttggtccttcggtttcggcggcgcaagatgggggagagggtcaagggaaccgtgaagtggttcaacgtcaccaaggggttcggcttcatctccccggaggacggcagcgaggacctcttcgtccaccagtccgccatcaagtccgacggctaccgcagcctcaacgagaacgacaccgtcgagttcgaggtcatcaccggcgacgacggtcgcaccaaggcctccgacgtcaccgcaccaggaggaggagcgctctccggcggctcccgccctggcgatggcggtggtgaccgtgggggccgcggcggctacggtggcggtggctacggcggtggcggtggcggtggcggctacggaggcggtggtggcggttacggcggtggcggtggcggctacggtggtggcggcggcggccgtggatgctacaagtgcggcgaggagggccacatctccagggactgcccccagggcggcggcggtggcggcggatacggcggtggtggctatggaggaggcggcggcggcggccgcgagtgctacaagtgcggcgaggagggccacatctccagggactgcccccagggcggtggtggtggcggcggcggcggcggctacggaggcggtggtggccgtggcggcggcggcggcggtggcggctgcttctcctgcggcgagtccggccacttctcccgcgagtgccccaacaaggcccactaggcggcacagctcttcagatctgagtgccccgtttaccctcgctcctttacctacctcctgattctgcagcaagtcataccctatacctatcagtactagtattagtcgccgtagcgtttccccctgctgctcgatccgagcttggttccagaagaattgctggtggtgtgttcgtcgttaagatccaagttattttgttgtctctctgtgatgaggacacagatctatctatgtgttggatggactaagttatcgaaaaaaaaaaaaaaaaaaaaaaa

SEQ ID NO: 1856 - DNA, 509 bp, Triticum aestivum
  misc_feature (199)..(199): n is a, c, g, or t
  misc_feature (203)..(203): n is a, c, g, or t
  misc_feature (205)..(205): n is a, c, g, or t
  misc_feature (354)..(354): n is a, c, g, or t
  misc_feature (391)..(391): n is a, c, g, or t
  misc_feature (447)..(447): n is a, c, g, or t
  misc_feature (462)..(462): n is a, c, g, or t
  misc_feature (474)..(474): n is a, c, g, or t
  misc_feature (483)..(483): n is a, c, g, or t
  misc_feature (493)..(493): n is a, c, g, or t
  misc_feature (506)..(506): n is a, c, g, or t
ctggaacttgccaacttgaatttgaagaacagtcgtgggtacacagcactccacctagctgctatgaggagagaaccagctattattatgtgtctcttaagcaaaggagcagtggcgtcgcaattgacagatgatggccgccttgcaagtaatatttgtcgaagattaacaagactaaaagattataatgcaaaggatngagnanggccaagagtcaaataaagataggatgtgcattgacatcctagagagggagatgatgaggaatcctatgacagcggaagattcagtcacctcacctttattggctgatgatcttcacatgaaactaagctacctggaaaataaaagtcncgtttgcaaaattattcttccctgctgaaacgaaagntgcgatgcaaattgcgcaagcaaacgtcacaccaaaaattggggttttttctgcancaagtacttctggtnaactgagggaantccatttgnatgagacccncttacaaaaaaanaaa

SEQ ID NO: 1857 - DNA, 733 bp, Triticum aestivum
tattaccccaacaaagtgacaggaaaacagttcaagcaggctccagcttagcagcacctgccatgccacaaatctaccacaacaagagaaccggctgcagctgcatcgtccccaaacacaacgaccgtctaccaaacccccaagtaacaattgcagactctaaattcagttttacaatatcattggaccgaattgacggtcattcaccacacacataagccaaggatgatttgccagggggcaaaggcccgccctaggcgccccctctcgcgcggtaatggaagtcaccggacggtaaggtgtggtcgtgcttcgagaacatgccgccgtctgcaggaacgccggcgtagccaggtctcgctgatgcattgccgccgccggaggcctcggacttctccttcgcgttgaggaaccgcccgcctgttccccgggcccgcttcatcgcgtgctggtgccgggactcgtggaggtacggcttgcggctcttcaccagcttattttcagcctctaattttgcgcggagctgtctccttcggagaatggcatggtattgcttcgcgttcacataaatgggctcttcggcggcggccggttcaattggcagcggcactcgagaggatggtaccatgcccaccatctgggggtgcataatagcatgtgcgccataggctgccactgcaccaccatagtaaggatcagcatatgggtatgatatggcaaaagggatgagtgc

SEQ ID NO: 1858 - DNA, 734 bp, Triticum aestivum
tcggcacgaggccatggcgccgtcgtcgccggcggcggcggcggtggcggagggagacgagcagcagcagcagcagatcgtggcggcggcggcggcggccaagaagggcggcgggaagaggggccggcgcgagatgcggcggatcgaggacgccaccagccgccaggtgaccttctccaagcgccggagcgggctgctcaagaaggccttcgagctgggcgtcctctgcgacgccgaggtcgccctcatcgtcttctccccccgcggccgcctctacgagtacgcctccgcgccagatttgcagaaaacgattgatcgctatctgaaccacacaaaagggacatctgccaatgagaaaactgttgagcaaccagctgctggcgtccagatgtgtagatccgaagctaccgccttgaagcacaagatagacgcaattgaggcataccagaggaagctatctggagaaggactggggtcctgttcggcccatgagctgcaagagctggagctgcagctggagaagagcctaagctgcatccggcaaaagaagcaacagaaaatgctggataaaatcttggagctgaaggagaaggagagaaagctgttgacggagaacgtggtgctccgcgaggagtacaaggcgctgcctctgctagagctggccactgctgctgctgctgaaagatcgcctgacggcgccggagctgaagaagctgaggaggacgagcggcggc

SEQ ID NO: 1859 - DNA, 442 bp, Triticum aestivum
  misc_feature (425)..(425): n is a, c, g, or t
  misc_feature (430)..(430): n is a, c, g, or t
acgacgccgaggtcgcgctgctcgtcttctcccccgccggcaggctttacgagtatgcctcctccagcatagaagatacatacgaccgctatcaggcatttggaggagccggaaagaacctgaatgaaggcggtgcaagcaccaacaatgagggagtatttgctgatgccacactgctgccttgccttgtgcttttcatatcagtctgttgtcagtcttcactgctgctatgtcatacgcagttgctcgagaaataagtttgagctcttttacaagtacccttaaattaatataagccgtctatttctgggcaatccaatggccagtatgattcggtactcccatcttttgttcacggagtactgacccaaagagtcaaggagtacttaatctaaggggcaaacagtaatcgcatcaatcatttnaaaanaaaaaaaaaaaa

SEQ ID NO: 1860 - DNA, 507 bp, Triticum aestivum
  misc_feature (482)..(483): n is a, c, g, or t
gcacgagggagaggacgaggctggtggggaactggggatggcgcggcgcgggcgtgtggagctgcggcggatcgaggaccggacgagccggcaggtgcgcttctccaagcgccgcgcggggctcttcaagaaggccttcgagctcgcggtcctctgcgacgccgaggtctcgctgctcgtcttctcccccgccggcaggctctacgagtacgcctcctccagaattccactattcgctggtgcttctacatgctttcattggatattccagaccaccttagtcggagttcaacaagcttctcttcaatcaacgccacccctacctcatcatgtattcactcttcataattaaatcctttattgtagggccacgcatccaccttagcatgtgcatcttagtgacacatttattggatgtggtgtctcttagtagcccaacactctgctccatatatcatcacaggttcgttcgatgtcctaannaaattaccttttaaaaaaaaaaaa

SEQ ID NO: 1861 - DNA, 661 bp, Triticum aestivum
gggaaaatgttgcgagcctctgcagaagtacaggctatacctcagacggctaagtgccgtggcatcacagcaagccagcattgctgctgcttttggaggcagagaccccttcttgcacatgggagcatttgaaggacttcatagttatcatcaaccctttgcccctcctgctgctcttccatctctcaatccacatggactgctgagtggtgctggtgcagcagcatttgggcttcaggaccttgcttctcccaaggcaaaccagtgttctagcagcaacggcgcagtaagtcattgcgccggcgatacggagaagttccacattgtgagcttacaagacaaccaacaggcagatttatcgcaaggcttgacctcgtcgcttgggcagccccagctccatcagaagtggattcatcaagaaaccagtgacttgtgctctgtcttttccgggggtgctctggctaacactatgtctggcacacttcaaagagttacaagcagttcactgccaccagaagatcttttggagtgcactgcacacatcaaagttggagcccatccatcaataggaataccaactgggagttcagggctgcttgaaaggtctgtcggagtttccgccgatttgcgggattcttgtatatctcagcagtgtgctctt

SEQ ID NO: 1862 - DNA, 556 bp, Triticum aestivum
  misc_feature (481)..(481): n is a, c, g, or t
  misc_feature (500)..(500): n is a, c, g, or t
  misc_feature (508)..(508): n is a, c, g, or t
  misc_feature (525)..(525): n is a, c, g, or t
ctcgagtttttttttttttttttttcgatgaatttgtatccaacactagtacagtcagagttgatccagtttgtgggccataacatgctgcatgtcttcactgtctagttctacaaatataggacaaaaaatcgtggacgcagagcggttttgaatccacccatccaagcatgttgtgcgcaaacagctttaaaactttgcaagtccaaacaaccttttgttttttctagaaaaccgattacaacacgcacacactcacaccaccacacaaacgcactcacgtatcgccaacttaagactactagtagcatgtaactcaaagcgatttcgaattagtgaaatcgtttattactttcacacagagcgtaagggacatgttctgttgatatttcagtatatgggtgttatgcatcacacatgtctatcgaagtagtgcgttatgcatcacaccgtgaagaccacaactatgggcgtcagctcnaactggcttgtagcctcanagctgctnagtctccgagaacgccnagaatctcgggtacacctatctgggtggcgg

SEQ ID NO: 1863 - DNA, 772 bp, Triticum aestivum
  misc_feature (1)..(1): n is a, c, g, or t
  misc_feature (744)..(744): n is a, c, g, or t
  misc_feature (767)..(767): n is a, c, g, or t
nggacgaggcagatggtggggaagcctgcccggggagcaccaccctcaccagcaccagcacccgcatcagcatcagcaccagcaccagcacccgcaccagcatcaccctccgggccccatgctctacgccgcgccgccgccccacgctgtggcgccaccgccgggcagcaatgctgctcggcatgggcgaccttatgcgcaagaagcggggccgcccgcgcaagtacgcgcccgacgggagcatggccctcgcgctcgcgcccctctcctccgcctctggcggctgccgcgccgcccccgcctccagcgccagcagacggcttctccatcagcagccccccgtctgatcccaacgccaagcgccgcggcgcccccctggctcctggcaagaagaagcagttcgaagcactcgcggtcgtggggtatctccttcactccgcacatcctctccgtcaaggccggcgaggatgttgcttcaaaaataatgtccttctcacagcaaggacctcgcacagtttgcattctttcagcaacactggtgcacataagcaatgtaacacttcggcagccagctacatctggtggactggctgacttatgagggtcgatttgagatcatctccctatctggttcattcctacttgcagaagatggtgacacccgtagcaggactggtggatttgacgcgttgcacttgcaggatctgcatggccgggttcttggctggatgtgtcccctgggcngctaacggcgtgccgacctgtcncggtg

SEQ ID NO: 1864 - DNA, 684 bp, Triticum aestivum
  misc_feature (26)..(26): n is a, c, g, or t
aatctttgactccaacacggcggatnacccacacttaattcacagcgaaaagtctaggctccagccgggataatcagttttaggtccccagtcggaatactcggttttaggtcattcatattgctacataataaggtggtcacttccacggtaccatactgcctcacattcataagagcggttcttgtctgccattccgagactaggctatcatagagccgaagcagcgatcacacaacatatccatgatcggaatgatgttggtagatcgtctaactatattattgactaaagttcatggcgaggagagggctagctaggttggtgaaccgaacacgtcgcaataccgtgatgatgatgcgatcctggagtgctggtttagttctggactccgatctccgtttcagtagtccagtggcggtacggaggccatgttgccggtgagattctgcaggtcgtggcccccagaataaccgtcgcagacattgccctgcgccatcctcgctccaggtgcagaagacagaaggccctcgccgccgccgcggaccatctgctgcacctcctgctgcgagagtatcttgatgcaccctacgctattcacaaactcctgccatgggtcgtcgccgacgagaagaatatcattttctcggtcgacgaatacaagctgccagcctgatcttacgg

SEQ ID NO: 1865 - DNA, 677 bp, Triticum aestivum
  misc_feature (12)..(12): n is a, c, g, or t
  misc_feature (21)..(21): n is a, c, g, or t
gagcctacattnacaggattngcaagtaggagtattcccagaagagagttttggcaggcttaccaaaagggggggtttacggatcacggtacagttcctacttcttcttaacatgagatcacatggcatgattattagacggtagtacatgacttaaaagagctaggaatggtctatgtgcttgctttccagttccggggtctcgaaaactaggagagaaagggaaaaaaggctgcagaaacatacgcggcgaagctagcttaagccgaggccttcgcctcgcctcagaacaccatttcttcagaactcgacttcgaccgagccgaccgacgcgatcccggtgctcaggctcctcgactcctgcctgctcgcgtagtcgtcgcagctgctaccgccgccgccgcccagcctcttcccgggggccgagctcagcagctccaggccctgcttgcccatctgctgcacctcctgcggggacaggatctttatgcaggacacgctgttcacgaactcctgccaagggtcgtcgccgaccagaaggacgtcctcctcccggtcgacgaatacaagctgccagcctgatctcatagggtcttccaactggccctcaaggccaaataggcgccccaggtccctacgtagttcatggtagttgctaaacttggtgatatcaagcg

SEQ ID NO: 1866 - DNA, 544 bp, Triticum aestivum
ttttttttttttttttttcgaaataatcctcctgcattcaaattattgcagttcttcaaggaaagcgtgcctgggagtctcgaatacatagatagaatacgaccgacagagtaccaactaagcatagtcttgaaagatttgatgcggcgcgcaaacagactggctgccgcgccgcgcgaggtacaaaccatctagggtaaaagttaaaccgatacagattcccaagaggaacctacagaaatatcagttcatggcgtcggtggcctgcaccggacggagataggtaacgggtggggagctctcgagacgtgcacggagcacacgcaagagacaggtacgaagatgagacgatcggaggttccggggatgttgtgccgccgtgagcaagggtgctaccatgtgctgtcgaatcctcgctggacccagaaacagcacaatgatcttgcacttaggaaaggtaacgtggatcatttccttgcttgcccaacttgtgcacatcctctggtgaaagtatcttgatgtaccatacactattcacaaatga

SEQ ID NO: 1867 - DNA, 717 bp, Triticum aestivum
accccaacaccaaaccatccaacgaacaaaaaccaagttcatttgcatcggccagttggagttgcccttacgtgatcagcattcgagttgcccaaagggcactcctcggacaacatacctacagtatgaaacgtaggtacagcggctacaggcctacggcaacccagtaccacatgctcagtctcgaagttacgaaaccataacagaagcatattcagcacgcattcacgatgcactgatagaacgttaacttaacatccaccatagttacaaatccatgttacataattcacttatagccccatgcttcagaattcattcataatccagaaaatagtttattcaggatactgttccagatcatagttttgatgcttctggtgtttactgcattcccctgtcatcagacccaggaggaattctttatccctccagcctcaggttcttctccttggcaccttgagccttctgctatctttggcttcttgcattccacctcatctccaataggagtgtgtggtcgtttcgtgatatcgggtttcttttcatcatctaagagctttctatccgactcgtccacatccacgtcgtcgtcctcgtcgccttcgtcgtcctcgtcgccatcctcgccctcgacgatgtagaatacatcacgagcacgttcgaaagcactcatttcctctcgtaacttgtcgatcttttgctcgaacgtcttac

SEQ ID NO: 1868 - DNA, 589 bp, Triticum aestivum
  misc_feature (18)..(18): n is a, c, g, or t
  misc_feature (20)..(20): n is a, c, g, or t
  misc_feature (163)..(163): n is a, c, g, or t
tccctatatttataaatncnaccttttaattctagtacaatttctccttcacacaaacccactaaaaatcagaaagacagagaaaatggcaaaataacgcgttaattatttgcactagagattatactatatcatggccgtggaaaccaagaagccgccgcangaaagagaaagaaagaaagaagaggaacgcaagaactccaagaattcgccgataaatgaacaattgcaccatggagcccataaattacggccagccggggctacagcgccgatccatggccccacgcggtcccgcacctcgggcggaaggcgactaggcatggcggagcgcggatccgcttcttgggcggcagggccatgaacacggcggagaggtcgcccgggacgtcgaagaagcgcagcggccgcttcggcgatggcctcgtaccgaccaaagccacgggcttcctcggcgcgccggggcactcggtcggcggccggagcttgctctcctccgaagtcggtgtcctgggctcctctcttcctcctcctcctcctcctcttcgtccgccaccgcagccggcgtccgggactccgccaccacctc

SEQ ID NO: 1869 - DNA, 323 bp, Triticum aestivum
atgaacaacacaaaggctttatgctttgtacttctgattgctttgtctaccttgcagtactggccttgtcatgcatccgagggccatataagtgttgaagaaggtgggattagacatatgtgtaggtacatgcttggcggtaacactacgaccgagaggtgcagagagctttgccttgcacttggcagtatctacaatgcggacttaatttacctccaattctgtgacaaacgctacacgtgccagtgttgctgcaaaatgtactgattgatgcgaaagatttaataaacttgtcatcacagagcaaaaaaaaaaaaaaaaaa

SEQ ID NO: 1870 - DNA, 640 bp, Triticum aestivum
  misc_feature (328)..(328): n is a, c, g, or t
  misc_feature (409)..(410): n is a, c, g, or t
  misc_feature (460)..(460): n is a, c, g, or t
  misc_feature (493)..(493): n is a, c, g, or t
  misc_feature (533)..(533): n is a, c, g, or t
  misc_feature (540)..(540): n is a, c, g, or t
  misc_feature (543)..(543): n is a, c, g, or t
  misc_feature (545)..(545): n is a, c, g, or t
  misc_feature (559)..(559): n is a, c, g, or t
  misc_feature (562)..(562): n is a, c, g, or t
  misc_feature (578)..(578): n is a, c, g, or t
  misc_feature (583)..(583): n is a, c, g, or t
  misc_feature (603)..(603): n is a, c, g, or t
  misc_feature (608)..(608): n is a, c, g, or t
  misc_feature (622)..(622): n is a, c, g, or t
  misc_feature (630)..(630): n is a, c, g, or t
  misc_feature (633)..(633): n is a, c, g, or t
gacgagacgaccgaccccaagccaaaggaccaaagcaaggctaggcaagcagcgtcactgaagcggaaaacgcgtcgccttcaccagtctccactccagagaggagagctttgattgctggtggtctggtcggcggcggcggcggcaatggagcccctggaggtggccataacgatcatattcgacgcgctgctgctggtgttcatggtgaagctcttcttcgccatgttccagatgaagctcgtcgtcatcctcttctacctcgtcatcctcctcttcgccatggccttctccggccgggcgcccagcagcttctagctcgacgatngtagcaacagaggtggcaaaaattgaagctttcttctcctccccctctttcgtttcttctccccctcctggagggtggatnngtggatcttgcaacgctacgtacttctgtgaaaaaagacatcatctcggnttttggtggatggcaactaattaattctcctangaaaaaaagataagaagaacgccatgatcgaggccaaatnctaactnaananaagaattatcatcnaanttcattcccctccagntccanttcaagtagaatctgcgtcnccgcnttgtaggttctgtncaacatgngantaaaaaa

SEQ ID NO: 1871 - DNA, 431 bp, Triticum aestivum
  misc_feature (25)..(25): n is a, c, g, or t
  misc_feature (52)..(52): n is a, c, g, or t
  misc_feature (74)..(74): n is a, c, g, or t
  misc_feature (80)..(80): n is a, c, g, or t
  misc_feature (82)..(82): n is a, c, g, or t
  misc_feature (109)..(109): n is a, c, g, or t
  misc_feature (140)..(140): n is a, c, g, or t
  misc_feature (143)..(143): n is a, c, g, or t
  misc_feature (146)..(146): n is a, c, g, or t
  misc_feature (163)..(163): n is a, c, g, or t
  misc_feature (176)..(176): n is a, c, g, or t
  misc_feature (232)..(232): n is a, c, g, or t
  misc_feature (245)..(246): n is a, c, g, or t
  misc_feature (254)..(254): n is a, c, g, or t
  misc_feature (265)..(265): n is a, c, g, or t
  misc_feature (283)..(283): n is a, c, g, or t
  misc_feature (300)..(300): n is a, c, g, or t
  misc_feature (307)..(307): n is a, c, g, or t
  misc_feature (330)..(330): n is a, c, g, or t
  misc_feature (346)..(346): n is a, c, g, or t
  misc_feature (371)..(371): n is a, c, g, or t
  misc_feature (376)..(376): n is a, c, g, or t
  misc_feature (381)..(381): n is a, c, g, or t
  misc_feature (405)..(406): n is a, c, g, or t
  misc_feature (414)..(414): n is a, c, g, or t
  misc_feature (420)..(420): n is a, c, g, or t
tcgagttttttttttttttttttancacaaagtcctttttttcataggaaangctatcataagttttgcagcangaaaananacaccaatgcttcaacatatcaagtcncaacatttagttctcgcttatctttgaaagnaanaanatctaactcttcatcanccatttcctcgtnatcgtcatcatcgtcgtcgtcgtcttcatcctcacaaccactgcttcccgccttgnttctaccatttanntcacttanggacgcgccanttaaggagtggagatgtncaggtactatcagttancccaccntcgtccatatcagcaccattggngcctaaaccggcgggnacgccgttgggtttcacgtcaagcngaaanggacnattccccgtcaatccattcgcctnntccaggtnctcagnggttttagcaa

SEQ ID NO: 1872 - DNA, 269 bp, Triticum aestivum
cgcggagggctcgtccacgtcctcgtcgctggccaggctcccggtgctgctcaccggcatctgcagcggcggcgcggggtaggcaggggcagcaccccgcaattaacacccctcccgaggggcgtttacgccgcgtacgtgaaagcggactgaatgcagcatgattcttttcttcaccccacggaacggattccctctgccgcttcatttctccttccctccgttattaaataataatattttgttgttgcccttggaaaaaaaaaaaa

SEQ ID NO: 1873 - DNA, 505 bp, Triticum aestivum
  misc_feature (455)..(455): n is a, c, g, or t
  misc_feature (464)..(464): n is a, c, g, or t
gcaatggacacccatcctaaccatccaatcgttaatcttcatttggatccagagatatcggaagataccgatgatgaggatgatgatgagtatgacgatgatgacagcggcgatgaaggagaaagaatggatctggactagaatcaacggcggtgatggctggtgggcatgatggggaagtacacatacggattttataggtcccacgtaccaggtgatgaagaagagaggagagatgaaatggataaaaatcttggctggtgtcgaagaacaggatctgaactaaggttcctgttgctctgctacaacaacgcaagcgcttgcgttattcagtatatcgcttcaatttagagctttaataacttctcgttgtactgctacctaatttgttttccccattcatctgattgctaaagtttgaactgattatatcgtcattatgaactgtgtaatcncgttcttcncttcattggattcacctttgtttctcattaaaaaaaaaaaa

SEQ ID NO: 1874 - DNA, 514 bp, Triticum aestivum
  misc_feature (425)..(425): n is a, c, g, or t
gtttgtgctactagctagctagcagcttggctcatcgcgggacatgaagaaggatgaagagggatgcaaatgccaccatccccttcaagcccccgccatcccctccccaccatggctggtcgctcggcatgccgcagacgccgctccgctgacctcttcgtccccgtcttcgtcttcgtctccgtcgtcgtctcggttctaccgcagggcaaaggcatggaggcatccgtgcaagcttagctcagaaaaatggtggagagttctgtattggcatgcgggaaagccaggcaatttttttttcctcagttccgacttgtttccgctttcctctccttgctaattgctgtccttgttcttgctgctctaggtcgcttcgttcgaccttcaagactatttgtatctcgtttcgttgcgaattttaaggncatccgatccatggatgttatatatcatcgagatcgatatgggcattcaagattctatataattgtgtgtaattaagaaaaaaaaaaaa

SEQ ID NO: 1875 - DNA, 441 bp, Triticum aestivum
  misc_feature (215)..(215): n is a, c, g, or t
  misc_feature (236)..(236): n is a, c, g, or t
  misc_feature (239)..(239): n is a, c, g, or t
  misc_feature (300)..(300): n is a, c, g, or t
  misc_feature (311)..(311): n is a, c, g, or t
  misc_feature (322)..(323): n is a, c, g, or t
  misc_feature (328)..(328): n is a, c, g, or t
  misc_feature (333)..(333): n is a, c, g, or t
  misc_feature (359)..(359): n is a, c, g, or t
  misc_feature (378)..(378): n is a, c, g, or t
  misc_feature (401)..(401): n is a, c, g, or t
  misc_feature (404)..(404): n is a, c, g, or t
  misc_feature (414)..(414): n is a, c, g, or t
cgcattatcagtaccatgagaacaatatggcagactctgcagctgccagcgacggtgagcagagcgatgaggaggaggaggaagaggacgatgacaatgaagaagagagccagtaatgagagactgaataacaggtccaggcattggtgattcaaacagtttctattgggtatgtgttagggttacattgcaacaacttaacttatatttgaatncaagcaggaactatatgtccnagnaattattttattggaatccttttatcaaagtaatttcccaagggtttaatttattacttanttatgataagnccccgcccttnntcaanttgcnaccacatatttcatgccccttaaccnaatttcaagacacatctgncccgattcctttgtgccaagatntgnctgttttgcnaaccctgttgcccctaaaaaaaaaaaa

SEQ ID NO: 1876 - DNA, 488 bp, Triticum aestivum
  misc_feature (256)..(256): n is a, c, g, or t
  misc_feature (336)..(336): n is a, c, g, or t
  misc_feature (358)..(358): n is a, c, g, or t
  misc_feature (370)..(370): n is a, c, g, or t
  misc_feature (385)..(385): n is a, c, g, or t
  misc_feature (393)..(393): n is a, c, g, or t
  misc_feature (420)..(420): n is a, c, g, or t
  misc_feature (436)..(436): n is a, c, g, or t
  misc_feature (454)..(454): n is a, c, g, or t
  misc_feature (464)..(464): n is a, c, g, or t
ttttttttttttttttttttttttttttttttttttttttttttttttttggcttacaaccgccacttcacacaatacataaatatagcattacatcatccagaatacaatcaaggtccgactacggaaccaaataaataaagacaaccccaaatgcatagatccccgatcgtcccgactgggctccactactgatcaactagaaacaaaacaacacaacaaacacaatcttcatcgagctcccacttgagctcanttgcgtcatctgcaatggcatcatcgtcacctgcaactgagatcacgcaaggaagaagaacgagtccatgaagaagacanacagacgtagtcgaacggattntcacaaacgcgncgtttcgggaaatcngggcctancaagccgaaactaaagctgggccaaanaggaggccactggccnacggggaaacatcaaggncgaccggatntgacgatgcataaccggtgctgaa

SEQ ID NO: 1877 - DNA, 511 bp, Triticum aestivum
ggcacgagggatgaagagggatttgatgaagacgacgatgatgaagatgaagaagaggaggaagatgatgaggagtgaagccctctttcatgctgaatttcagttggcttcgacaactcccgtgcgtgtagactgaaaagcaaggtggtgtccccttttgtggtgttttgttgcttgacttagctggatctgtaggattgtaaggttgatctgcgggaacttgttttgatctgctcatacatttggagtcccgcagattccaatatgtggcatttcaagtatattgttattgtgggatgtagtagttccggatatgcaaggtgtctgtgtttcctgagatacagttgctttaatgactgttagtcaacaatatttaacttatatggtagcgcaaaattcatgccgtatttcagttactcctcgacagtatcatttttgtatcccatcattcacatttttttaaactgtttgttgatcaaagctttattccaaaaaaaaaaaaaaaaaactc

SEQ ID NO: 1878 - DNA, 415 bp, Triticum aestivum
ggcggatgccgagaaggcctactacaagatgatgggcatcacccctccaaactccacacttgtctagcttagctgatggctcgtctcggtcctcctcgtctccatgttttctctcagtggatgacatgacaagccctgactcctctactcggatgatggagatgacgatgacgatgacgacgacgacgatgaatgtataggttttagatgcatgtagagttacatgatggtgttatgtatcaaccaacattacagtgcgcttgtcgactcatggtcctttctgactgtcaatctcatgagagaattggctcgagaatttcgagaaaccttgtcttttttcagattgtacctgcatatatggtatatacaatactactgaaccagattgcatgatagtaaaaaaaaaaaaaaaaaa

SEQ ID NO: 1879 - DNA, 511 bp, Triticum aestivum
  misc_feature (487)..(487): n is a, c, g, or t
  misc_feature (495)..(495): n is a, c, g, or t
  misc_feature (498)..(498): n is a, c, g, or t
gccgccaacgctgccttctcgacgcccttgctcggccaaatctacaaccccgtcaatcagagcggaatggatgggagccagaggcccaggttatgaggtgccaacttgtctgtttgtcgtcccttccaaaaagcaccagcagccgccgcccaacgtctaccacgtccgttcaatttttttcttcgaaggtcatgtgatttgctcatgaatggcacaatgtgctttcatttgttacatgtttgtttccgatcttgtatttgggtattcctaatctcccaatctttgatcttgtttttgctccgaatgatgaccgacaaaagaatgttcacttaatcacaaggatagctaagaaacaatttgtcaactggtgttaacttttcatattgtttgtgtgttaacatttgcatcaatggtacaaattgctaactggggggggtaattgggtggttgatggacattccgttagtatcaagggaagcaaacatcntattgggnggntaaaaaaaaaaaa

SEQ ID NO: 1880 - DNA, 683 bp, Triticum aestivum
attcggacgaggaacccctccctctctccctccattcgaaccaaacccgagggagccgccgcccgcggaatccaaactttttccctccatccccttccccgcgcgatcaatcgatcgcttgatcaagcgcttgatcgagcgatcggagccgatcggggagcagcggcgatcaggaatcgatccgtgctccgcatacaagatgtcgccggcggagatggagtccgacaaggtcgttgaggcggcggcggatcctgaggagcgaggcgctggcgaccccaaggcctgcgacgactgcaacaccaccaagacgccgctctggcgcggcggacccaacggaccaaagtcgctgtgcaacgcgtgcgggatccggtaccggaagaggcggcgggtggccatggggctcgacccggaggccaagaggaagcccaagagggacgacgccatcctatccaaggcggaggcttctagtaccaaggaggaggaggaggaggacaacaaggccagcaccaacaagatcaagaccaagacgactactcacaccgtggagctccacatggttgggttcgccaaggacgcggtgctgaagcagcagcagcggcggcggcggcagatgcgacggaggaagccgtcgtgcctggggcgaggaggagcgcgccgccatcctcctcatgtcactctcctca

SEQ ID NO: 1881 - DNA, 764 bp, Triticum aestivum
ttttttttttttttttttttttttttttttttttttagcattacctcatgttatcaatggtaacgtgctactgtagctcaggtcatagccattcagattgtacagactacacagcaaaccaaaatctgcagcacaccgattcaaataattgcatgtgcatcttgtcccacggcttgcatcgagacattcaagcttcttcagtgagattgcatttcagacgcaatctgaaatttgtttggttttcagcacaggaaccagttgcaacactggaaccgggacggcacgtgtccggtcttccagatgcgctccacctgtcgcgccaaccagactgcctgctggtcccgtctcacctcgaccctcacttgcttcccctccaccttgtgcctcaatgtgggaagcctcttggtgaagttgttcttcacccccgccttctcggcctgcacctgaaataaaatttgcacaattacaaccagctgagatttgtttcagtcttatctggacggtgcaacaagttcatggatgctgagctctgcattcatcttggcttcgaatttggatttctggcagttctcccactcctgtatcgtcacctccttcctttgatatctgatccatcatgaccaaaacaacacaagattcagaagaaaatacgtggagattttgttcgtgacttgatgcaagtttacacttcttggactctgctcatgccgcaactcgagcttcaaactcctccttcgcctcgtattctttgccggcgctcttct

SEQ ID NO: 1882 - DNA, 425 bp, Triticum aestivum
ctcgtgccgaattcggcacgagcgccactgttccccactcctaaccctatccgatccagagggaggcactgaagcgatgggaagctccaccgctgccactcatgcacttcaccgtcgacctctacaccgaccgtcgctgcccgtgcgcagtccttcatcgacgaaccagcaatggccggaacgctaagagtagaaggagaagaaatatagcgcgtctgctggagcggctcgcgcgcgctacattttgcaacgaccgctgaaaccgacgcttcgcagcatgtaaaaactggctacgaaggcgctgtaaacgtttttttagcgcgccgcgtgttgcgcgcttgttggagattctctcagtacgtgagagacatgataaataattaaatcgtacagtacatttttctagcaaaaaaaaaaaaaaaaaa

SEQ ID NO: 1883 - DNA, 819 bp, Triticum aestivum
  misc_feature (389)..(389): n is a, c, g, or t
  misc_feature (416)..(416): n is a, c, g, or t
  misc_feature (515)..(515): n is a, c, g, or t
  misc_feature (524)..(524): n is a, c, g, or t
  misc_feature (541)..(541): n is a, c, g, or t
  misc_feature (559)..(559): n is a, c, g, or t
  misc_feature (570)..(570): n is a, c, g, or t
  misc_feature (580)..(580): n is a, c, g, or t
  misc_feature (585)..(585): n is a, c, g, or t
  misc_feature (613)..(613): n is a, c, g, or t
  misc_feature (621)..(621): n is a, c, g, or t
  misc_feature (629)..(629): n is a, c, g, or t
  misc_feature (666)..(666): n is a, c, g, or t
  misc_feature (685)..(685): n is a, c, g, or t
  misc_feature (694)..(694): n is a, c, g, or t
  misc_feature (701)..(701): n is a, c, g, or t
  misc_feature (703)..(703): n is a, c, g, or t
  misc_feature (712)..(712): n is a, c, g, or t
  misc_feature (726)..(726): n is a, c, g, or t
  misc_feature (743)..(745): n is a, c, g, or t
  misc_feature (752)..(753): n is a, c, g, or t
  misc_feature (758)..(759): n is a, c, g, or t
  misc_feature (768)..(768): n is a, c, g, or t
  misc_feature (772)..(772): n is a, c, g, or t
  misc_feature (785)..(787): n is a, c, g, or t
  misc_feature (792)..(792): n is a, c, g, or t
  misc_feature (794)..(794): n is a, c, g, or t
  misc_feature (801)..(801): n is a, c, g, or t
  misc_feature (806)..(806): n is a, c, g, or t
  misc_feature (811)..(811): n is a, c, g, or t
  misc_feature (813)..(813): n is a, c, g, or t
  misc_feature (815)..(816): n is a, c, g, or t
  misc_feature (818)..(818): n is a, c, g, or t
ggaagaaataaggtgcagcgcctcatagtgtacccccaccaccaccaacgctacactcacaagctaacctcaccatttcaggaagcatatgagcagcgaaagcttgggcaagaactccaagatcatgggtggccgtgaaagaaaagaagttaatagcaccgcaaagcattttgttgatttcacagaagcagaggaagatcttgttttcagaatgcacaggcttgtcgggaacaggtgggaacttatagctggaagaatccccggaagaacagcagaagaagtagagatgttctgggcaaaaaggcaccaggaccaatgaaaatgaaaacaggatgcatgcagtaaaactagattgacatataggatgcacatgtccatcaaaaacctgnggtggatctactcgtctatcttctagncatgctaaaagcaacttggttctgtccaacatgggatgtacataagaaacctcaagaaaaaggaggaacatgtgctaaataacaaaaatatgaattcgntttgtccangattattctacatttcnactaatacatacatgttnaatggcccagngctattaagncccanattgccaaaaagagacctgggtgattcntaactttngttttggnggggactaatccaatgtaatcctaacatgcttaaganaattccactgcagaacatnggggatgcntctgggnanaagattttnttggcaaataaaanatgctgtgtctggaaannnaccgctnnagganngctttaaanttcnggaaagttcgttnnnaaatnangtaaaanctccngtccnangnncnt

SEQ ID NO: 1884 - DNA, 563 bp, Triticum aestivum
  misc_feature (463)..(463): n is a, c, g, or t
  misc_feature (472)..(472): n is a, c, g, or t
  misc_feature (481)..(481): n is a, c, g, or t
  misc_feature (496)..(496): n is a, c, g, or t
  misc_feature (505)..(506): n is a, c, g, or t
  misc_feature (509)..(509): n is a, c, g, or t
  misc_feature (536)..(536): n is a, c, g, or t
  misc_feature (541)..(541): n is a, c, g, or t
  misc_feature (557)..(557): n is a, c, g, or t
gagactagtctcgagtttttttttttttttttagccacagttgaaaaactttactgaacaagttgaaggctagtgtcttctcagttaactaagcaaagcaaaaacagatagatacatagatagctcacagacacacaggtagatgccaatcacgacttgtacatttgttcagagcaaccaaaatccatgcccttgctgccctgtttactcctgcatgggctgccggagtttcttggcttctcgaactagccttgccatctccttccatgtcttcctgtttactcctgcatggcggattgctggcgctccctggcttctcgagcagctcctccgctcacggacaaccttggtactcctccatgtcttcggttaagtgcatcacttatgctggcatcgagtcttgacctcggccgcgacagctatcaattcccgcggcgcatgggggccggagatgcacttgggncaatccccnaaaggagtntataaaatcacggcngctttaaanntcngacgggaaacctgggtaccaactaacncttgngaaaccctttgcagcngggtag

SEQ ID NO: 1885 - DNA, 710 bp, Triticum aestivum
ctaaatgaaactcaaacagcacgtacacgactacacggtccatcaagtgtacatacaatcaaatacacatgcaccaaaacatagtggcaacatcaactaaaactatgatgcacatctccaggctgatctttggtcacaacagcagccacctcgacaacataagatcctgatctatataaattatttacttaaagattcttcacctggagttccttgtacaccaacttttgacgaatgaaggccaaaatctaacttcatgtcgatgatatggatggggctgtagtagaacatctggtaagcatcatcttcgacgctgaacgttgcagatacttgtccatttagtagtctatcatgcgctccgacaacgctgatgcgccggctgttcgaaatggaacgcgttaaagggacgcgattttggggacggggaggaggcacgctcggctcgcctaagaaccgcctctgtcaccgctgacgagagccgtgccgccgagtcccatagccaccaactcgcgccgctcgccgccgcagtcaccaccttcgtcgtcgacgcggcggtgctgccggacctgaaggggcgagcgattggtccgagcccggagagcagaggaggcatggcggcggtgtgctggcgcaccttggaagcccgggaacatggtggtaccgatggtcaaggaagaagaggagcagagcaggcccttgatcgtcaacta

SEQ ID NO: 1886 - DNA, 647 bp, Triticum aestivum
  misc_feature (2)..(2): n is a, c, g, or t
  misc_feature (30)..(30): n is a, c, g, or t
tncctgttgatttatttgacgcactttatnctgtgctaacttatgactttcatgtcaagcagactctggttctcattcttgcacaaggtgtcaatacagaagcagttatctgctgactcgctgaagtacgacataacatcatctcaaatggtacacaaggatgacacacctgcttcaccatgctttccggatgatattcacctacatgtacacacaagtcgtatgcttcgcccaaaaagtcgaaagtagtaccaaggaccggcgtgatcacgttttcagttgggttctctctgcaacacctgacagccttctcgatcgtgcgctgattcaacttgggtgcggtgttctgctcggtgcggcagcaccaatcctaagcctcttgttacaaaccagcgcttggggattcatcttccccgttgatagctccgacgtcggaggcgagctctccattctttcggccgccgcctccttcgccgagaagatttgtgcttcgccgctgtccaccctccgattctgcgtcacctcgccctccgcgaacaacaaacaaacatccaaaaaaaataggaagaaaaaaacaaaagaatacctcaaatagttgacaatcaataagggcaaaagagaaatgtttttggaaatttttgggcttt

SEQ ID NO: 1887 - DNA, 601 bp, Triticum aestivum
  misc_feature (86)..(86): n is a, c, g, or t
  misc_feature (118)..(118): n is a, c, g, or t
ttttttttttttttttttgtcaaatgttgccttgccataacaaccacatttcacggtgatacgaaccagaactgttaatttttccncggaaatatatacaggggaggggattgctganagggagaaatctagagacctcgaaggcacaaattatgtacaattcataagtacaaatcgagctccccaaacccatggacacagaagaaatcaagaatgaacattcgacaaggtaggagccgaaggcctgtcccggctcaccattgtgcattgaggtgttctactcgggggcgcatgaccatgaggctcccaagcagtcgaccaggacaccatgctgccgcttctcctcatcatccccaaccaatttgcgttggatcatctgctggaaatcaacgcgccatggaagtatctctcggtgctctgctcccccgtggcttttggccagagaaatgcgaatgccggccggccagcacgacggaattctgacttgtcgccggcgcgccgtccgtgcctcagcgacagggacagaccgtacggaaaagcggcgaagcatcggcgggcgggcggacggttttggcatctcacacgtcgctttcgcagccgt

SEQ ID NO: 1888 - DNA, 484 bp, Triticum aestivum
tttttttttttttttttttttaaataaagtcccaccttggccgcttgcattcaattagcacagtttatatagagtacttttttcagtctcctgggatatgcgagtagggattccaaacattgtggcaaagagatcatgaatcaaagcttgcgctcggttgccaaaagaacttgacgacgcttgtggtttcaccacgacggtcagggcaaccgtggaggtgaccgagggctggtgccggagcttgttggcgggctacctgcaagcatcgccctcggggacgacgagacagagccacagaggtcttggctacgtggatccggtgcaaagggggtcagaggctacgtggaggaaggcggggcactgatctccatggtcgccaatggcggcgcctttctccggttcctgtcgacggagagaagagagagattggacagatacgcggcgctgaccttgccgccgctcctctccgcgggcctgaattcct

SEQ ID NO: 1889 - DNA, 434 bp, Triticum aestivum
tttttttttttttttttttttttttttttttttaagcacatcaaaatttcgtctccattgttgagagttcactaacctacaaccggcaatcacgcggtacatacccagtacacacccagcattgtcgctcagcaccaacacccaacccaacaccatcagacccggaagtttagtcgtgcattttacccagaagcttcagtgccagtgcctcctgctgcgcgagaaggtccccgcccttagctgcatcgccaccttcatcatcgtcgctgttgtttaagtacttctttttacccttggaggacatgttctggtttctgtccgactctgagccactgtcgtcagacaccgcatctgtttcctcctgtcgcctgcgcttcagtttcatcttcttctcaaacttcttctcgtgcaaactcttcttgtgctgggccttg

SEQ ID NO: 1890 - DNA, 405 bp, Triticum aestivum
tttttttttttttttttttttttttttttttcggaaaggggttacaaatttccccacatttacatggacaccgcaacttgaccatcgaaaaccctaaacgcaaattgctacaaagcacaaattcaaattgctacacaacaagcaccaattttcccaaacagaaacgcaagcactccctgtaatcatccacaatgtgcacatttatgtcctctcacacatccaccactcaacattctatacaccaacggcagaaacacacagctattacggaggggagtttgtatcacatctcaaacacctcgcgaattccggccccagggcaccacctggttaacacacacatacatacatacaccggtgagtgagctctctcattcgcgcagcgcccacaaatatgttacaaaa

SEQ ID NO: 1891 - DNA, 517 bp, Triticum aestivum
tttttttttttttttttttttttagctcagaacattaccaagtcagaagcagaatgttgatcttgttttccactactgtagaacatttggaaacatggaagcgcccagctctaaaacaacacagtagaggtagaacagggcacatcaccctggttcgggcagggaacttaaaaaccagtacagaggcatatagccgaacaccttgcgtgcacgcaccaccgcgccgcgggctgctgccacggtcttccctcactcgggaccgcgctcgccgcagatctccttgagccgccctgccgcctccgcggcgtcgatggagtactgcaagccacgcgttgcacagccaggaacagtgagataggtagcaggaataggtcgatccattggcattccattcccatgagccgcgaatggaatggatggcgcgatgaacacgcggagagtgagaacgagcaccgcattcggttgacgtgacgttaccttggagaggaccaggaggagtgggcatgggcgcggcgga

SEQ ID NO: 1892 - DNA, 278 bp, Triticum aestivum
cctcggtgcccgccgtcgccgccgggcccgccgagcgctaatcccattcctcggtcggcgtggcgctgctgctgctgctgcacagcgcttccgcgcctctgacagacatttaccctgctttgccgtagcgcgtttcagatccagtctcctggtctgtgagttgtactaatgatggtcgcaagcttcgcccgagagagtcgagagtctaatgtcgttctcatgctgtccccaactgttaagtaatggaccacttctaattccaggttaaaaaaaaaaaa

SEQ ID NO: 1893 - DNA, 615 bp, Triticum aestivum
gcacgaggctttcttctccggctcaccttttggcctttctcttttctttttcaagtttagccatcttaccagggccgctagctgctgtgcatctcgatctgttttagtcgatccagatctgcatccgagcaagcaagcttctccatttttctttggcttttgatacacacatacatacattctacatctctccgcctgtttttgttgggtggagcttgatttcctttgcattctagtttagttcttcagctctcgacgtttactcgaaataaccagccgactccgctcagatcagccgcttgtttcggcgccagatttgcaaagactgactcacagatggagtgtggtttgaaatccctgagcagcagctcctcccccgcagcatcgccttctctgatgatggcctgcaggccgttcccgcagccgccgctcctgcccctgcccgcgcacctccaggcctcgccggcaccggcaggccgccagcgccaggtcgacccgcgcgccaacaagagccccaagaagccggcgggcggggcggcatcggcgcccatcgtggtagcggcgccgcctatgccggcgtggacgtcgatggactcgatgtactcggtgtcgccg

SEQ ID NO: 1894 - DNA, 494 bp, Triticum aestivum
gcaggatagcagacgtgcacaactagctttcgaagcctcgctcgaaacacaccagcatggcgtcccacagtgctgccggccgtcgtcccacggcgctcgtgcatatcgctctcttcgtcgccatcgccgcggtcatcatcaacagctccgtctgtcttggagccgccgtccacgacgccgccacctcaggcaccggtgctctcgaccctaacgtccctgctgttccgacgccgggcggtgccggtcaaccctacaccggccgtgggtgccgcacagtttatggatgtaaaccaccggcgggtagccagccctaattacatccgcgcgcagaccccatctcccagacacaatgcttgcgaggatccatcgatatatgtaattggttagcacaagttaatctactgtcacgcaccaccttatgtacacggtaataccgtctcgtgatgtacttgtacctacttaaactcgaataaatctggattgttgcatgtctg

SEQ ID NO: 1895 - DNA, 392 bp, Triticum aestivum
  misc_feature (11)..(11): n is a, c, g, or t
  misc_feature (20)..(20): n is a, c, g, or t
ggcgcgacagnaatcttctnctaataagctggggcgtgcaggtgcagtagcagagaatgcagaagcagagaatgtggagaaggttgaatctgataagaagcctcgtgtggagggggagggggagggtggagaagacaagctgggatctgcagaaagatgtgtggttagttgagcagagctgagctgagcgcaaggaaggtgtgattttctggactggactggactggagcgcaaggaagaagaagaagaagaagaaggaagaattataattaaattattaataatatgtatggtaactgtaatagttagtgttaagtaagtagttggtccctctgctctgctctgagaactaagtaatttaattatggttggttggattattaaaaaaaaaa

SEQ ID NO: 1896 - DNA, 429 bp, Triticum aestivum
gccgctgtggttgagggaactggaggtgcgactgaagcttgttctgataagctgggttcttgtgcaatttcagagaagtcggcgagtggtcctcggcatgtggaggctgtaggaggtgcgacagaatcttcatctaataagctggggcgtgcaggtgcagtggaagcagagaatgcagcggaagcagggaaagtggagaaggttgaatctgataagaagcctcgtgtggagggggaggggggagaagacaagctgggatctgcagaaagatgtgtggttagttgagctgagctgggctgggcgcaaggaagaagctatcatgacaagacaagtgtcgattttctggactggactggactggactggactggggcaatggtgattttctggactgctggagcgcaaggaagaagaagaagaaaaaaaaaa

SEQ ID NO: 1897 - DNA, 463 bp, Triticum aestivum
  misc_feature (253)..(253): n is a, c, g, or t
  misc_feature (330)..(330): n is a, c, g, or t
  misc_feature (333)..(333): n is a, c, g, or t
  misc_feature (372)..(372): n is a, c, g, or t
  misc_feature (411)..(411): n is a, c, g, or t
  misc_feature (414)..(414): n is a, c, g, or t
  misc_feature (443)..(443): n is a, c, g, or t
  misc_feature (449)..(449): n is a, c, g, or t
  misc_feature (456)..(456): n is a, c, g, or t
ttttttttttttaactgaaagtattaatatgcattcatagagattgagatgccaagtaacatctgcatacatgatatacaagactgcatgtgctaaatataagcctgcactttttgcggacataaagaacttttggttcctttttttttcctttccattttctgttttgaaccaacaaaaatcaagatcctatctttgtagtgaattctgattctcagaatcacccccacccgctccaaatacagaactgaanaattatttaccatggcacagagcacttccgtgttgcgccacattttcttcacttgggaactaacacgctacgcttcnttnaagcaccaccttccgcgctgctgcatacattttcaacanaaggatgtgcagaacctttggccatacgcatccatacancanagatcttgaatacactccaaggggcttcnacatgnaaacttngcctgtt

SEQ ID NO: 1898 - DNA, 631 bp, Triticum aestivum
  misc_feature (342)..(342): n is a, c, g, or t
  misc_feature (346)..(346): n is a, c, g, or t
  misc_feature (521)..(521): n is a, c, g, or t
  misc_feature (604)..(604): n is a, c, g, or t
  misc_feature (610)..(610): n is a, c, g, or t
gaactatctaactccatttttcaccagtcagactgatgatgatgctgatgattttggtgatcaaccccaaaaccagagacgaggattctatgatcaatagcagagtttgggcatgactagctatacacggtgccaagtgccaatggacttaacgatatcgtagaacgtgggatccagattggaaccatcaaacgatataaacatacacctttgcctttgttgagtaacatatatggcagagcatattgtaggatagaaatcataagcctgatcaggacagcatgcctcctgtatatatttacaaggctcaaatggtacatggtggggcccagttgaaaaggnaaantctgtgacgaactttgttgacccaagcccttgtcctacacaagatcattgttcaacagctcatcgctgatcacggcaactgcattggctcggaaaaccttgttgtgaagtgaacgtacacggttaacattacgtgatgtatccaatgaaaccaaaacgttagggcataattagcntcacggaatgcctgcataagtgcatgcatgaagataaccgtctactcgtggtccgagtagttgcgttgccgtgtggaactganacgcgngtccgcagtctaacttcacct

SEQ ID NO: 1899 - DNA, 726 bp, Triticum aestivum
  misc_feature (27)..(27): n is a, c, g, or t
atgagagctgcggacacaccaacaagnctgacatactccagggtgcgacttaactaacaggaaatatagtcgatcgagttatcttacaggttacacgggggagaaacttcgcatacgaatggaagcctgtatatactagtactacaagagcagcttcacaatctgcaatggaagcttctttgttttgttttgcttttacttcaacaataaataaaaggtggcggcgcgaagattaaatgaaagaatgcaccaaagtctcgctcgtcccggtgccgtcacagaacaacataatgtacatgcaatctcagggtctccgctggcaatgccgcagaggaaagaatgatcaatcctgtcttgggtggagaatgcggcgagggtcgccgccgtcaggtgttgcccggcttgtaccgcttcgtcgcatggggaagctcttcggcggcgttgcccagcatcgtctgctgatggcccatcatgttgttcgtcgggcctagatcggtgtgctccttaaaattggaggattgtccagcaataggtcttttgacagctcgcttgcccaggttgatctggacagagatgttggcttgggacaaatctatacccgagctttgaagagcatgcgtcaatgtgttaagtagctcttgggaatattggcttgacacgctgattgttccttcatcaatcatcaattgttgattatttaacacgtcactgttcacagcgcaatca

SEQ ID NO: 1900 - DNA, 535 bp, Triticum aestivum
tttttttttttttttttttttttaattcaaaatacttaaactatatttggtcctgattcacgaaaaaatatacacattttacatgacaaaagtcaaataaataagctcattttacacactccaatcacagacctaatattacacatcaattttcagttattctgatctagaaggatggttccaaattgatcaaagaagcaaataaaagaaaaggccattgttggaacaaacaaaaggtgagattttgtatcagggcctcacccaaccacatttctgtccgttctcttggaaaaactgtatatatgcaataacctgcaatagaaaattgtgtcaagaatgaccaactgaataaaatgggttgcatcatataatcaataaccttctaggtgtgtgccttgtttcttttatgaaaatcagcaccaaattatttatgtgtgcatctctagttagaaccaaccaaaactaataaaatctctgaggtgaaaaacacataaaaattaatggactaaaaatatagcaggattgagcaccacat

SEQ ID NO: 1901 - DNA, 311 bp, Triticum aestivum
gcacaacttctgcgtcgacaatgccctcaacgtcgcctgcctactcgcgcgctccgggaccgtccagttgccactgctttgatgatgatccatgccggcatctcgcggtgaggacagcccagtgctgaacgtcgagttgagcaagcaaggcggcgccgttcttcggtgattgaatggtccgcgcggacgtgtcctttcttgagcgtcggtttggatgtataaattggatcttgaaatgcttttcgttatctaatgctgtatgtataacatgcagtcctcttgcatggttgggtttgaacaaaaaaaaaaaa

SEQ ID NO: 1902 - DNA, 656 bp, Triticum aestivum
  misc_feature (309)..(309): n is a, c, g, or t
  misc_feature (614)..(616): n is a, c, g, or t
  misc_feature (651)..(656): n is a, c, g, or t
ccacgcgtccgcccacgcgtccgcttcgacaagatgctgtccgtcatgtgcccaccgacgccgacgccgacgccgccgccactactgccgccactaactcctctcgtgacgcggcgccgtgacacgcatccagtgccacgccgttcgtggggggtggacgtcggggagcttgtgctcgctggatgtagcaaagtggtaccagggaattcagtgccagatgcgcaattgaggggaaaacagacatatgaagctggcgcagtgcagggggaggaatttgcgattctcacagaggcaattcataggcttaangaggtttatgagagagtggagagtagcaggaggcagcacatggcggagttgaaacgtatgcggaaggatatgcaaagggaccttgaggtgaggcggagagagattttggaaaaggcacaaatggagatagcgagtcttgaggaggaggatgcaaaggagggtgctgttaacaatagattagaggatcacaatggtgttgaggagcagaacaatggcgctttggatgcttctccttagcccagcacgtacaagttcagcaaatgaggaacaaagctgggatatcatgtcaatagttggatccacannntgtttcagacacaaaatggggatttcatgtcaatnnnnnn

SEQ ID NO: 1903 - DNA, 725 bp, Triticum aestivum
  misc_feature (22)..(22): n is a, c, g, or t
gaggaattcggcacgaggctcnccttcttcttcttcttcttcttctacctcccaccctcctactctccacatcctcgtcttctattggctcttcgtgagcgcccaagctcactcttgacttctcccaccgacgccggccacccaccgccggaaacgacccatcgtccgttggctagcgagcatgcagagcatggatttggtgtcgccgtccgagcacctctgctacgtgcgctgcacgtactgcaacactgtgctcgcgctgcaggttggggttccatgcaagaggctgatggacacggtgactgtgaaatgcggccactgcaacaacctctcctttctcagcccacggccgccgcccatggtgcagcccctctccccaaatgaccaccaccaccccatggggccgttccagggatgcactgactgcaggaggaaccagccactgccaccgctggcctcgccgacatcaagtgatgccagccccagagctccctttgttgtcaagcccccagagaagaaacaccgcctaccatcagcctacaatcgcttcatgagggaggaaatacagcgtatcaaagctgcaaagccagacatccctcacagagaagccttcagcatggctgctaagaactgggcgaagtgcgaccctcgctgctcatcgactgtctctgcttccaacagcgccccggagcccagaatagtagtgcccggtcctcagctgcagg

SEQ ID NO: 1904 - DNA, 647 bp, Triticum aestivum
  misc_feature (595)..(597): n is a, c, g, or t
  misc_feature (628)..(631): n is a, c, g, or t
  misc_feature (640)..(647): n is a, c, g, or t
gtggtcgcggccgaggtactgctactagacggtatgtgtgcctcgctgcttgaagaatttagaacattagttcatgaagcaaaggatacatgatctgttgtccctgctcttgatcagcactggaagtagccaaagcaattacaacggtgcaagcatcgaacgactctgcaccagaatagattcacaatcaaattgttgtgttgtccagcgcataatgagatacaactaacgaattgagtagcacctggatatattttggagcgcctcaacgcgcttcctgaccttgggctccaggctctcgagcactcgatgtgccagaccaccaaaccctgcagcgtattcttaatcgactgcatgaggttggccttgtcctcgaacccgagctcgacgcatcactgcttgaccctttcttttgctctagagtcgtgactgattgtaggttcattgattacccactcctcataaatcctgccaaatcaatgcgtatattgaactaccatactagcacccatttggagatgatctactgaggttatgctgcaccatagtcggaaaccccatacttagatgtggacatcaagatgggaggcgagcnnnagtttgtgcgggtggggcatggccggtgacnnnnacaaccacnnnnnnnn

SEQ ID NO: 1905 - DNA, 585 bp, Triticum aestivum
ttttttttttttttttttttgttcataaaaagacaatgcatttaaaaaaaaccaaatttgcatccgcagtttaaaaaaaaatgcacaacatgtacatctagtccctaggaaaaacataggtttgcacattcttctctatacatggcacatatcttgtttctctgttcgactgtacttagtctgcatcttggcatcctaaaatctgcagtcttaggggctgtaaaaggcagaagcaccattccaaggtgtgcgataggggggggtgtatgaagtgctcgaagagacaagtgcaaaggatggagatgctcagggagggaggctgtgatggggaagctaagcgccgcacagcatcatgccgagctgctgtagcctgtggaacgtgcagctatcggagctggtggtcaatataccaaagacgagaacccacggtgcggcccctagcgatagcaacatccccatccatgactagtgcccagctcaccacgcacaccttagtggggaagatggatgcagagcaccaggggaggtggcgtcctcagaactgcgaccgttgatgcctgatccacggagggcgcgcgagctgga

SEQ ID NO: 1906 - DNA, 684 bp, Triticum aestivum
aaatccgtccaagagttcgttgataagcacttccaactcagccgccaggatgaccagcccttaacttgggcgatcaacagcgctgaacaaacagctaacagacaaatacagtgagtacatattaaaaagcaatccacaagattgtattgtagtactaacgacgacgcagttccgcttgacagcacgggttaacaaacgctaataaaacgcatgcatatagagagtagtccttcactctaggtttaatatttctcaatgaaactcatgctggagctcatcaagatatcacacccgctgaaccatgcattcgatgaggtttcgccaagatatcacacccgctgaaccatgcattcgatgagaggtttcgccagccctcccttttcgccacttattatcgtcagcctccgtgccactttcatgaagtcgctgaatggtaatcccccagtgtgcatgacggcaccagctgtgtcacggtaacgaagatggcttatgatttcttccttctcgatcccaaacatgtcagccagacggccatacaactcgtcgtatgacccaaagacagacaagtcgatggtgcgaccaacatcctccgattccataaatacctttgcagtgcccagcttccaatccaaggtcagaagcctcatgaccctgggatgagaatccaatgcagattgatgaacc

SEQ ID NO: 1907 - DNA, 897 bp, Triticum aestivum
accaaataccttggcctggggcagaccagacagacaagcggcaaactghhaggcaccgttcattcggaagattcgccgcaaaaggaaggtaaggtaatccaacacatggtgaatdaaattccaacatggcagttacctaaaccatgacagcaacaagggtccagaaagatggaatgaccatcatctgtatttattcaacttctcatcatcccacagcccgttcagatcgcatttacgtctctktaatgtgggagttaaatatgagtttgtcttcctccatccctcggcaaaccggcatgagggagaaaggtaactagcttcaaggtgcaagtyagaaaaccaagcaagtttgcgctgcttgaatctgggatgagcttkcatggattaaaataacagatcagcattgccatcagctcgatggctccagtaacaccaaagcatcagttagtttgcgctggaattcagcaaagatgcacgcgcgcacaacaaggtcagaggaaagcggacgctgaagcaggkcccacaagatgtktcaacctcgaatgatcaattttgcggaactcctgttttttaatgtcaacattgctgcytccgcaaaggcttktkcagcyacagcatcagcttctgcagcctccgcttccctcattgcggcttcagcytccgccatgatagcgtctgccttagcaaccgcacgagctgctgcagctgcagcctcttctgcgcycatgtttctcatccgtkcaagtkcagcatctacctkagadttggtgtgggckgtaaagcbatcccgctctaccttctctaccttggttggctccttttttatatyawcaagcagcagcattttggagcktcgcccttctaaaaaggacgagctaggggctatcctgtaccttc

SEQ ID NO: 1908 - DNA, 729 bp, Triticum aestivum
accggtccggatttccgggtcgacccacgcgtccggggtttctggtcggctagttcatacggcgaggagcacgggaagggaggcggaactcgggagaggagatgggtgcgccgaagcagaagtggacgtcggaggaggaggaggcgctgcggcgcggcgtgctcaagcacggcgctggcaagtggcgcaccatccagaaggatcccgagttcagccccgtcctctcctctcgctccaacatcgacctcaaggacaaatggaggaatttgagttttagtgcaagtggactgggttcaagggataaacaaagggttccaaggccgaaagcaccttcgtcctccccatcacctagcccgcagcttctgcttctctcagccccgaataatgttgccgaggcttctccaccagaagattgtgaaaaaagcccacaggatgacaagactccgagtccaaagttgtacagttccatgatcctggaagctctcggcgaactgaaagagccaaatggttcagaagttgctacaatttgcaatttcatagagattgataagtcctataagctgacggattcatatgcaaaaagggctctggctccaatgaaagatccatctctaaagaagaaggattcagcccagtcatccaaggcagcaaagggtctaggccagtcgagtcctgcactggacgcagctgaagctgcagcgatgaaagtagcggacgcggaggccaaat

SEQ ID NO: 1909 - DNA, 697 bp, Triticum aestivum
  misc_feature (20)..(20): n is a, c, g, or t
ttaattctatttatgacatncttgaactaaggagaatggactagagtttaattacaaataaacacatgttcagaagaaaaaaggatgaaaattgaatactactttcctgttcgctcctgttattgcgtcattgactggctaacacaacacagcgccaattgcatgatatatttatctaagaagatgctactagataacatcatctgaagggtgagccagggtttaggaccaacagcaagatgttgaaaacccctgcccttcattgaaacattttgatctataaggctatacaagaaactcatgtatcgacaaaagctttgcggcacaacacaagcattgtctcatacaaacttctgctcactgaagccaaatgcacggcacggctagtagagaagatcagcaagctcgaagaatcgcagaggcagcatttttgttttgcacagtcaacatgacggcatcgagaaaagcctttgcagcttcagcctcagcttctgcagcttctgcagcccttgctgcttcttcagcctccgcattggcaacttctgcctcagcaactgccttggcagcaaatgctgctgcctcttccttattcatgtgtgtcatcatatccagttcagcatccacttgaggcttagttagttgtctaatacaaatattttgtttgtcgtcttctgttgagtgcaccttggtgctcctt

SEQ ID NO: 1910 - DNA, 968 bp, Triticum aestivum
gcgcttaccgcgttaattattttcaactattacgagactgtatatggcagagttctggcaacacacktacaacctccttcagaatagactaccctaagtgcataacagtcttactacatacagtatagcttgctgacccaaagcaaatggggaagaaggtgcgggctcaagtttagttagagcacctaatctacgggtgcaacgcccggtcaataattacttccttttggattcttttcgagatatgttaccacatactgtatcacatatgccatgcggtcgataattacttgggcggataatgttttcccccaaacatcaactagctagcggtgaccaagccgaatcacccgaaatgccgaggcgtcgtcgtttctaggccagggcggggctcagctggtgagcgccgagagcacgccaccaccgctcttggaggccatcacgacctcccagccaggccctttcagggggataagagggggggcatcggcggcggcaggcggcccggtgaggtcgctccggtccatcaccttcaaaaggtcctcgtcgctgatgtcggtctggatcatcctgtcttcctcgtcccgctcgtccctcagcagcgcaasagctcctcctcatctaagacgttaggcttcgcgctattttgttcaaactgtcccttcccgatcacaacgtgctctagcttcagctttccaaaagctctcttgataatccgtccctcaacagagttggatgttgccaaccgataaacatgcactgggcgcgtttgaccaatccggtggcatcgatccatggcctgcaaatccatctgaggattccagtcactgtcatacaggatacatgtatcagcagaagcmagaattgattgcmagcccaccggcacgagtgctcagaataaagacattcatactgctgttcaacgtcattaaactcygctatctgtcycatcctgtcttctaatttaa

SEQ ID NO: 1911 - DNA, 776 bp, Triticum aestivum
ccggtccggaatttccggtcgacccacgcgtccgatcagaagcaaatccagaatcacttgattgagcagacatttgatgactacttgcatgagagcgcagatattgttttgcggaggcccggcatcaagacaaagctaaataatctactcattcagctgagaaaaaattgtggccaccctgatcttttccattctgcttttgactcaaacagtctctatccacctgttgataagcttctggaacagtgtggcaaatttcagctgttggacaggttactgaatgctctcatcaaacgaaatcacaaggtcctaatattttctcaatggacaaagattttggacatccttgactattatttgtctgagaaaggcctgaaggtttgccgaattgatggtaatgttaagttggaagacaggaggaaccagatagcagcgtttaatgacttaaacagtggtatgaatgtcttcattctcagcacacgtgctggtgggcttggtatcaaccttacttctgctgatacttgtatcctgtatgatagtgactggaatcctcagatggatttgcaggccatggatcggtgccaccgtattggtcaaaccgagccagttcatgtttatcggttggccacatccaattctgttgagggacggatcatcaagaaagcttttggaaagttgaagctagagcacgttgtgatagggaagggacagttccagcaagacgccgccaagcctaacgccttagatgagggagagctgctggcgcttctgaggga

SEQ ID NO: 1912 - DNA, 711 bp, Triticum aestivum
  misc_feature (2)..(2): n is a, c, g, or t
gnatgcggtgttaacaagcaagtgctgcttcgtcagtttctgtgataaatgtattcgagattacattattacacattcgaagtgcatttgtggagtcaaggtccttgcagattccctcatccccaatcccacagttaggagcacaatcagcaatttgttaggaacaaggacttgcagcactgccagcggtacagggaagcacagaagttcttcaggaagcaacgctgatcccaaatcacagagccacaccacctcggctgctttggaaagggacacgaagcaatgtatggacaaccagctatcgcaagcttctcccgacgcccgcctccaggtcgccacagaaggtgatcaagtcgaccggcctcagaagaattctgatctgaagagcaacactgaaggctctgcagggcgatcagtagagaaagccatacctaatgctgacctacccaaactgaaggatgtgagcgaatcaactatgaagaatggtactatttcagggaccttagaaccaaaagttgctaagactgatcagttgaagaagaagcgaaagaaggcagactcatctaaggctgttcatccaaacaatgttgattatggttacaacgttccatttgaccctgcatattgtaaccctttcaacggtggatatcaaatgggtccatttggggtacctgatccatacatgtacggctcaatgggcatgccctatgg

SEQ ID NO: 1913 - DNA, 674 bp, Triticum aestivum
  misc_feature (19)..(19): n is a, c, g, or t
aacatgaaaattcttactncgacttttattaatatgtagtagcatttgtcgtgcagagatatttgctagtatcatttaccttactctcccacaaaataaaataaaaacatttaccttgctgtttcttttacgaaaggaggattacccccgcctctacatcatttcttactgtgaatcacaaaaatcaatattggaccgaattgtggaatgaaggaaggaaaacttgccttggccgtgatggttatgatgacagtgcaggccgtgaacggcatgacattggcgtgggtgacggtgaggtggagcccctcctccacctccgacagcaccctcaccaccacccccttgacgtcgtggcagaggatcctcaccatgatgccggtctccgagaaccgcacctcgatctccggcagaggtttctccgctgccggcgcccccgacgacgcggacgagggtgagccgttttcgtctgcaacggcggcgtagcacggcttcttgacgagtaccacggtctcgttgctcctgctgctgcgtccggcggctgcctccagggccttgatcttctcctgcagctccttgacgtgcctcgtcgtgtcggaaaggatcgtcgccttgtccatcttcttgaggccggggatgacggtggagagctcgatgaagcgctggttaatcttctc

SEQ ID NO: 1914 - DNA, 662 bp, Triticum aestivum
gctaaatctaaaccactcgtgcctagctagctccttcccgcttccagtggtcgatcgcatcccacagtttcctcagctccacaggttccctgttcttcacttgtacgcacgtccatgacgaagcaccagagagcagcagcagaccaggccgtgtcactctccctctcgctctccctcggcgtcgtagccgacatcaacaagaagatgcgccgcgccacggccgccagtggggaccagttcgtgtgcaagacgtgcggccgctccttcccgtcgttccaggcgctcggcggtcaccggaccagccacctccgcggccgccacgggctcaagctcgccctcaccgccggcggtcagtgctactccgtcaaacccaagagtacggatcagaagcctgagcaccggtgccacatctgcggccaagggttcgagacggggcaggctctcggcggccacatgcgccggcaccgtgatgaaggcggcgcaggcgccgcccgtactgctcgagctgtttgtctaggctgatctcagtagttctagtgcagggttgctgacatgaatatatgcgtgcacagtcgtagcagtaggtgttgatcattggttcgttcattcctttatatgtgtacatataagtatgatggcttcttcaatgattaaaaaaaaaa

SEQ ID NO: 1915 - DNA, 795 bp, Triticum aestivum
  misc_feature (704)..(704): n is a, c, g, or t
attcggcacgaggatcatcatcatctttagagtttcagagattgatcaattggtccagagcaatgacaaagaggtatgcttttgaggagaaggagatggcgcgcatgctgctgctcgtgtcgcgggagcaggcgatgcccatgccgatgccgatggcggtgcgcggtgaccgcgccccggagcgggtgttcgtgtgcaagacgtgcgaccgcgtgttcccgtcgttccaggcgctgggcgggcaccgggccagccacaagaagccacggctggacgacgggggcaacctcaagcccaagttgcacggatgctctgtctgcgggctggagttcgccatcggacaggcgctcggtggccacatgcggcgccaccgtgccatggccgtaggcggaggtggtggcgtcatggctattacgccgccgacagcagcgatcaagaagcacggcgacagcagcgacgacgccgttgtcggcatgaagcgtgggctgtggctcgacttgaaccatccaccttgcgatgagtacggcaccagcagcgagagcgacgacgagtgcggccacgacgcagctgccggcgggtacacgttccaccagttcctggatccggcaccatggaggtggactgcgtctagctaccccatctcccactccgttgccgggtttttgccggatagtacaatattttcctgtgtgtactttggcagnaacttcttttttaccccttttctattcctttttcatgcatggataaatccatattttgtagcagtagacgagtgcccagtgaaaggcatgc

SEQ ID NO: 1916 - DNA, 393 bp, Triticum aestivum
  misc_feature (351)..(351): n is a, c, g, or t
  misc_feature (375)..(376): n is a, c, g, or t
  misc_feature (380)..(380): n is a, c, g, or t
gcggcgtggagttcgcgctcgggcaggcgctgggcgggcacatgaggcgccaccgcgcccacgagcaggaggggagcactcacgggccggtagtcgccgagcgggagcccggcgagacaagaagggggctgctgctgggcttggacctgaacgctactcccgctgagcaggccatggacctctctctctgggcctgaccgaaccgaggaccggtgggctgctgttccttctgcaatagctcccctcctactactcttctctaacctaagggggggttggaggttcctttcttgtacaatattggttgctgtcaattgattgatttggatttttcaaccccaaaaaaggatnggctgttatatcaataaactttcnnttcnttcctaaaaaaaa

SEQ ID NO: 1917 - DNA, 211 bp, Triticum aestivum
ttttttttttttttttaaaggtgaaaaatgcttcaatttttgtttgcatcaatcgggagagcaaaacacaggaggatttgtcacacgagtgtatgtacccaaagtgcaccgggcatcaacgcggagactgaattcctatgtacgccgtgtcagtgaaactgacatttctaagtgctactaagctctaccccagacccagagtggccagata

SEQ ID NO: 1918 - DNA, 697 bp, Triticum aestivum
  misc_feature (19)..(19): n is a, c, g, or t
atggcctgttatacaaagnactcccttctatggccctccgcaagatcggtgtcgtgagaagaagtcgagaacttttggagaaccgcccgttatagaactaaagaccaaatcgctcgaaattcatcatgccgagtcatgaaaggggtcattgcagtaagccaacgggatgaaccacgaatgaagcgccgtgcaagcaatacagagggaaagaatgcgcttacttcatcatcggaccgtaaccgccgccaccaccgtaggggtgttgcggaggcatacccatgcctgggccaaagggaactggtggaggtggcgcagggcggtaaggggtgccagctgggccggagttgttctgtgagcgaccccagctgagacgaacgcgagagttgccaatcgggtagccctgcatctggttgatggccatctcagcagcatggcgctgaacgaactggacaaagccacatcccttgcctggaggaatcttgacgtaagtaatctcgccgaagccctggaagaaggagcggagctcgtcttcggtaacgtagccggaaaggccgccgacgaagacagtggtgttgttggggtcggtgaactggttcatcggctggggggcacccgtagtagccgcccattgggggagcgcccatggagtacatgcccattccggggccgccgccgccttgtggcatgcccatgccgc

SEQ ID NO: 1919 - DNA, 683 bp, Triticum aestivum
ccacgcgtccggcatgcagatgttactgacgggatgttggaagagatattcaaagccacctacccatcagttaaaggtgctaatgttgttactgacagggccactggtcgctccaaaggatatggttttgtacgctttggagatctaaatgagcagacacgtgctatgactgagatgaatggagtgacattgtctacaagacaaatgaggattgggcctgcagctaacaagaagaatatgggtactcagcagacatattcaactaatgggtaccagagctctcaagtaaacgaggcggcgaatgatcccaacaatactacaatctttgtgggcgggttagattccaatatagatgagaactatctaaggcaagtttttactccatatggcgaagttggttatgtgaagattcctgtaggcaagcgttgtggatttgtccaatttaccagcagggcgtgcgctgagcaggccatcagtgcactgaatgggtctcagattggtagttccaatgttcgtctttcatggggccgtagccaaaacaaacagcctccccagcaggatgcaaaccagggtaatggcaacagctactatggatatcaacagggtcctgaggcatactatggtgcacccaatgcgcaagatcctagcatgcaaaactatggatactctggttatggcagtta

SEQ ID NO: 1920 - DNA, 573 bp, Triticum aestivum
tggttttgttcagttcgttaccagaccttctgctgagcaagcgctgctaatgctgcaaggggccttgattggtgcacagaatgttcggctttcatggggtagaagcctgtcgaacaagcaggctcagcctcagcaggaatccaaccaatggggtgcagcagcggctgctggcgctggtggttactatggtggctatggacaaggttatgaggcttatggcagtgggtatgcacaacctcaggatcctaacatgtatggttatggtgcttatgctggttatcccaattaccaacagcaacaagctgcacagcagccacagcaacaacagtgaggcgtgtttgctccggtaggtcattgggttgtcgagatggaattaattaatattatttcaaggcactcttatattgcattcttgtcaatagaggtggtttcgaaaggctcctgattttgatggtcccatggcccggtctcatctatttatatcacatatgccctgttatgtctatgaacaagtggtgctctactgtgattgctgtgttgagacatgcttaatttctttccaaaaaaaaaaaa

SEQ ID NO: 1921 - DNA, 681 bp, Triticum aestivum
  misc_feature (492)..(492): n is a, c, g, or t
gtttggtacgtagcattgaggctctacatctggaccactggacgtgacacaaccaacggcgggttcgaggttgtgtgtccatctacgaaagagtggtgtgtaatctttgtcaagcaagtgacatcgtggaggccatggacgtcaagtaccccagcggctctgtcaagaaggtgaggcaggcagctgtggcgccggcggtgcaagaggcgaagtacaacgagtgcggcaggaaccacgcactggctagcggtgggcatgtcgtggacggctgtggggagtggatgcccttgagggacctcaaccccgccgacgcgtcgtcgtacaagtgcgcagcctgcggctgccaccgcagcttccaccgcaaggtgatgacggagaggtcgccgatgttggcgcccatggtggagacagtgctccacggcctgccgcagcgcaggaaggaggagacgccggaggactggctcccgggtgtcgactctgacaccaactcanatggcatgaagtacgactcggatgccacagagtacgactcagaaggcacggagtacgatgacgagcgctccgtgccccaaccactgcaacctccacctgtgtaccatccagcacaggtgacgcaacaactctcttctgggcaacataacttcctgccgagggcactgcagatccacaggcttgccaccc

SEQ ID NO: 1922 - DNA, 603 bp, Triticum aestivum
gagctagggttgtaaccaaattccccaactgagcgagggcgcgtccatcatcgggatctgacagagtggccatggactacaccaacgccatccatatcatcccggacgccgccggtcccgaaagctgggccaactctgcggcgcctcctggcggggactctgggatttgggccaccgaggacgactacagccagtggaacggcgaccaggggcttagcgggggttgctatggcggtgacaggaactcgtcgcagccgcattcaagggccggcggcgagcagccgccgccgggcaagaagcccaggggcagtgggccgtcgggcggcggcgacgccgggagcacgagcaagtcgcgcgcgattgggaagatgttcttcaagacgaagctctgctgcaagttccgggcagggacgtgcccgtatgtgacaaactgcaacttcgctcatgggatggaggagctgcgcaagccgccccccaactggcaggagatcgtggcagcacacgaggaggcgacggaacagagagaggagcaccagatcccgatcatgacgtcgtccaacgtggtgcctggtgacagcgtgtctggcagggcgtacaaggggc

SEQ ID NO: 1923 - DNA, 569 bp, Triticum aestivum
ggattacctggacagagcggctgtactgactgcactgcagagaaacatacaggaatccggcaacctagaatcatacatgaaactctgcaagcgcctatctgagacagatctgatcgcaccgtgcgtcctatatctgtatgtacggaaattcaagctgtggatgatgcgcatgctgtgagggtctcgacaaagccttgaatcatctgtgggtgcttcagacgtgttcatggcttcgattaggtgtagaatgtcccgactacggtgaaccaactgatgcacaatcatggttccttgtatatttttgaccggaaaggagctccccatgagcgttcacccccatcagagctgctgtcttattgtctgagcagactacatgaatgtaaattttcagtgtaccatccccagttgtgtggaatggagggcgctagctgctgtaggggagcatatacctcttacgaaacattacgtgtatatagttgaacaaaaagaaacttgtaaagttgtgatatacctcagttgtcttcgtaatcttgtacgtagcccttctctgtttttgttgaaaaaaaaaa

SEQ ID NO: 1924 - DNA, 715 bp, Triticum aestivum
  misc_feature (517)..(517): n is a, c, g, or t
  misc_feature (530)..(530): n is a, c, g, or t
cggcaccaggagaacaaaggccgacttgtcaacaaaaccaacatgcactttcttagtccaaaaaagcatgcagcgtgtgtctctgcattttattacttgtcgctcggtcaacagcacgccctgacacggcccagctacgacgaaacactcaccgcgcgacagccgtcgatctaccgatctggcggacaatcgtcgcggcaacaagattacaagagtggaaagcctccctgtcccagtcaaaccaactacacctggaaaaaaaccgggctggacctgccgagcgccgatgatgaccgacctagctggctggacgttacgagccgccggcgccgacgccgtcgtacttgagcccgaactcgcggaacctgatctccatgtccgccgccgcgacgagcagctcggccgcctgcgccggctcgaggatctccacggcgcgcttcatggtgcgcagccgcagcgcgtctgccccggccagcaccgcgccgacgcggccgacgagcccgcccacgtccaccgnctccccgccggcngcccaccgcgccgtggccctcctgcacccgcgccatctcccgcgacagctcgtcctcctgcgccacggtgcggcgctgcagctcgtcgatctgcgccagctgggccgggctgaggtcgcccaggttgcccgaccgcacgcccagcaggaggtccgggagctgcgcctcgaagcggctgccggact

SEQ ID NO: 1925 - DNA, 1105 bp, Lycopersicon esculentum
gcggcaggtcgaaaaccttcgttaaacatttcgattccttctgttaagaaaacagaggaaccaaaaacaggggaagtaaaaacaggggaaccaaaaacagaggagccaaaaacaggggaagtgaaaacagagtactctgttaaggagaaaatggtagaaaattcggagaaaaagcgatacagaggagtgagacaaaggccatgggggaaatttgcagcggagattcgtgacccaactagaaaggggacacgagtttggttaggaacattcgatactgcaatggatgcagccatggcatatgacagagcagcatttaggctcagagggagtaaagcaatcttgaattttccacttgaggtaagcaatttcaagcaagaaaatcatgagattgagaaaaatgttgtgaatttgaattcgaatacgaattcttgtgggaaaagggtgagaagggaaatggagaatgatgacggaattgtaatgaagaaagaggtgaaaagagaacaaatggtggcaactccattaacaccttcaaattggtcttcaatttgggattgtggaaatggaaaaggtatttttgaagtgccacctttgtcaccattatcaccacattcaaattttggttattctcaacttttggtatcatagtgaaatccccaaaagatccattgagtatgttatggaatattatatagcggaattatactgccatcacgatcccatgagatttagtcttttgttatgttgagagttttaaaatgttatggcagaatatattactgtcacaatccactgagatttagacctttattgtgtcgatccactgaaatttagtcgagagttttaaaatgaaatattttgaacaagtatgaagtgatttcaagttgtaataaggaatttactttggaaattttggataaaaatagcacatgtacaaatgaagaaacatggaatgatggagggagaatggaagtgttttgaatcatggatatttttaattattttttgatttcattgattaagcttttttttttccatgtaaatatgaattttaatttggttggtttattttgaaggaaaaggttcaaaaaaaaaaaaaaaaaaaaaa

SEQ ID NO: 1926 - DNA, 1072 bp, Lycopersicon esculentum
tagttagaaaaaatatccgaaaaaatgggaagaggaagagtccacttgaagcgaatagagaacaaaattaaccgtcaagttaccttctcgaaacgtcgatctggtttgctgaagaaagcccatgagatctctgtgctttgtgatgctgaggttggtttgattgttttttctactaaaggaaaactctttgaatatgccaacgattcctgcatggagaggatacttgaaagatatgaaagatactcatttgctgagaaacagcttgttcctactgatcatacctccccggtaagctggacccttgaacatgcaaaacttaaggccagacttgaggttctgcagaggaaccaaaagcattatgtgggagaagatttggagtccttaagtatgaaggaacttcagaatctggagcaccagcttgattcagctcttaaacacattcgatcaagaaagaatcaattgatgcatgagtccatttctgtgcttcaaaaaaaggacagagcattgcaggagcaaaacaaccagctttcgaagaaggtgaaggagagggagaaagaggtggcacagcaaaatcagtgggaaatcaactcatcttcatttgttttgccacaacaactggactctcctcaccttggggaagcataccagagtactaatgtaatagataatggggaagtggaaggaggtagttcttcacagcagcaaggtgcagctaataatactgtgatgccacaatggatgcttcgtcatcttaataattaaaaggtatcattaatacttcaatataattaactaggtatataattttgatgccacaatatattaattaaaaggtatcattaatacttcaatataattaactaggtatataattttgatgccacaatatattaattaaaaggtatcattaatacttcaatataattaactaggtatataattttgatgccacaatatattgtctatgtgtacttgctttcaaagacatgccacaatatagatggattgttgtaaaaacattataatatatgttaaaaataaattttgatgtatgaaaaaaaaaaaaaaaaaa

SEQ ID NO: 1927 - DNA, 708 bp, Lycopersicon esculentum
cttcaatgaggctcttaatggtatagctgatgagggctggtcaatgctggatagtgatggaatggatgatgttaccatccttgtgaactcttctcctgacaagttgatgggcttaaaccttccttttgcgaatggattttcacctatgagcaacgcggttatgtgtgcaaaagcatcaatgcttctacagaatgtgcctccggctattcttctcaggttcctacgtgaacatcgatctgaatgggcagacaacaatatagatgcttatgctgctgcagccattaaagttggtccctgcagcttacctggggctcgagttggtaacttcgggggtcaagtgatacttccactcgctcacactgttgagcatgaagagttgctggaggtcattaagttggaaggtcattctcctgaggacgcgataatgccacgagatatgtttctattgcaactatgcagtggaatggatgaaaatgctgttggaacttgtgccgaactcgtgtttgctcctattgatgcctcttttgctgatgatgcaccattgcttccgtctgggtttcgcattatttcactcgagtctggaaggaagcgtccagtccaaatcgtacccttgatcttacttctgctcttgagactggcccagcggaaaacaaagcagccaatgatcttcacactagtggtggctcatcaagatctgtcatgacaatt

SEQ ID NO: 1928 - DNA, 576 bp, Lycopersicon esculentum
cacaaggcaaattttcagaggtgctattccatgcaagaaatcattatgaatccagcaccaaacaacagttttcaaatggcattcgaaagagtgaggccatattcaaattcgcaaagtaagcaaagcataagatcccaatcaaaccacgttatcgaacatttacggacatagaacagtagtttataacagccaggtttcatgagctcaaatgattccgctgacaggccagggaaacaaggcaccaagtagacatacaccaaaacatctgcatccagctaggactttttaactcttcggcacaatttagagtatcagcttcgatagcctccagaactgcgacgatcatatggtccagaacgatcacggttaaaacgttcccctccttcacgaccaccaccatctgtgctgctgcggcttccatatcgatctccgttcctgtcaggtccacctccaccaccataccgaccacctttacccccttcactagggcattctctggcaaagtgtcctggcttgccacaattatagcaatctccaccaccaccaccagctcccggaccaccaccataatcacgg

SEQ ID NO: 1929 - DNA, 573 bp, Lycopersicon esculentum
gatttttttaaatcaatttctatgtgattaattccttcttcaatattaagtttttttttttttttttttttaattaaggggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcacgcaggagataataagaggcaataagaggcatactaaagacagagttcaacctgaaaaccaagctgggccacagtatctacagtatatgcagcatgaggcagcaaatttaatgaagaagatagagctccttgaaacagcgaaaaggaagttcttgggagaaggtctgcagtcctgtacccttcaagaagtacaacagatagaaaaacagttggaacggagtgttggcaccatccgggcacgaaagcttcaagttttcaaggaacaggttgagcgactaaaaaaaaaaaaaaaaa

SEQ ID NO: 1930 - DNA, 1567 bp, Lycopersicon esculentum
agttttttattaattaaaaaaaaaattatgggtgttcaagaaaaagatccacttttgcaattaagtttaccaccaggatttagattttatccaactgatgaagagcttttagttcaatatttatgtaagaaagttgctggacatgattttcctctacaaattattggtgaaattgatttatacaaatttgatccttgggttttacctagtaaggcgacatttggtgaaaaagaatggtatttcttcagtccgagggataggaagtatccgaatggatctagaccgaatcgagtagcaggttcgggttattggaaagcaacggggacggataaggtgataacttcgcaaggaagaaaagttggaattaagaaagctcttgtgttttatgtgggtaaagctccaaaaggatccaagacgaattggattatgcatgaatatagactttttgaatcttcaaggaaaaataatggaagttcaaagctagatgaatgggtgctttgtcgaatttataagaagaattcaagtggaccaaaacctctgatgtctggtttacacagcagtaatgaatacagccatggttcgtcgacttcgtcatcatcccaattcgatgatatgctcgaatcattaccagaaatggacgatcgattctccaatttaccgaggttgaactctctcaaggccgagaaattcaacctcgatcgtctggattcagccaatttcgattgggcaattctcgctgggctcaaaccaatgccggaattgggcccagcaaatcaagctccaggcgttcagggtcaggctcaggggcatgtcaataaccacattcacagcgacaacaacaatatgaattttctcaacgatgtttacgcccatcctccaaatttccgaggcaacacaaaggttgaaagtattaatctagacgaagaagttgaaagcgggaaaagaaatcaacggattgaccaatcgagttacttccaacagagtctcaatggattttcccaagcgtatacaaacaatgtggatcaattcgggatccaatgtccgaatcagacgttaaatctcgggttcaagcagtagaggatactggaaagtaagaaaagttgtagctcgaaatctgaatgccagtatactgtgtatatatacagaaggcctggatttagatttccttggcccaacggattcgaagaaagagcaagtacagtatcatgccaaggaaattaagtccttcgagggcacgtctgggcagacgtcgtggacgttatttgcaagttcttgcaattgtgtctgaagtcattaggctgagtggcacttcttatttgcaagttgtgtttgaagtcattaggccgaaggcacgtctgcgtggacgataaaataatgtacacaaacaggagatatatgcaggggcgtgtatattcttttaggaaactgggcttttagtttgttttattttatgatacatttccagatttggatgtattttgtaatttttacatttctgtgtagcaagttagaagatatatagaaagatacttttaaaatactttttataaaaaaaaaaaaaaaaaaa

SEQ ID NO: 1931 - DNA, 515 bp, Lycopersicon esculentum
cgaaaaaagggaatttactcacaaaagttcaactgcattaacaagtttacaaatcaagattcttagtctacatcacatatgtcctgatcctcagtacagcgatcaagattaactaatacaaatagcattgtaatacaaatgacagatggggattaagtctttactacataaagaacagtgtcttagaaacgagaccggattaattaggcgaaagcaaaagaacgccaagctcttgtgaagcagagccacacttggtttatcgaacaacgacagcagtcagtaatcaagtgatcctatagatggaagtccggacatgaaatctcgaccatcagcactattattactgctcatcctttcaggtggaccgcggtttagggatccaacctcctctttccccagtttctgcacatcctcgggtgaaagaattttgatgtaccaaacattattgacaaattcctcccacggatcgtctccaaggagaaggacatcattctccctggagagagagaactagt

SEQ ID NO: 1932 - DNA, 291 bp, Lycopersicon esculentum
ttttttttttttttttttgacttggatcaacaaattcagaagaaataggacattacaaccactgtcatcgaattaaacaacaaattcgaagtttcacagaatcaagatcctaaaatacagcaatacaaaggaaatgtttgacaagtatatgatctacctacaacttttcatacctataactttacagtttagactaaacagctagccatatgctcactgaattcttctttttcaactctagtcctagtcctttttttatgtacagaaaggaagaatcgaatctactaggcg

SEQ ID NO: 1933 - DNA, 672 bp, Lycopersicon esculentum
taaaagtgaacagggtgtgaagagctacagttctgtatgtgggggttgttagatcgtgtgattttttggaattaacggttgatatttctgggttttggaactgaagagaatttaattgggtaaaactgggtttcttctattttaggactcaacgagtactgattcagcagaaatgactataggggatcaaagcgagtcggactcgatacttccttgtaggaataggatgtcagttgatgttggagctccttctccaaggagtatccagatggatgagcaagttaatccaggagaagaatatgctcctaagataagaaaaccatacaccatttcaaagcaaagggagaggtggtctgaggaagagcacaaaaagttccttgaagcattaaagcttcatggtagggcatggcgacgaatagaagagcatgtgggaactaaaactgcagttcagattagaagccatgctcagaagttcttttcaaaggttgttcgtgaatcgagtaatggtgatgcaagctctgtgaaatccattgagatccctcctcctcggcctaaaagaaagccgatgcacccttatccaagaaaaatggcaactccacttaaaagtggaaccctggcttcagagaaattgaacagatctggttcacctgatctctgtctctctgagccaga

SEQ ID NO: 1934 - DNA, 1867 bp, Lycopersicon esculentum
gcacgaggtggagaactgtagttgggcatgcatgtttggtgagttggaagttcccgcagaagtaatagctgatggtgttcttcgctgccatactccggttcaaaaggctggaagagttccattctacataacatgctccaataggttggcatgtagtgaggtgagagaatttgaatttcgggtcactgaaggccaagatgttgatgttgcaaatccaaatagttgcagctccagtgaaagtcttcttcatatgagattcggaaaattattatctctggaatcctttgtttcccaaacttctccacctatcagtgaggacaatgtttcctatatatccagtaaaattaactcattgctaagagacgatgacaatgagtggaaggaaatgttgcaccttactaatgagaacaactttatggcagagaaagtaaaagaccagctcctacaaaagcttctaaaagagaagttgcatgtttggctccttcaaaaggttgctgagggtgggaaaggccctaacatactggatgaaggtggtcaaggagttctacattttgcagctgctcttggttatgactgggctgtaccacctactatagctgcaggcgtaagcgtcaatttccgagatgtgaatggatggactgcactccattgggcagcatcatatggaagagagcggacagtgggtttccttatctccttaggtgcagctactggagcattgacagatcctactcctaaacatccttcaggcagaacacctgctgatctagcttccagcaatggacataaaggaattgctggttacttagcagagtcttccttgagctcccaccttttttctcttgagttgaaggaaaagaagcagggtgagaatgaacaagcttttggggaagctgttcaaacggtttctgaaaggactgctacaccagcttgggatggtgactggtcacatggagtctcattgaaggattctcttgcagctgttcgtaatgctactcaagcagctgctcgtattcatcaggtcttcaggttgcagtcattccagaggaagcagctaaaagaatacggtggcagtgaatttggactatcagatgagcgtgctctctcacttctcgccatgaagacaaatagggctggacagtatgatgagcctcacgctgctgctgtccgtatacaaaataaacttcgcagttggaagggaagaagagattttcttctaatccgccaacgaattattaaaattcaggctcatgtgagaggacaccaggtaaggaacaaatacaaaaacataatatggtctgtggggatcttagagaaggtaattttgcgatggaggcggaaaggaagtggattgcgtggatttaaaccagaagcacctactgaaggaagcaacatgcaagatcaaccagtgcaggaggatgactatgatttcttaaaagaaggcagaaagcaaactgaagaaaggttgcagaaggctctggaaagggtaaagtcgatggttcaatacccggaggctagggaccagtataggaggctgctgaatgttgtgtccgacatgcaagaacccaatagtactgcagccagctacaactcagcggaagcagttgatttcaatgatgatttgatcgatcttggtgatttattggatgatgatacttttatgcctacagcaccttgagttctgtgttaataatataccatttgtggattagtatttgttatacatggctgttagagttgttgtatacataggctgcactaactagtttgtaaatgtgaaaatcaaaaatccattgtgcagattgacaagaatttgagatttaaaggtagtaagattatggtatgtttgatgttttcttttcgttgt

SEQ ID NO: 1935 - DNA, 282 bp, Lycopersicon esculentum
tttttttttttttttttttaaaagtttaacttgatttatgtatacaagcaagaatccccagaaactttaaggtcatcataactcaggttataaacagaaggaacagcacaatacaggaaaaaaaaccaagagaaggtacctacaactgagctatatcatctcagcaagcattaatcatggatcactatttgtgacataataaaactacaagttcctgtatagaattctaatcattttcacaagaacattgttcatccaaatcagcaagtagcacaagaaact

SEQ ID NO: 1936 - DNA, 288 bp, Lycopersicon esculentum
ttttttttttttttttttagacataatactatagtttctattagatattagaccaaaccaaaagtaaaaatctacttattaactctatggatactacaacaagataaacataaaatgttttcttctcttcttcttttgggaagcaaactgattgtaaaacagacatctatacataatatagcaaactatttagattattgaagaagagtaggtgctaataagatggaaacactttagtattacactttgaaagtcctccatttgtgaagctgaaaattcttgggcttc

SEQ ID NO: 1937 - DNA, 722 bp, Lycopersicon esculentum
  misc_feature (697)..(698): n is a, c, g, or t
ggcttatgatacggcggtctattatctaatatgcccttcggcccgattgaattttcccgagttgttagttggtgatggtgggcttaatgatttgtctgctgcttcgattcgtaaaaaagccatagaagttggtgctcaagtagatgctgtacagaactcgcttgcaacccatcataaccatacagaggaaaaggtgcactctgagacggcaagcccctcagaattgaagccttgttggtttcaagagaagcccgatttaaacttgaagcccgagcccgaagatccagaagtggattactggtaatatttagttaatatcgatattaccaataacagtatctctactagtgtaatttttaattatttttttggctttttgttggttgggggaagaggaagtgctttggtaagaatacaagcgccgctccaggttgtgtagcttggtagcctaggattgttatattcttaaaaagaaaaaactatcacctctttctttaattttactttatttttaagaacaaattatcagctgaacagttttggtgttgtaagatgtaaaggggatttgtgttatcattttgtctaatcgcaattctggttgtacttttgcttggttggggtcttttagtggtgggggaaacaaatgttagtgtgaatgatggattatgcatattggtcatcttgaagactaaccaanngtttattatttggggaaaaatgat

SEQ ID NO: 1938 - DNA, 634 bp, Lycopersicon esculentum
aaaaactaacaaaacaagtgaatatatttaatttttttcagtatgatggaaggagagaagagaaaacagaggcaacaccagcaagataagccatacagaggaatacggatgaggaagtggggtaaatgggtagctgaaattcgagaaccaaacaaacgctctcgaatttggcttggttcttattcttcccctgttgctgctgctcgtgcttacgataccgctgtattttacttgcgaggtccttcagctaggcttaatttccctgaatgtatagtggatgaccatgaaattcacgatctatcagctgcttctattagaaagaaagctactgaggtaggtgctcgagttgatgctctgcaaactgcgattcacaattctactgttaattctgttgaatcaaactgtaattcgaattctaaatctacaaggatgatgatgaagcctgatttgaatgaatatcctagcccggaaagttgcgacgaagataactgaatctctgcgagttaacagaggccaagagggggattatttttatgttgattagatatactgaggatccatgtatgaaatataatccgaagggattatatgttaatattatcaattatgatagttattaaaggaaatttaatct

SEQ ID NO: 1939 - DNA, 468 bp, Lycopersicon esculentum
gtgaattctctataccatgtgttgctagataatggctagttcgctgtttaatgttctttttgtttggaaattgttctcacgatttcataagttgagtcgttcatttcaaaaaaaaagaacattaaacagcgatcttcattcacttccagcttttgccttttcatgggtattctttctctctctcccagtttagctctagattacagggaaacaaaatttttgtaattcagtccctgtaatttcacataataattattatacagtcaaagatggagataggtggtgggggtcaaagtggagttgctgcaaattcaggggtttgttgtggtgggaagagaaagaacgaaaagccctataaagggattcgtatgaggaagtggggaaaatgggttgcagaaattagagaacccaacaagcgttcgaggatttggttgggttcgtattcaacgccggtggctgcggctcggt

SEQ ID NO: 1940 - DNA, 1397 bp, Lycopersicon esculentum
ggttcaattaccaacaatatttttcaagaaaaaaaatggattcttcttcactagaaatgataagacaacatcttcttgatgatgttgttttcatggaaacttgttcttcttcttcttcttcttcattagaaacaacaagtagtacactttattctcaaacctcatcgaattcggaatctttagaatcattaacctctgagatcaaacttgaaagcaatttctctgtttatcctgatttcatcaatacacctcaaagttcaaatcttgaatctgtctctcgttttttcgataactcaactattgaattccaagctaaaccccaaaagaaaagaagtttcaatgatcgaaaaccttcgttaaacatttcgattccttctgttaagaaaacagaggaaccaaaaacaggggaagtaaaaacaggggaaccaaaaacagaggagccaaaaacaggggaagtgaaaacagagtactctgttaaggagaaaatggtagaaaattcggagaaaaagcgatacagaggagtgagacaaaggccatgggggaaatttgcagcggagattcgtgacccaactagaaaggggacacgagtttggttaggaacattcgatactgcaatggatgcagccatggcatatgacagagcagcatttaggctcagagggagtaaagcaatcttgaattttccacttgaggtaagcaatttcaagcaagaaaatcatgagattgagaaaaatgttgtgaatttgaattcgaatacgaattcttgtgggaaaagggtgagaggggaaatggagaatgatgacggaattgtaatgaagaaagaggtgaaaagagaacaaatggtggcaactccattaacaccttcaaattggtcttcaatttgggattgtggaaatggaaaaggtatttttgaagtgccacctttgtcaccattatcaccacattcaaattttggttattctcaacttttggtatcatagtgaaatccccaaaagaatccacttgagtatgttatggaatattatatagcggaactatactgccatcacgatccactgagatttagtcttttgttatgttgagagtttctaaaatgttatggcagaactatattactgtcacaatccactgagatttagacctttattgtgtcgatccactgaaatttagtcgagagtttctaaaatgaaatattttgaacaagtatgaagtgatttcaagttgtaataaggaatttacctcttggaaattttggataaaaatagcacatgtacaaatgaagaaacatggaatgatggagggagaatggaagtgttttgaatcatggatatttttaattattttttgatttcattgattaagctttttttttttccatgtgaatatgaattttaatt

SEQ ID NO: 1941 - DNA, 878 bp, Lycopersicon esculentum
gcacacaaacaccttcactagaaaaaattcagattcacagagacataaacacaaacaccttcactgcaattctcaaaatactgcaaaatgacgaaacaagatgaaggattaacattagaactcatacgacaacatctcctcgaagatttcacaactacagaatcattcatcgacagtctcaattcttgtttttccgatcacatctcctcctccgatgacatctcccctgttttcacttcagtaaaaacagagccatctacatccaattccctctcagattcacccaattcctcatacccaaatgaacccaactccccaatttcccgttacttcaatctccgctccgatttccctgaattcaaaatcgattcagataccatcctcagtccagttttcgacagctccgccggttctaatgaagacaataataagaagaagaattacagaggggtaaggagaaggccatgggggaaatttgcggcggagataagagatccaagtcgaaaaggatcgaggatttggttgggtacttttgatactgatattgatgctgctagagcttatgattgtgcagcgtttaagatgagaggaagaaaagctattctgaattttccgttggatgccggaaaatctggtgctccggcgaatgttggccggaaaaggagaagagagaacaagatggagttggtgtagatgactaatttgtaatttgtgttaaagcatgttaattacttaatcctcttctacatcataattaatagagctttcccccccacatatttattaaagaatatcattccataatgtaaattttgattaacaaatttgaattcctaaaaatgataatatgttattatactaaaaaaaaaaaaaaaaaa

SEQ ID NO: 1942 - DNA, 559 bp, Lycopersicon esculentum
tttaaagaaaaaaatgggttctccacaagagacttgtacttcacttgatttgattaggcaacatctttttgatgaatctctggaccagacttgtttctcttttgaaacaactcaaacttcaaatcttgatgacatcgcaagcttctttaatgctacttcaaaaacagagtatgatggttttttcgaatttgaggcaaaacgacatgttatccattcaaattctccgaaacagagtaacttgagagaacggaagccatctctgaacgtagcaataccggcgaagcctgttgttgttgtagagaacgttgagattgagaagaagcattacaggggagttagacagaggccatgggggaagtttgcagcggagattcgtgacccaaatagaaaggggactcgagtttggttaggaacatttgatactgctgtggatgcggcaaaggcatatgacagggcagcgtttaagcttagaggaagcaaagcaatattgaatttcccactcgaagttgcaaactttaagcaacaaaatgatgagactaaaacagagatgaagtcgtca

SEQ ID NO: 1943 - DNA, 903 bp, Lycopersicon esculentum
aaaaatggggagagggagagtggaactaaagagaatagagaacaaaatcaaccgtcaagtgacattttctaagaggaggaatggtttgttgaagaaagcttatgaattatcagtgctttgtgaggctgaagttgctctcatcatcttctctagtcgtggaaagctctatgagtttggtagtgcaggtatcactaaaacccttgagaggtaccaacgttgttgccttaatcctcaagacaattgtggtgaaagagaaacacaggccaagtttgaagcacttcaacgaactcaaaggcacttgcttggtgaagatcttggagcactaagtgtgaaggagttgcaaaatcttgaaaaacaacttgaaggtgcacttgcacaagctagacaaagaaagacacaaataatgatggaacagatggaggagcttcgtagaaaggagcgtcatcttggtgatgtgaacaagcagttgaagattaaggtttctcttgaactatcatcgtttgagggtgaaggacaaggtgttccttttccatggagtaattgtaatgcatctttagatgaagcaggaagcagcacctttcatgtccaccattctcaatcaaatcacatggactgtgatttacctgatccagttcttcaaatagggtatcatcagtatatggctgcagatggagcctcagggtcaaggaacatggctgttgagagtaacattatccatggttggggtctttaatttctaattctaattatggattatactagtacaagttttttgcttttaagtttttcagattaaaaaactcaagtgacatataattatgatttgaaatgcatgttatatagtaatgtataattttagcaagtgtcatatacactcctgtttttaaaaaaaaaaaaaaaaaa

SEQ ID NO: 1944 - DNA, 499 bp, Lycopersicon esculentum
caaaatcaaccgtcaagtgacattttctaagaggaggaatggtttgttgaagaaagcttatgaattatcagtgctttgagaggctgaagttgctctcatcatcttctctagtcgtggaaagctctatgagtttggtagtgcaggtatcactaaaacccttgagaggtaccaacgttgttgccttaatcctcaagacaattgtggtgaaagagaaacacagagctggtaccaagaggtctctaaattaaaggccaagtttgaagcacttcaacgaactcaaaggcacttgcttggtgaagatcttggagcactaagtgtgaaggagttgcaaaatcttgaaaaacaacttgaaggtgcacttgcacaagctagacaaagaaagacacaaataatgatggaacagatggaggagcttcgtagaaaggagcgtcatcttggtgatgtgaacaagcagttgaagattaaggtttctcttgaactatcatcgtttgagggtgaa

SEQ ID NO: 1945 - DNA, 566 bp, Lycopersicon esculentum
gagagagagagtatagagttctatattttcttgatgaataagattgccctgtagaagcaatattaatcatcttagtgcaaagataaaagacacatggaagttgttatagtttttctggtaagaccttctgatttagttctctgatttcatccatcagaatctgctcctgcaagaaagtaacacatttaggatccttataataaaaaaaggagtaatacgtttgggagaaatcgtagacttgattttagcataagtttcatgaacacagaagaatttaggattttaccttttgctttcgtactcctttcaaactcatttcaatttggttttccagatttgttagatctttggtgctgagtccagaaagttcttcacccaaaagctgcctgtggttcataaaaaaaagaaacacatggaagaagacattgcaatttcccaatttcaaatcttgggtgtcatttccttaataattcttggatttgaattaatcgctctcatatccatgtcaaggagatatataccaactggaagtttcgaggaattgacaaatttggcatatacaaact

SEQ ID NO: 1946 - DNA, 391 bp, Lycopersicon esculentum
cagactgaacccaaaacgacgattgcgaagtcttcttttgtcttctccatcaacagcaacttttttgcccctctctctctcgatcgaaaaattcctccattgatttgttcttctgcttcttctcgtgaatgaaatttctctgagagaggaagtagagagagagagagagagtgagtgtgtgtgtgtgagagagatcggcgatggggagaggtaagatagtgataaggaggatcgataattcgacgagcaggcaagtgacgttctcgaagaggaaaaatggattgttgaagaaggcgaaggagctagcgattctgtgcgatgcggaggccggagttattatcttctccagtactggaaaactctatgaatattcaaacaccagcatgaagtc

SEQ ID NO: 1947 - DNA, 818 bp, Lycopersicon esculentum
  misc_feature (771)..(771): n is a, c, g, or t
attaaaacctctttctcctacctggggagatccttccacttcccaataacgatacagttttttaatttatcatttgccaaaaacaaagaattactaaacataaatatccatttccattacacaatatacatatatatacacacacaaagaagaaagaagaaagaagaaattaatatgggtagaggaagagtacaattgaagagaattgagaacaaaattaatcgtcaagttactttttcaaagaggcgatctggtttgcttaaaaaagctcatgagatctctgtgctttgcgatgctgaagttggactcattgttttctcaactaaaggaaaactctttgagtattctactgactcttgcatggaaaggattcttgaaaggtatgaaaggtactcatatgctgaaaggcagcttaatgctactgatattataaccccgggtagctggactttggaacatgctaagcttaaggccagacttgaggttttgcaaagaaaccaaaagcattatgcaggagaagagttggacacattgagtatgaaagagcttcagaatctggaacaccagctcgattctgctcttaagcacattcgatctagaaagaaccaattgatgcatgaatccatttctgagcttcaaaagaaggacaaggcattgcaagaacaaaacaacaatctttcaaagcaggttaaggaaagggagaaagagatggcccaacagactccgtgggagcaacagagtcatgatcatctcaattcatcttcgtttggntttgcacacccctttaacatcttcacataggggaagcatacccaaat

SEQ ID NO: 1948 - DNA, 1494 bp, Lycopersicon esculentum
ccacacccttctttttttttcttccgtctgtctccatttgatatgatatatatattacaacaacaattattcatagtatagaaaaaatatccgaaaaaatgggaagaggaagagtccagttgaagcgaatagagaacaaaattaaccgtcaagttaccttctcgaaacgtcgatctggtttgctgaagaaagcccatgagatctctgtgctttgtgatgctgaggttggtttgattgttttttctactaaaggaaaactctttgaatatgccaacgattcctgcatggagaggatacttgaaagatatgaaagatactcatttgctgagaaacagcttgttcctactgatcatacctccccggtaagctggacccttgaacatgcaaaacttaaggccagacttgaggttctgcagaggaaccaaaagcattatgtgggagaagatttggagtccttaagtatgaaggaacttcagaatctggagcaccagcttgattcagctcttaaacacattcgatcaagaaagaatcaattgatgcatgagtccatttctgtgcttcaaaaaaaggacagagcattgcaggagcaaaacaaccagctttcgaagaaggtgaaggagagggagaaagaggtggcacagcaaaatcagtgggaaatcaactcatcttcatttgttttgccacaacaactggactctcctcaccttggggaagcataccagagtactaatgtaatagataatggggaagtggaaggaggtagttcttcacagcagcaaggtgcagctaataatactgtgatgccacaatggatgcttcgtcatcttaataattaaaaggtatcattaatacttcaatataattaactaggtatataattttgatgccacaatatattaattaaaaggtatcattaatacttcaatataattaactaggtatataattttgatgccacaatatattgtctatgtgtacttgctttcaaagacatgccacaatatagatggattgttgtaaaaacattataatatatgttaaaaataaattttgatgtatgattccataatatcacgtaaaggattttgtagtaattatatagtaataacttttatattatatttaacgataacaataaatatgaatatttataattaacactttacataagtgttaaaggatttagtaattttgaatgtaatattattaactcatgttgtgagtatgttgtttttatgatagttaggagatatgataatatatataacttgatgaatgattgatgaataaattttttaatttattcgaaagatgcttttggttggttataggttgtcaattatttatccataaaactattgttctatagcataaaattaaatagatattacttaaaagatataaaacaaacggacaaaagacactgcattttctttgtcatcttttcttgattggtactaccaaaaaaaaaaaaaaaaaactcgagactagttc

SEQ ID NO: 1949 - DNA, 650 bp, Lycopersicon esculentum
aatttatcatttgccaaaaacaaagaattactaaacataaatatccatttccattacacaatatacatatatatacacacacaaagaagaaagaagaaagaagaaattaatatgggtagaggaagagtacaattgaagagaattgagaacaaaattaatcgtcaagttactttttcaaagaggcgatctggtttgcttaaaaaagctcatgagatctctgtgctttgcgatgctgaagttggactcattgttttctcaactaaaggaaaactctttgagtattctactgactcttggtacgtatactatttattatatatgtatatatagttatttatttattttttcttgtttttttttttgtgtgatgaagtagattaaaataacctcaatattgcatgcaattacacaaaactaatttgttaagggtttaattttgatagaattaaaaacgtgtaccgagttttgtttctgaatttgatcttgtatagatctatttgaaaatggatacaacaaaattatttatttttgttaattaaaactaaacagatctattggaataataattcaagaaataattaattccatgcgcatcataattatgtaactgaaaaaaatggagaggtcatttcactaatgtaaaacaacta

SEQ ID NO: 1950 - DNA, 677 bp, Lycopersicon esculentum
aatttatcatttgccaaaaacaaagaattactaaacataaatatccatttccattacacaatatacatatatatacacacacaaagaagaaagaagaaagaagaaattaatatgggtagaggaagagtacaattgaagagaattgagaacaaaattaatcgtcaagttactttttcaaagaggcgatctggtttgcttaaaaaagctcatgagatctctgtgctttgcgatgctgaagttggactcattgttttctcaactaaaggaaaactctttgagtattctactgactcttgcatggaaaggattcttgaaaggtatgaaagggtagctggactttggaacatgctaagcttaaggccagacttgaggttttgcaaagaaaccaaaagcattatgcagggagaagagttggacacattgagtatgaaagagcttcagaatctggaacaccagctcgattctgctcttaagcacattcgatctagaaagaaccaattgatgcatgaatccatttctgagcttcaaaagaaggacaaggcattgcaagaacaaaacacacccaacaaaacagtgcttctgtgatgcctccatggatgcttcgccatctcaacggttaaattaaaacttaatgaagtataaacgccagcggacatattatgttatctattaatcac

SEQ ID NO: 1951 - DNA, 430 bp, Lycopersicon esculentum
gaaaaaagctcatgaaatttcagttttatgtgatgctgaagttgctttaattgttttctctcaaaagggaaaaatctttgagtattcttctgattcatgtatggaacaaattcttgaacgatatgaaagatactcatatgcagagagacgtttgcttgcaaataattctgaatcaccggtgcacgaaaactggagcttggaatatactaaactcaaggctaggattgatctccttcaaaggaaccacaagcattatatgggagaagatcttgattcaatgagcttgaaggacttgcaaaacttggaacaacagcttgattctgctcttaagctaattcgatcgagaaagaaccaactcatgcatgaatcaatctctgaactgcacaaacaggaaagagctatcctagaggagaataacatgctaaccaag

SEQ ID NO: 1952 - DNA, 587 bp, Lycopersicon esculentum
gtctctatctatgctaggtagcttatatgatttaatagttcgattaatttaaatacgcattaaagatagaggatgggaagaggtagggtagagttgaaacggatcgagaacaaaataagcagacaagtaacattctcaaagagacgatctggattattgaagaaagctaatgagatctcagtattatgtgatgctgatgttgcattgattgtgttttctaccaaaggcaaacttttcgagtattcctcaaatgactcaagtatggaaagtattcttgaaagatatgaaagatgctcatatgcagagagacagatgaatgctaatgattctgatcccaaggaaaattggagtgtggagtatccgaagctcatgtcaagaattgaacttttacaaagaaatataaggcattacatgggtcaggatctggaccctctcagtttgcgtgagctccagagtatagagcaacagattgatacttcattaaagagaattagaagcaggaagaatcaactgatgcacgagtccatttctgagctgcagaaaaaggagaaagcgctccaagaacaaaacaacttgattactaagaa

SEQ ID NO: 1953 - DNA, 801 bp, Lycopersicon esculentum
tcaaaacttatcaggaacttggaaataggtgagaattaagcatttttttccccacacaacagagttctgcacaagaaagattgtaaacttgttaacatagcctaaatacataatactgtataaaaccaaaccatattaaatttgtatttctatgcagctggtcagcaatagctgcaaaattgcctggaagaacagataacgaagttaagaacttcttccacacacacttaaagaagcatcttggactgaaaaatcatgatgttccattgaaaactaggaaaatccgcaaacaaaccaaagaagatgagaagaaaattagtactcgaggaagacttgtacttgaaacgagcaataacagcaatttattaacaacagatgtttgttcaccctgcagcagcattactacatgtgaagaaaaccaaatgatggatccttttgtgaatttctcacaaacttttgaagtttgttataacaacattacttcacttgttgtcgatcaacaagtccccggcatggaacacacatgtataaatattggtgttgcccaaccacattccattccccatggtcctgctgttaactccttcgatcaattcgatatgaattcattctggattgatgtacttggaaatatctgaacatcttactttctaaaacatgttacaagttagaacccatgtgcaggtcctagtttttatccactttttattctctcacaaagcaataatctgtattaggtcctagttttattccacttttttgtctttctcacaagcaataattctaatcttctgtcttaaa

SEQ ID NO: 1954 - DNA, 508 bp, Lycopersicon esculentum
ggtccttggactcctgaagaagatatcattttagtatcttatattcaagaacatggtcctggaaattggagatcagtccctactaatactgggttgatgagatgcagcaaaagttgtaggctaagatggacaaattacttgaggccaggaatcaaaagggggaatttcactccacatgaagaaggaatgattatccatcttcaagctttgttggatgggcagctatagcttcgtatctacctcaaaggacagataacgatatcaagaattactggaacacgcatctgaagaaaaaactcaagaaattccaaatagaattggattcacataatttgactcttcctcctcctaatttagacaattctaacactaataactatgatcatcatcatcatcaattcacaaagttattgaactctccaaattcttcatcttcatcatcattatatgcttctagtactgaaaatatttcaagacttctagaaggttggatgagatcttcccctaa

SEQ ID NO: 1955 - DNA, 950 bp, Lycopersicon esculentum
gtttgtatttttggtgttcgcccattgaagcatttaatatcagaagtcagaaccatcaatggcatctattcataaacaatggtactttcagtgagtttggactaatttactgaaactgtcaatgctagagccttcaccatgggctgatcccctgatttgaaaagaatgatagggttttagtaacttctttactatgaacttcatgtcttgctatattctggattagtagaatcaagaatgctttggtgcgttgttcaaaatttcaaacaactgtagaatgatctttggtagagatgtaattcttgtatcactcatcttatcagtataatcagagcacatgaaaaggcattaattcacttaaatccaggtgttaaaacaattgtctagagaatgaagaatgtaattgaacaagatgaagtatattattcagctgtgaaggggccctatcaactgaatgaagatatctgtccagcttcccctccaatgcagctttctgaatatactgctgcatttcagcatggttccaacctgcttactccaaaacaaaaacttgtttgtaatgacgctgcagatctggctcttctttctaactcatctgcaagctcttgctctagttcctctggtatatctgccaaggaaggttttgattctttatcattaacaccagaatttgattcagagtcttacagttcatctcctgatgagcaccaaaaatcggccttaggtggggtgaagacaaccttgcaagaagactatttggagatggagagcaaggaagaaaatggctatggtatcgaccatgaatctttggattgtacatcaaagcttagagaagacagggagtatgaaatggtgctgaacagtatcatggatcaggaacataaactcagtgttcccgaccaaaaaatccagttctcagaagaagagatacagggcttgaagtatgaact

SEQ ID NO: 1956 - DNA, 806 bp, Lycopersicon esculentum
ttctttccaacttctaacttcaaaaaatctttctttcaaagtagttctaaatttgatatacaatttgtaaaaatcttcaataatatgacatctatgaaaagaagcagagaagagaatatgcaaattgaagcagaggccatggctcactgcgccttaatgcttttgtctcgtttcaacaacaacacttgttcatcgtcatcatcagatcatcatcatcatattaatgattttgaatgcaagacttgcaataaacgcttcccatctttccaagccttaggcggtcaccgtgcaagtcataataaaaagccacgattaatgggagagtttcttgttgaaaccaacaaaaagaataataagatacataaatgttctatttgtggtgtggagttttctttaggtcaagcattgggagggcacatgcggcgtcatcgcgatgaaattaataaaacgataataccagtgttgaccaagtccaatagcagcaagaggattttttgtttggacttaaacttaacccctcgtgatgataatgttgctgatttcaagttatcgccaattgcatcccctgttctgagaatctttatttaaattcttttccttatacaattaggaaatatgctaccaatttattaattctttactgagatatccatgtcaacataaattgctatgatgaattcttttgttattcgaaattcactaatttaaatttgtgttccttactatatatataaaaaataatctaaacaacgttattctttttcaaaaaaaaaaaaaaaaaactcgagagtagttctctctctctc

SEQ ID NO: 1957 - DNA, 668 bp, Lycopersicon esculentum
attcaaactcagtatacgattatcgaaagcatcttatttgtatcaactcttcataatgataaaaattagagaagacaagggtgaagtggaagcacaagcaatggctaactgcttaatgcttttatcatccatagatcgagatcgtcgtaattcatttgaatgtaaaacctgcaaaagacgcttctcatctttccaagcgcttggtggccatcgaacgagtcataaatcaacgattgatatcggaaaatttcttcacggtaaaatatccaaaaaacgcaaggtacatgaatgtttaatttgtggaatggagttttctatgggtcaggctttaggtggacatatgaggcgtcaccgtgccccagtaaatgaaattgaacattcggccaaaaggataccagttttgaagaaatcgaatagcaacgagagaatattttgcgtggatcttaatttaactcctgatgagaatgatgactttcacttttggcctatgccacctgtacctccattcttatcctcttaggacttggctagaactataaatatcattcattttaattcttgtgggtagattcacaaattttgttatctatttaccttaattgatcggatttctttattgatgagtatatttattcacaataaattttattaaaaaaaaaaaaaaaaaa

SEQ ID NO: 1958 - DNA, 643 bp, Lycopersicon esculentum
cagttattcttcaacttctaacttcaattatttctttcaaagtacttctaaatttgatatctttgtaatatgacatctatgaaaagaagcagagatgagaatatgcaaattgaagtagaggccatggctaattgcgctttgatgcttttgtctcgttttaataacaacacttcatcatcatcagatcatcatcacattaatgattttgaatgcaagacttgcaataaacgcttcccatctttccaagccttaggcggtcatcgtgcaagtcataataaaaagccaagattaatgggagagtttcttgttgaaaccaacaaaaagaataagaagcataaatgttctatttagtggtgtggagttttctttaggtcaagcattgagagggcacatgaggcgtcatcgcgatgaaattaataaaacgataataccagtgttgaccaagtgcaatagcagcaagaggattttttgtttggatttaaacttaacccctcgtgatgataatgttgttgatttcaagttatcgccaattgcatctcctgtgctgagaatctttatttaattactccattatatattcttgtaagattaattagaagaagaagctggaatacttcagttgttaattcattcattagttcat

SEQ ID NO: 1959 - DNA, 817 bp, Lycopersicon esculentum
ttttttttttttttttttttttttttttttatttagaccatgcatgatcaagctctttaatttccaaaaataatctaaattagaacactacaaatattaatgaattctatctttaatttgctttgactaatacaatataatattacaaacttaatcccaattgaagatccaaatgtttacatgaacttttttgtttagtagatgaagaattatccaaaatagttgatggaggcttcatataattatttcctccatgtgtaagagtaaatgtacaattatttgaatcttgatgaaatggccaatttgttcctcccccttctgatgagacttgataatcataattagggttaaaactaatttgggattcttcataaacattaaattgaggatcatgaaattgataattaataatattgttgttgttgttgttgtaattttgattatgaaaaggctgaagatagcaacttaaacttgcttttcttgcttgaagttgtagtctttttttcctcattctttcctttttatgagcattttgatggcctcccaaagcttgagaatttgcaaattgtttcaaacaatattgacactcaaatttcttcattatttcttcatgatttgatgatattttttcttgattatgatgaatatttcctgatgatactgtggaagctgatgatgaatttacactttcttgatcttcttttgatgaattattttggactttttttggagatctttttggattatcaataagctcaaaaccaaatattttgagcttcttgttgttgttgttgttgttttctatacatgatttagc

SEQ ID NO: 1960 - DNA, 780 bp, Lycopersicon esculentum
  misc_feature (729)..(729): n is a, c, g, or t
gcttctttatcctttctctctcaatatactgtatcttcttttacacatggagaaaaccaaagataaagaaactcaagatttcatgaatgttgaatctttttctcaacttcctttcatgagaccaacgaaagaaaaagccgcgattaggctttttggtaaagaattactaggtactactattcgtcatgaagatcaatcaattgagattcatgatagtgttggagatactacagaaatcaacaataacaacagaaaatttgaatgccaatattgttgtaggaacttcccaacatcacaagccctaggaggacatcaaaacgcacataaaagagaacgtcaacatgctaagagagctcaatatgcaaaatatcagtacaacgcttattttaattcagcgttgtacaatactagtagtacaagtagtactactagtggtggtttgtatgtgaataataacggccatagccattattattcacaacaaattaatcgcgatataaatgaaaatcaccgttcattgtcagcgttatggagagtacctcatgttcatcatagtagtattagtagtagtagtaattcttactctcctaataatgtttctaattttgttaggccaatagtttataataatgttaatggagatttgaagaagattaacacaaagagtagctcaatttctttaaccagatttgggtatgaattgaaggaaggagtacatcaagatcatgntagttttagatctacacttgtaaagagtacaatccaagctatagtatcgac

SEQ ID NO: 1961 - DNA, 501 bp, Lycopersicon esculentum
gctcactttctccttcatttatttcacatttacacttgtagtcacacaaatatatatataaagaaaaaaaacatctatatggcggaactggaatatctcgcgggttctaatactaacagacgattaaaattatttggtttcaacgttatagaggatcaggaacaagaggttgagtctacaaaaacgtcatcgggatcaccggaatccggtgactttccggcgatcgatggccggaaatatgagtgtcaatattgttctagggaatttgcaaattctcaagctttaggtggacatcaaaatgctcacaaaaaagaaaggcaacaattgaaacgtgcccaaattcaagctagtagaaatgcttatatgaggaaccctattatttccgcgttcgctccgccatctcacctcctcactccgccgggtactgtagtgtacccggcagggtcaactccatcgtgggtttatgtaccacgcgctccaccatccttccacgtgtcacat

SEQ ID NO: 1962 - DNA, 1323 bp, Lycopersicon esculentum
gtgatggttggacaattatgggtagtgatggtgttgatgatgtaacaattgctgtaaactcatcaccaagtaaattccttgatgcacaatacaacaccttgtcaattctccctacttttggaggagtactgtgtgcacgggcatcaatgcttcttcaggatgtttgccctgctttgcttgtccgtttccttagggagcaccgttcggagtgggctgactatggagttgatgcttactcttctgcatctcttaaagccagtccttatgctgtcccttgtgccagacctggtgtcttccccagtagccaggtcattttaccgcttgctcagactgtggaacatgaggagtttcttgaggttgttcggctagagggtcatgctttctctccagatgacatagctttatcgcgggatatgtatttgttacagctatgcagtggagttgaagagaatgccacaggtgcctgtgcgcagcttgtttttgcacatattgatgaatcttttggtgatgatgctccattgcttccatctggtttctctgtcattccactggagcctaaatcagattctcctagtgctgctcggactttagatttagcttcaactcttgaagctagaactggtgggacacggccagctggtgaagttgaaggaagcagttacaaccatcgttcagtcttgacaattgcattccagtttgcctttgagaatcactatcgagaaaatgtagctgctatggctcgccaatatgtacgaaacattgtaggctctgttcagagagttgctatggctattgcaccctctcgactctgctctcagttgacacctaaatccttccctggttcaccagaagctgtcactttggcgagatggatttgcaggagctataagaatcatactggtggagaattgctacagatggattctcaagctgccggtgatgctgttctgaagcaactatggcatcatactgattcaataatgtgctgctccgtcaaaatgaatgattctgcatttttttcatttgcaaaccaagcaggacttgacatgcttgaaaccactctaatagctcttcaggatataatgcttgataagatcctagatgaagctggtcgaaaggtcctcctttcagagttccccaagattatgcagcagggctttgcttatctgccagcagggctatgtgtatcgagcatggggaggccagtgtcgtacgagcgagctgttgcatggaaggtccttaatgatgacaactccaatcactgcctagctttcatgttcacaaactggtcttttatttaagttcaaaacatatgatctgcgt

SEQ ID NO: 1963 - DNA, 739 bp, Lycopersicon esculentum
  misc_feature (676)..(676): n is a, c, g, or t
gatcagatgtccctgcagcaactcggaccttggatttagcttcgactctagaagctggaactggtgggagtgggacacgtccagctggtgaaattgaagcaggcaattacaaccatcgttcggtcttgacaatttctttccagtttacttttgagagtcactaccaggataatgtagctgcaatggctcgccaatatgtgcgaagtatagtaggctctgttcagagagttgcaatggccatagcaccctctcgactcagttctcagttgacacctaaatccttccctgtgtcacctgaagctgtcactttggcaaggtggatttcccggagctatagggtgaatacaggaggagacctgttccaggttgattctcaagctggtgatgctgttctgaaacaactgtggcaccatagtgatgcaataatgtgttgttctgtaaaaatgaatgcatctgctgtttttacctttgcaaaccaggctggtcttgacatgcttgaaaccactttgttagctcttcaggatataatgcttgataagattctagatgaagctggtcgtaaggttctcctatcggagttctccaagataatgcagcagggatttgcctatctgccagcaggaatatgtgtatctagcatgggtaggccaatatcatatgagcaagccatagcatnggaaggttctcaacgacgatgattccaatcactgtctagctttcatgttcataaactggtctt

SEQ ID NO: 1964 - DNA, 1141 bp, Lycopersicon esculentum
tgcacgagggctgtttcccgcaactgcagtggggtagcagcacgtgcctgcggcctcgtgagtctagagcccacgaaggttgctgagatactcaaagattgtccttcttggtatcgcgactgccgttgccttaatgtactaagtgtaatccctactggcaatggtgggacaatagagcttatttacttgcagacttatgctccaactacattggcaactgctcgtgacttttggacattgagatacactacaagtttggaggatggcagtcttgtgatatgtgaacgatctctgacgacagcaactggtggcccaacagggcctcctgctacaagttttgttagggccgaaatgctaccaagtggttacctcataaggccttgtgagggtgggggctcaatgattcacattgttgatcatattgatctagacgcttggagtgtccctgaagttttgaggccactttatgagtcttccaagatccttgctcagaagacgactatggctgccttgcgacacatacgacagattgcacaagaaaccagcggagagatccaatactcagggggtcgccaacctgctgttttgagggcactaagtcagagattatgcaggggatttaatgatgctgttaatggatttgttgatgatggttggactattacggatagtgatggtgtagaggatgtaacaattgctataaactcatcttcaagcaaattccttggttcacagtacaacaccttgtcaatactccctacatttggaggagttttgtgtgccagggcatcaatgcttcttcagaatgttccccctgctttgcttgtacgtttccttagggagcaccgttccgaatgggcagattatggggttgatgcttattcttctgcatctcttaaagccagtccatatgctgtcccttgtgccagaccaggtggtttcccaagtagccaggtcattttacccctagctcagactgtggagcacgaggagtttcttgaggtagtacgtctagagggtcctgctttctcaccagaggacattgctttatcgcgggatatgtacttgttacagttatgcagcggagttgatgagaatgctgcaggtgcctgtgctcagcttgtttttgcacctattgatg

SEQ ID NO: 1965 - DNA, 1509 bp, Lycopersicon esculentum
gcttcaatgaggctcttaatggtatagctgatgagggctggtcaatgctggatagtgatggaatggatgatgttaccatccttgtgaactcttctcctgacaagttgatgggcttaaaccttccttttgcgaatggattttcacctatgagcaacgcggttatgtgtgcaaaagcatcaatgcttctacagaatgtgcctccggctattcttctcaggttcctacgtgaacatcgatctgaatgggcagacaacaatatagatgcttatgctgctgcagccattaaagttggtccctgcagcttacctggggctcgagttggtaacttcgggggtcaagtgatacttccactcgctcacactgttgagcatgaagagttgctggaggtcattaagttggaaggtcattctcctgaggacgcgataatgccacgagatatgtttctattgcaactatgcagtggaatggatgaaaatgctgttggaacttgtgccgaactcgtgtttgctcctattgatgcctcttttgctgatgatgcaccattgcttccgtctgggtttcgcattatttcactcgagtctggaaaggaagcgtccagtccaaatcgtacccttgatcttacttctgctcttgagactggcccagcggaaaacaaagcagccaatgatcttcacactagtggtggctcatcaagatctgtcatgacaattgcttttcaatttgcttttgaaagccacatgcaagagagtgttgcttcaatggctcgacagtatgtccgaagcattatttcatctgttcaaagagttgcattagcactttcaccatctcatttgggttctcatggaggtcttcgtttgccattggggactcctgaagcacatacattagctcgttggatctgccaaagttacaggtgctttttgggcgtggagcttctcaaattgaatactgatcaaggaagtgaatcaatcctcaaaagcctatggcatcactcagatgctattatctgctgctccgctaaggctttgccagttttcacatttgcaaatcaggctggtcttgacatgctcgagacaaccttggttgcacttcaagatattaccttggagaaaatatttgatgatcatggaaagaagaacctctgcactgagttcccccagataatgcaacagggttttgcatgtctacaagggggaatttgcttgtcaagcatgagcagacctatatcttatgagagagcagtagcatggaaagttatgaatgaagaagatactgctcattgcatctgtttcatgtttgtcaactggtcatttgtctaagttactgttctttagatctgttttaaagggatcagtacactaatacctaagaacccttaaatattttcctttcaaaatcaacattttgaactagttgtgtgtgttgaaaacttgtttattgttaaaacttatgctactcagtacctttatgctatgtattttttaaaaaaaaaaaaaaaaaaaaaaaaaa

SEQ ID NO: 1966 - DNA, 934 bp, Lycopersicon esculentum
tactggttcggtttctgcgggagcaccgttcagagtcggcagactttaatgttgatgcttttgtagctcctgcattgaagtcttgtcccgcatacatatcctgagatgaggcctaccagatttcccggtagccatataataatgccacttggccacacaattgagcatgaagaaatgcttgaagttattagacttgaagggcactctattggacaggaagatgcttttatgccaagagatattcaccttttacagatgtgtagtggcactgatgagaatgcagttggagcctgttctgaactagtttttgcccctattgatgagatgtttccagatgatgcacctttgcttccctccggatttcgcattattcctctcgaatcaaaatcaggtgatgcccaggatacgttgaacgcacatagaacattagatctagcatcaagtcttgaagtgggcccagcaacaaactcgactactggagatgcagcttcttgttacagtgcacgatctgtactgacaatcgctttccaatttccatttgaggacaatcttcaggacaatgtggctaccatggcccgacagtatgttcgcagtgtggtttcgtctgtccaacgagttgccatggcaatatctcctacgggaatgaatcctacactgggggccaagctttctccaggctcaccagaagctgtaacattgtcgcattggatctgccagagctatagttatcacatgggaacagagttacttcgagctgattctagtggcgatgaatcagtactaaagaatctctggcaacaccaggatgcaattttgtgctgctcattgaagtcgctgccagttttcatttttgctaataaggccggactcgacatgctggagacaacattagttgcattacaggacatttctctagataagatatttgatgaat

SEQ ID NO: 1967 - DNA, 723 bp, Lycopersicon esculentum
atccttgttctgttgtaacctttaaaatgcactctttactaaactaggtgattgtggaggtggtacatatgtttacatgttgctggaggtcattaagttggaaggagtttgccattccccagaagacgttataatgccaagagatatgtttctattgcaattgtgcagtggaatggatgaaaatgctgttggtacctgtgctgaactcgtttttgctccaatagatgcctcatttgccgatgatacaccactccttccttctgggtttcgcattattcctttagactctgctaaggaagcctccagtccaaatcgcacccttgatcttacttctgctcttgaaactgggccagtaggaagtaaggtggctaatgatctcaagtcaactggtggcacatcaaaatctattatgacaattgctttccagtttgcatttgaaagccacatgcaagagaatgttgcatcaatggctagaaaatatgtacgaagcttcatttcatctgttcaaagggtcgcattagcactttctccatctaacttcggttccctgggaggccttcgtctgccgctggggactcctgaagcacatacactggctcggtggatctgccaaagttacaggcgatttctgggtgtggagcttccaaaattgagtagtgaaggaagtgagtctctcctggatagcctatggcatcactcagatgctattatctgctgctctgc

SEQ ID NO: 1968 - DNA, 503 bp, Lycopersicon esculentum
tagaaacttcatgctttttagacacagactttttctgcctttcatctttttgaaatttatagaatatttatggtgcattgaaaagtttattagcatctgaaggtgcaattttttgttttagaagtccccgtcatttgaatactgtcatggatatgtggattaatttcttaccttattcttacagtttagtattgctactacttataatgcagggttctcctagtgctgttcagatttgagatttagcttttaactcttgaaactagaactggtgtgacatggccacctggtgaagttgaaggatgtagttacaaccatcattcagtcttgacaattgcattccagtttgttttttagaataactatcgagaaaatatcactgctacggctcgcaaatatgtatgaagcattgtcggctcggttcagagagttgctatggctattgcaccctctcaactctgctcgcagttgacaccaaaatctttccctggctcaccttaaac

SEQ ID NO: 1969 - DNA, 959 bp, Lycopersicon esculentum
gcttgattcaccacatttctctcaagcatcagcaggcctccttcaatggctacgtacgtcggattttcaatctgaagcatcaacaatttctcattctttcagtttgctctttcttgtacttcgaacttccaactgggtgcatacaggaggagacctgttccaggttgattctcaagctagtgatgctgttctgaaagaactgtggcaccatagtgacgcaataatatgttgctctgtaaaaatgaatggacaaacaccaagtgaagagaaagaaggagaagctctttgtacagatggtagcgagatatcaaatattgagactgaaatgaagtgaagaataaaacgtctctacaagaattgattggtgtagtatcctcttgcctatctgaaggtaaagaggtagttaaatagtgttcatgctattttctcattacttgaataggtagtcgtgcataaattacttgaacatgtagtcttgcataacaagtcgtcaggtagtccacaaaaacaggtgcttgcatatcccgcagtagcagatttttcactaattgttgttggaattcttcccttgaaaatattttggaggaaatccctttgataggcagaccatttcaagtgggccaaccgatgaacgtaaggtcgctgatccaaatatacaagatttggtttgaatgggaggttatggaaagaatggtcataaagaaaacggtaagaaactcatgtttagtgaaaaaggcaaagatacgaaaaaaagagtagcagaggtgaagcaaagcatagttgctggtatgcagattgatggtatttcacggaagagtatgaaatatttttttgaagaaagaattgttgaatctgctgttggggtaatctccatttctgccttgccatcatggctccctccgccaacacctgctgttggggcaatcttgagctcaaacctataccaagcaagttttaga

SEQ ID NO: 1970 - DNA, 538 bp, Lycopersicon esculentum
cactcagatgctattatctgctgctctgctaaggctttgccagttttcacatttgcaaaccagggtggtcttgacatgcttgagacaaccttggtcgcgcttcaagatatatctttggagaaaatatttgacgaacacggaaggaaaaatctctgctctgagttcccacagataatgcaacagggttttgcatgtctacaaggcggaatctgtttatcgagcatgggtaggcctgtttcttatgagaaagctgtggcttggaaggttctgaatgaagaagatactgctcattgtattggttttatgtttgtgaattggtcgtttgtttaaatttgttatcagtaaacttaagctacatacatatctacaaaccattttgaactagtttggctttttgtgcttttgttgctactcaatgtgacatgaaatcttttggaatgtgattacaagatgatgtctggtgtctgcatttgatcccacaaatttggatttgtgctaagtaagacttcattcggtggtaaaaaaaaaaaaaaaaaaa

SEQ ID NO: 1971 - DNA, 687 bp, Lycopersicon esculentum
gatcaaacgtgtcatttattccagctcagaatcttgaaattcatgaaaaaaagttaaagtttttttttttttttgcttaagattccaaaaatttgagagttttgaagcaaaaatcaaagggctattggtagaaagttaaaagttctttttaatgatgatggagtttggaggtttgtgtgaatggaaatggtgtagtaaagtatcaaacacgagtaatttacagctgaagtgattttttttttttttgattttgttgtccttttctgccatatctttcgttgagcagttttggctgtaccttaatttgtaagtttagcgtgaagtgtatgtttgagccttgtgtagaaaccaaaagggggagaacctaggaatcttctagttcaatcaagatcgtccatttcatcttgtctgagatccctagaaaaaaaaagaacaaaagaaaaagataaagcctttgtttcagagaatcttagttctctgtatagatatatatacatatatatgtaaagctgctaaggaagtagtttcagggaatatatctacttgggggtgttttgaaaatcttgatttttttttctggggtttggatttgagggaaaatggctatggtggctcaacagcatagggagagtagtagtggtagtattactaaacatcttgatagtagtggaaagtatgttcgatata

SEQ ID NO: 1972 - DNA, 543 bp, Lycopersicon esculentum
gctaggaaggcaacctgctgttcttcgaacatttagccagagattatgcagagggttcaatgatgccatcaatggattcggtgacgatggctggtcaatgttaagttcagatggtgctgaagatgtcatagttgctgtcaattcaaggaagaacctcgcaaccacctccattcctctttccccgcttggtggcgtcctttgtgccaaagcatcaatgctactccagaatgtcccccctgccgtactggttcggtttctgagggagcaccgttcaaagtgggcagactttaatgttgatgcttttgtagcttctgcattgaagtcttgtccgtatacatatcctgggatgaggcctaccagatttaccggtagccaaataataatgccacttggccacacaattgagcatgaagatgcttttatgccaagagatattcaccttttacagatgtgtagtggcactgatgagaatgcagttggagcctgttctgaactagtttttgcccctattgatgagatgttgacagatgatgcacctttgct

SEQ ID NO: 1973 - DNA, 163 bp, Lycopersicon esculentum
tgagatgtttccagatgatgcacctttgcttccctgcggatttcgcattattcctctcgaatcaaaatcaggtgatgcccaggatacgttgaacgcacattgaacattagatctagcatcaagtcttgaagtgggcccggcaacaaactctactactggagat

SEQ ID NO: 1974 - DNA, 513 bp, Lycopersicon esculentum
tgcacagtagagtttggagaagttgcctcaggagaggaaaagagggggttactaaccacacatttgacagctcaaaaccactttaccaatccaaacaaaaaatcatcacattatccctcccttctctcctttctctattactctcattttccccaagtttcagacttgggaaggctgtgtaaacaaaaggggtgtttggattgtaaggaatcataatgtcaatgtcctgcaaggatggtaaatcaattgaagataacggaaagtatgtccgttatacacctgagcaggttgaagctcttgaaaggctatatcatgagtgtccaaagcccagttcaatgcgtcgccagcagcttattcgtgaatgcccgattctatctcatatagagcctaggcaaatcaaagtttggtttcagaatagaagatgtagggaaaaacagaggaaagagtcatcaaggcttcagggtgtgaataggaagctgtcagcaatgaacaagctattaatggaagagaatg

SEQ ID NO: 1975 - DNA, 588 bp, Lycopersicon esculentum
gcttgtggcctggttggtttagatccaacgagggttgctgagatccttaaggatcgcccttcctggtatcgtgactgtcgggctgttgaagttctaaacatgctgcccactgccaatggtggaaccattgaacttctttacatgcagctttatgctccaacaactttggcgcctcctcgtgacttctggctgatacgctatactactgttacggatgatggtagctttgtggtttgtgagaggtcattaggaaatactcaaaatggtccaagtatgccgcaagttcagaattttgtgagagcagaaatgctgcctagcggatacctgattcggccttgtgagggaggcggctctattgtccatattgtagatcatatgaatttagaggcatggagtgtgccagaagtgttgcgtccactgtatgagtcatctgcagtgcttgctcagaagacaacaatggcagcactacgccaactgaggcagttaaccttggaagtttcacagcctaatgtcactaactggggcaggagaccagcagctctacgggcattaagcaagaggttgaacagagggttcaatgaggctctc

SEQ ID NO: 1976 - DNA, 768 bp, Lycopersicon esculentum
ggttgctcaggagtagcctcgcgtgcttgtggccttgtgggtctagagcctacaagagttgctgaaattcttaaagatcggccatcatggtttcgtgactgccgagcagtggatgttctcaatgtgatgtccactggaaacggtggaaccattgaattgctatacatgcagctctatgcacctactacactggcaccagctcgtgacttttggttaatgcggtatacatctgttatggaagatggtagccttgtgatatgtgaaagatccctgaacaacactcagaatggtcctagtatgccaccggtgcagagttttgtgagagcagatatactgccgagtggatatctgatacgaccctgtgaaggaggtggttcaatcattcacatagttgaccatatggatttagagccatggagtgtgcctgaagtgttgcgtccactgtatgagtcatcaacattgttgtcgcagaggacaactatggcggcattacgtcacttgagacaaatttctcaagaaatttcacatcctactgtctctggctggggaagaagacctgctgcgttgcgcgcacttggtcaaagattgagcaagggttttaacgaggccgttaacggttttactgatgagggatggtctatgcttgaaagtgatggcgtagatgatgttactatttcttgtgaactcatcacccagcaaattggatgggtgcaaacatctcttatgccaatggatttccatcgatgagcagcgctgtggctttgtgcc

SEQ ID NO: 1977 - DNA, 591 bp, Lycopersicon esculentum
gcacacttgatcttgcatcaactcttgaggttggaccagctggaagtcgaccaactggggatcattccaagaattctggtagcgcaaaatcggttatgacaatagcatttcaatttgcatttgagattcatcttcaagaaagcatagctgctatggcacgtcaatatgtccgcagtatcatatcatctgttcagagggttgctttggctctctctccatctcgtattggttctctccctggtctaagatctccacctggcacacctgaagcccagactcttgcccgttggatttgccaaagttatagattcttcttaggcgtggagctgctcaaatctgctagcggaggaagtgaatccatcctgaaagaaatttgggatcactcagatgctctgatgtgttgctctatgaaggcactgccagttttcacattcgcgaatgaggctggacttgacatgctagaaaccaccttagtagcccttcaagatattagtctggaaaagattttcgatgacaatggaagaaaggctctctactctgagcttccacagataatgcagcagggttttgcatgtcttcaaggtggtatct

SEQ ID NO: 1978 - DNA, 706 bp, Lycopersicon esculentum
tcacatctaggaatatctgggaatgtgtagtgtgcgaaattgaggtttggttgatactttattatatcaaagacattaaggagtcagcagaaattttcaaaattgaactcagataagtataacttccaaaatttattttggcgtggactatgtaggaacatcaagggaagaagttgtgctttattttctcaaattttgaggctatgaaatttcatcaagcccattgtagcaggaggcattactctacactgatgctaagaccactttagtgggtaagtattgttatagtggcgtcgctagagtaggtatagtagagagagaaacaagatttatatggaaacaaccataaagaccctattttcgacacttcatattcttggacatgggaggggcaatttcggacggtcttcactatttttccatgagattcttcgttaaagattctattaaacaaggaactgaagaagcaaagagaaatggcagctgcagctaaggaggaagagaagaagacgtataactcgactattgagcaagcttctgattggattagcttcagcattgaggggatcaactaaatcatttctttcagatatatgttcctatcattctggctcatgcaagtgatttttggacgttgagatacacaaccaccctagacaatggtagcagttatgtcaaagattcctatctgttaccgggcttgacc

SEQ ID NO: 1979 - DNA, 748 bp, Lycopersicon esculentum
gaaagagggggctctcgttctcttggaggagagagcctgtgattgtatcttgtaatggccttgtgtttacagagaggagaaggagaaagtggaagtaaaaacgatatggataatggaaagtatgtgaggtatacaccagaacaagttgaagctttagagagagtttatgctgaatgtccaaaacctacttctttgagaagacaacagctgattagggagtctcctattctctctaatattgaacctaaacagatcaaagtatggtttcagaatcgaagatgccgtgaaaaacaaaggaaggaagcttctcgtctccagactgtgaacaggaagctgagtgctatgaacaagctgctgatggaagaaaatgaccgattacagaagcaagtgtctcaacttgtgtatgagaatggctacatgaaacaacaaataaatactgttagcagcacgaccacagatacaagctgtgaatctgtggtcgtgagtggtcagcagcaaagaaaaaacccaacacctcagcatccagaaagggatgcgaataacccagctggtcttcttgcaatagctgaggagaccctggcagagttccttggaaaggctactggaactgctgtcgactgggtgcagctgattgggatgaagcctggtccggattctattggtattgttgctgtttcccgcaactgcagtggggtagcagcacgtgcctgcggcctcgtgagtctagagcccacgaaaggtgctgaga

SEQ ID NO: 1980 - DNA, 935 bp, Lycopersicon esculentum
agagaaaagagattctttttatatatagttataaaaaaatttcagagttttctttgtaaaacgaacggtgttgatagggcaaaatccaaaactctgcctcatctcagtcgtctccctttctcccttcttctccaacgtccgatcttccagttccctccatccccagtatggcggatggtcaaggttcgtctaggtcaccggcgagtccaaacggaggtggtagtcatgagagtggtggggaccagagtccgaggtctaatgtacgtgaacaggacaggtttttaccaatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaaggaagactattaatggtgacgatttgctatgggcaatggcaactcttgggtttgaagattatattgaaccactcaaggtgtatcttgctcgatacagagagatggagggaacgtcaaaggctgctgatggctctactaaaagagatgggatgcaacctggtcctaattcacagcttgcacatcagggttcatactcacaaggaatgaattatgggaattctcagggtcagcatatgatggtcccgatgcaaggaactgagtaaaaatccgatcttcgtcctgtttgagaagacgggtggagttgaaaacatattatatatatagatggttcttctgctgtaacctctgtaacatggtttattaattctagtgctctctagtgagtgccatgtcatatttaaagtttgtaaattgaggagatgttttaagaaatattatagacatgattgtttgtagtaataatgaaaaccattacctagtaaaaaaaaaaaaaaaaaaaa

SEQ ID NO: 1981 - DNA, 1004 bp, Lycopersicon esculentum
agtgcttcaacatttttctccctgacatattgtttattattagtttcataaaaaaaattataaaaattttctccattttcttgttcttaaagcttgtgtactatcataggcaaatacaagactgcgtatacatcaatgtcttcggactttactcgtagaattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttccttcccatagcaaatgtaagcagaatcatgaagaaagctttaccagctaacgcgaaaatctcaaaagatgctaaggaggtagttcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgcagaggtttagggatttggaagggcaaaaaagtggtgtctctggagagaaggatcatagtggatcagtgggttatgttgaggactaccatggcatgatgatgatggggagtcaacatcatcaaggacgcgggtatggcaccggtgtatacaatcatcatacgggggagaatgctgcaggggttggtacaggagggtcgcggtttcctgacgttgggaggcaaaggtgaagctgtgacatccgcggactacaaagatgtatcaggacgcgatgtatcaactgtcaacaggttgaagtatggacactgaaagacaggaacagactttgtagtttgtattctacagagatgtaaattggtaaacatgtgtgtacattacaatgtgggtgtaaacatggattgtaattgtctattaaaaaaaaa

SEQ ID NO: 1982 - DNA, 518 bp, Lycopersicon esculentum
ttttttttttttttttttcggcgtaatttttataattacagagtaaaaaggacaaattattgtatacaagatcttaccctcaccttttgtgaggtaaatatgctatttctgatagaccttctcctctaactaatgattcaagacattaaaaaaaaactatatttaagtaatgtagtttatattattacaactctataaattataattacagtgttaatataaaacttgaaaccccaacaattttgacaattaaagtaatgtaggtagtgtgtttaaattaggacaatatgaactttttctagtctctggaagtcctataaagagctctgtctcaacttccattatttgtctttcaacatctttctctactagaggaactggtgttaaagtcaatggtagcacctgacacttttttttcaagtctacattttccttcaatagaattttttcctcttccttcagttgagcaatctgttccttgaataacagattctttcttgccctaatgttgcttaaac

SEQ ID NO: 1983 - DNA, 674 bp, Lycopersicon esculentum
gaagaagccttcactaagccaaaagaaaatggcggtcttctctatgatgctttggcaagacctacaaagctttgattgtttaggtgtgtaaagaagacaacccatttgcccaaaaggagaataaattagcatgtgagctgaagtttctgaagaaattggcttcgcttgcctttataaccctctttcccattgtcaatttcaagatatttactacagttgtcttcttctcttcatttaatgagatatcagtgatgcctcatcagaaccagggacaaaatgggcagcagggtatgtggatgtaccaatgcatccattgtaaaaaaaacttcccttcaagccaggccatagcaggccatacaaagggtcatttcagagatggctgggttaaaggaaccccccagagcaaagtatttgtactattttctgagtatcagcaacagcagggttctatcactgactcttcaattcccgagaaacagattttttctgcagcaacttctgacactgacttagcagatgctcatcaattgcaaataggtgatgtgcagaattccagaagcctggtcgtgcggcctccatctccagcttcgtctagcagagaaccacgaatccctaggcatcatttgaggcttcgtgatctgaagatactagctaggctaagggctcgtcttacc

SEQ ID NO: 1984 - DNA, 424 bp, Lycopersicon esculentum
gggtcgtaggcttactcctactcgagttcctcggctgaaccgatattcggtttagttaagacgacaagtccgagtactcctacctagtagaagtcaatgagacgacctaaaattattcgctctctacctccggaagctggccgggcgacgacctcgtagcggtataaacaagcaaaccaagagcaggttaagcccacgtcgtactaaccacgcacggacacccctctaggagagcggattagaggccctagtcggaaaagagtacgaaagcttccttcttgggcgcagataacgaagacagcagtacttagtaagcggtaggtgaggacactagcggcgacaggagcgacattctccctagactaataatataaatttatttagaaccgatactacggctcgtaggcggcgcgagcttcggagg

SEQ ID NO: 1985 - DNA, 574 bp, Lycopersicon esculentum
caaactaaagaaagtgatttttaattgtctcctctatcagtaaaatcagctgttacattcaacattaacagaacaattttcaacagtaactatgaattacagtcaaaactattgaatgagtaaaagctaatccaactttcccaagaaattttttaacttagatccataatcccactattaatccctttgcctaataccactaaaaatttaaggaagagcaaacctttacctctgattgttgatggggttgacaaattcagcatcagaaactgcagaaacttcaacttgactgataatttcatcatcatcttccattggtggaggaaaattaagatctattaaacttgttccaccagttcttgataattctaatttatctggagcaggaggaggaagaacagttacacttgttgaaacaccagcaccaatagtatgtgatcgcttgtgtccacctaaagcttgacctgatggaaaaactctgtaacaaacagggcatagatgtattttctcttcaattactgcattattattattattattatgagccgcgctttccatcacttcctttgataga

SEQ ID NO: 1986 - DNA, 455 bp, Lycopersicon esculentum
ctcgtgcctcacaatcaaagggttttagggtttctttttctttgtgagcgaaaaaaatggctgatgagggttgtgagaggctcaagggaactgtcaagtggtttagtgaccagaaggggtttgggttcatcacccccgccgatggctctgaagatctgtttgtacaccagtctggtatcagatctgaaggattcagaagcctagctgaaggtgaggatgttgagtatcagattgagtctggctcagatggtagggctaaggcttccgatgttactggacctaatgaagcggctgttaaaggaggttcccgcagcggtggaggacgtgatggaggtggttacggcggaggcggtggttacggtggaggcggaggttacggtggtggccgaggaggaaatcgtggttatggaggtggtgacagtggctacggaggaggtagccgaggtggtggcggc

SEQ ID NO: 1987 - DNA, 608 bp, Lycopersicon esculentum
cagtatcagcagagaaagtggactgcagggaaatcggcaaggccaatatggaaatcagcctagtggaacgcaaaatgctccgactggctcttctgcaggcatgtatatgagctgtaatagttgtggtggaacaggtcatagtgcttcaaactgtccaagcatgatgagtggtcagagccaggcatatggaagtggttttggcaatagggcaacttcagggatgagcagtggtggtggtggtggtgagtgttataaatgccatcagtatggacattgggcaagagattgcccaggtgtaagcaatgcacctgctgccaataacatgacatcaggaagatatgggaatactccaaggcaacacgttggtggtttttgatgaacctttgagcacataaagttgtcctgtacaggtttagatgtcttctcttagtggctcatcatggctcatgttctgcttttgagaaagcttcttgaggggcttgcgttttgcctttctgtacagtggtcgcttggggcttaaattatgcatcacggctcctggacgggagtgcactacaagtcttgtcgtccatgttttgaggaatgaccgttccgtgctctttctttgt

SEQ ID NO: 1988 - DNA, 691 bp, Lycopersicon esculentum
  misc_feature (596)..(596): n is a, c, g, or t
ctacaaacacctattgaagagtataagcaggcgaaaaccctctcagttgcagggccatcaacaaaccacctccaaagtaccaaatgcatctgttgcatcctgtgttgaagttggaaagtttggaatagaggaagaagtggaaaggcttaaaagagataaggatgtccttatgcaggagctggttaagttgagacagcagcagcaggagacggatcaccaattggtgactgttgggcagcgcgttcaattaatggagagcaggcaacaacaaatgatgtcgttccttgccaaggccatgcagagccctggctttgtagctcaactagtacatcaacagaatggcaataacaggcatattactgggcttaataagaaaaggagacttcctgaacaggctgaagaaaatgttgcgtgcaagcctgtcaatgctttgcaagatggacaggtagtcaggtatcaaccttcaatgaccgaagctgcaaaagcgttgctgcagcagattttgagaataaatgcatctgggaggctggacaaccgattacacacaaatggcggctgtttgactaataatcccctcccgcctaacaattctctangcagtagcggtgcatccagttgtatttccagtgttaccctctccgaagtactgtcaacttcttcacagcctaatctgatatcagattctggattt

SEQ ID NO: 1989 - DNA, 464 bp, Lycopersicon esculentum
ctccttctactagtggcttctgtccggatctcgatacttccattttccgcataattttttttttttacttttctctgtatctgtgtttatctggagcttgtgaatcgctggattgaactgagaaagctgtgcaattctgaagtggaaaatggacggagttcatgaggctacggtggcggggaatttgacgtcaccgccttttctgaacaagacgtatgatatggtggatgatccatcgacggattctgttgtgtcatggagtaagagtaacaatagctttgttgttttgaatgtgccggagtttgctagagatattttgcccaagtatttcaagcacaacaacttctccagcttcgtcaggcagttgaatacttatttgagatgctcaggagttccttagaccgttgctaggagatattgcataacatgggtctttagagtccaattgagtggacttcactact

SEQ ID NO: 1990 - DNA, 514 bp, Lycopersicon esculentum
  misc_feature (490)..(490): n is a, c, g, or t
ggctactttcctcattgctccgaagttctggataagtttatggaggatgacttaccagacttatttttccttgaaaagggcactccagaggaacaaaagatcaagcggaggcgatttaaggagctcaaagatgatgttcaaagggcatttaataaagacaaggctggacttcaccgctctggctcgtcttcctcatcatcttccacaacttttaacgacggtgcaagtgtcaaagctaggaacctatgatagtaactaggttttatcctacatccttagactcagttttgtatctaagataagtagtcttcaaaacacttatcttataaaattttcattatagtggctgctctatcgttgaccatttttatagttcgtattgttaagtttgcttgtttatagtagaaataaagttgcataagaacaaacttgcggaaatattaaagatgtacaaatgattcgtgtatggagaatctatcgtattttattnctatataaaaaaaaaaaaaaaaaa

SEQ ID NO: 1991 - DNA, 703 bp, Lycopersicon esculentum
caaaaacagggtttttttgctctgcaattggaaatatttttggttgtcttggctggtatgaatgttattccatttcggtaagttgtgatcaagtagttgaagggttattagttggtagaattttcatttgtgtaagttgtgatcaagctgttgaaaatttgcatgttgtattcttgaaaaagatactatttttactgtgaaattgaagtttagctgatggtagatacggtggagttattagtttctgctcaagggttgatttggttgtaactgaaattgggagaatttgagttttagttttggaatttgcttcgtttcttcatcttcgttgttgaatgtgaggagaaaggaagaatttcttgtattggtgattgattaaggttttggagaggttctttttgtgcatagagactgtgtggggacttttgattttcttggagtttgactatcttagatgtagataatatttgtgtatttttagcttatacaattgtgaaaatggcaagttctgctgaaccatcatcttctataagctttacttcaacttccaacacgtcgaatgggtccattggcataggccaaaacacatgtgcctgtggtggatctgagacagggagtagttatgaaatcatcagcttaagtaaactcagtaataatttagagcaactattgttagattccagctctgagtttagtgatgctg

SEQ ID NO: 1992 - DNA, 739 bp, Lycopersicon esculentum
acactagtttttgggtcatcagtcagcagagtgcaactttcttccacaatacatatttggggtatgcagaatcaccttttttattttttgggagttttcatgtttatgttagaatgatgggatttcaccagcagcagccaggcttgcaggtgtgagagtttgggccaagatcatgcagagttgacctgttgactttagttttcaactttttcagattcctgaaagttttgtgctttctcttgagggatgaattcttgctagtttatttaccaaggcagtaattaagtttgaacaatggagagcggccatgagagttttgctacatcttctaatgtatcaaatgagtgcagtagtccccaggaaccaggaccaaatgttgatcatttgagtaatttatgtggtagtcttgagaaactcctgcttaatcctgaatatgactatagtgatgcagaaattgtcgttgaggggattaatgttggcgttaatcgctgtatattggctgcacgaagtcagtttttccatgaaaagtttaaggagaagaatgagaattccttgaaaaatgaaaagcctaaatatttgctgaaggatttggtgtgtgtttccctcattggctatgaagtattcatggtcctcctgaattatttatatacaggaaagattaagtcgtctccttcagaagtttcgagttgtggtgataatgcttgtgctcatgatgcttgccgccctgccattaattatg

SEQ ID NO: 1993 - DNA, 1454 bp, Lycopersicon esculentum
gacaagtagtgcctaggcaatttatggatcttggcttagctgctggtgctggtggtactgcttctgaagcggaagaggcttccctgtcttcgtcagaggggccaagtggcagggaaaaatcgcgatcaccagtgaataacattgaatctagttccacatgtgggattgtaagagaagatagtcctgaaaaagtgtcacctggttggggtcctaataaaattccaagacttggtaatacctctactaataataaacctgctgatcaagctactgaggctactatgagaaaggctcgggtctcggtcagggctcgatcagaagctcccatgatcacagatggctgtcaatggcgaaagtatgggcagaaaatggctaagggaaacccgtgccctcgagcttattaccggtgcaccatggcagctggttgtccagttcggaagcaagttcaaagatgtgcagaggacagaacaatcttgatcacaacttatgaaggtactcacaaccatccgttgcctccggcagccatagcgatggcctcgacaacttcctcagcagcgaaaatgttgctctcgggctctatgccaagtgcagatgggctaatgaattccaatttcttcgcgagaactctccttccttgctcttccagcatggccacaatttcagcctcggccccgttccctactgttacattggacctaactcaatccccgaacccgttgcaattcccaagaccccctaaccaattccaaatcccattttcaaatccacctcacaacaacatcctagcaaatccagctgcacttttgcctcagatatttggacaggctttgtataaccaatccaaattctctggcctccaatcatctcaagatttagaaggacaacaacacccttcaacgatgccatcctcgattaatccatccaaccacaatcctgtagctgacacggtgaacgccttaaccagtgatcctaatttcaccgcagcattagcagcagccatcacttcacttattggcaatccggggcaaccaaacaatggtaccaacaacaccatcgccaccaccacaacgccagccaacaacaataacaacagtgtcacaagcaatggcaataacaacaacaatggcagcaacaataaagtgacgaattcgagttttccagcaaactgattgatagcttgtcaattaaactgctgcgcgcatattttcctttcaagaaagaaatttttttcttaaattaatttttttgcttaactagtaatcaggaaaactagattactatacaagttgataagattctttttgtgtgttttatacgtggcttaaaacatataatcttccattctttttgtggctgaataatgtaattcaagatttcttatcaatacaagaaaatatattggcaaaggaaaagtacagaaatgttcttccttctaaaaaaaaaaaaaaaaaaaa

SEQ ID NO: 1994 - DNA, 1365 bp, Lycopersicon esculentum
aagaactgaaaatacacatccccatgaggttgttggcgcaaattctgatgaagaaaagaaaaaagcgaataatgggaccatagttccaagacaattcatggagctaggccctagtggttccaaagttgacccaatggacgaaccatctcattctcgctcttcatcggaagaaagaacactctctggatcacctcggaacaacatggaattagtgtcaagggataaggcaattaaccgcgaagaaagcccagaatctgagagttgggctccaaacaaggcccctaaattgatgacttcatcatcaaagcctgttgaacagtcaacagaagcaaccatgaggaaagctcgtgtctccgttcgtgcccgatcagaagctcccatgattagtgatggttgccagtggagaaaatatggtcagaaaatggcaaaaggcaatccatgtccacgtgcttattatcgttgcactatggctgttggttgtccagtccgaaaacaggtgcaaaggtgtgcggaggacaggtcgatcttaataacaacatacgaaggtacacacaaccacccattaccaccagcagccatggctatggcatctacaacatctgcagcagcaaacatgttgctctctggttccatgccaagtgctgatgggctaatgaatacaaatttcctagcaagagcaatgcttccatgttcatcaaacatggcaactatttcagcttcagccccatttcctactgtcacattagacctcacagcccaaaatccaaacgcagcattgcctaattatcatcaaagaatcaaccaagcaaatcctcaattccaattccctttaccagctgggctaaatcacccgaatttcgccgcttcaatgtcagcaccacaaatgcctcacgttttggggcagcctttgtataaccaatcgaaattttcgggtttacaaatttctcaggaaaacattcatcatcaccacccatcaatttctcatgacacactctccgccgccacggctgctatcaccgccgatcctaacttcaccgccgcccttgcggctgccatctcctccatcatcggtggttctcatccgaacaacggcaacagtcccatgtccggtccctcaagcaataataataacactagtagtttcccagggaactaattaaataaaatattattttgttttgtaaaatttgctattgtagtctttcttcattcatttttttaaaaaatttgttaggacattaggggatgaaattggaatgaatttacatgttcatatcttttttctttgtattattaccgtggaggaaagagtataggagaaaaaaaacgttattttcattcttttattctgattttggttatacg

SEQ ID NO: 1995 - DNA, 639 bp, Lycopersicon esculentum
gggaagctactcatctcaaagtctttttatagcagcgtccattgcatctgctaaaaacttcttagactcttcaatttatcatatttctatctctaccttttgatcttccaacttttattttttttatggacaaaggatggggtcttacccttgaaacttcttcttctaattctgatagagctggtttcttcaagaacaagcctgtttttggttttaatttaagtcctaaatttaacgctgctgaaatgttttcctcctccgatgagaaacgtagcatcgttaatgaagtcgactttttcgccgataaaaagcctattgtaaagaaggaaaattctcagaccgataattctatcagaactgatgatcagtgtgttgtaaatactggtttgcaacttgtgattgcaaacgcgggaagtgatcagtcaacggtagatgatggggtttcatcggaagtacttgaggagaaacgagctaaaattcagcagttggcacaattgcaagttgagcttgaacggatgaattccgaaaatcaacgtttaaaagggatgcttactcaagttagcaacagttattctgcacttcagatgcatcttgttacactcatgcaacaacaacttaattcaagaactgaaaatacac

SEQ ID NO: 1996 - DNA, 644 bp, Lycopersicon esculentum
caacgacaaaacatttcaataactcaaaatacacatgaccacaattttcagattgtggaagcaaagttaaatcaagaaaaaatcgttccaagaagattcctggaattaggtcgaagtggtaacgatctatctcataattccaattcttcatcagaagaaagaacagtttctaaatcacctcgaaacgatacacaagttacaattatgcataataaaggcagagaagaaagcccagaatctgatagttgggtacctaacaaggtccccaaattgaattcctcaatgccaattgatccaacaacagacgcaaccatgagaaaagctcgtgtctctgttcgtgcccgatcagaagctcccatgattagtgatggatgtcaatggagaaaatatggacagaaaatggcgaaaggcaatccatgtcctcgagcttattatcgctgcactatggctgttggttgcccagtacgaaaacaggttcaaaggtgtgctgaggacaggacaattttgaatacaacttatgagggtacacacaaccaccctctaccaccagcggctatggctatggcatcgactacatcagctgcagcaaatatgttgctatcaggttcgatgtcaagtgcagatggtgtgttaatgaatccgaa

SEQ ID NO: 1997 - DNA, 513 bp, Lycopersicon esculentum
caacaacgacaaaacatttcaataactcaaaatacacatgaccacaattttcagattgtggaagcaaagttaaatcaagaaaaaatcgttccaagaagattcctggaattaggtcgaagtggtaacgatctatctcataattccaattcttcatcagaagaaagaacagtttctaaatcacctcgaaacgatacacaagttacaattatgcataataaaggcagagaagaaagcccagaatctgatagttgggtacctaacaaggtccccaaattgaattcctcaatgccaattgatccaacaacagacgcaaccatgagaaaagctcgtgtctctgttcgtgcccgatcagaagctcccatgattagtgatggatgtcaatggagaaaatatggacagaaaatggcgaaaggcaatccatgtcctcgagcttattatcgctgcactatggctgttggttgcccagtacgaaaacaggttcaaaggtgtgctgaggacaggacaattttgaat

SEQ ID NO: 1998 - DNA, 620 bp, Lycopersicon esculentum
cgggttcggggattgagttaggtccaatgtaacagtagggaacggggccgaggctgaaattgtggccatgctggaagagcaaggaaggagagttctcgcgaagaaattggaattcattagcccatctgcacttggcatagagcccgagagcaacattttcgctgctgaggaagttgtcgaggccatcgctatggctgccggaggcaacggatggttgtgagtaccttcataagttgtgatcaagattgttctgtcctctgcacatctttgaacctgtcaatgcagagaaattcacttcagtcaagagacttcctttttttccccttcattcaaatattcgttctccattaattcaactaatctagacttgctttgagaaagccctctaaagcaggtaaaacactgttttgtatacaattctttattgaagctcaaatctaagacttctggttgaagttatagacactatagagatactaacggcataatacatacatcggatcctaaacttggcttcaaaattctactttgacctccaacttttataatgcaaaaatatacacttttactttccaacttttaaataaatacacacatgagttctatgtggaacaataaac

SEQ ID NO: 1999 - DNA, 1016 bp, Lycopersicon esculentum
gcttccccactcccaccactttttctctatgatacacacaaataaataaataaattaggcctagatatctacttctatatatatatatatgttgatacagatgtatgtataatcttgagaatctttagtgaaaagaacttcctttttagcttaagcatatgtatgtaatagacacaagctaaacttgtgagtttttcttgaaaggggtttttctttaactgctgtcatccccagaaaaagaaagatcataattacttggggcaagtctaataatgcctactattgctaaacatgatggtcggcagctggagactgggctgcgaattacctcactatcaactacccaaatgcaaccatggtggcacggttatggtgataatactatgcctttggctagtgagaatgccgttgcccaggagaaatctgaaggtggcaaccaggataaagaaacaaaggctctagccatggaatctggatcagatggaaataacgagcaatacaagcagcacctcaagcattttgcacccacaactgctgccatcatggctgagcagcagaaggaactcacaggtcattcagctatgttggcgtcatatccatatccagatatgcagtatgggggaatgatgacttatggcgcacctgtacatccccacttatttgaaattcatcatgcccgaatgcctttgcctctcgacatggaagaggaacctgtctacgtgaatgcaaaacagtaccatggaatattaaggcgaagacagataagagctaaagcagagcttgagaggaaagctattaaagcgagaaagccatatctgcatgaatctcggcatcagcatgctatgagaagggcaaggggaactggaggccgctttctgaatactaaaaagctcaatgacatggactgtacaccaacggagactcaaaaatatggggcaaccattgcaactcactctggcaactcttctgggttccgggaagtctgatcaggggggaaaggaaggatctacagttca

SEQ ID NO: 2000 - DNA, 1080 bp, Lycopersicon esculentum
cctttgcatgcagatgggagttatgggaaggcggatcagaattttcagccagctgctccagccatacctccaagacttgatggaagcctagcacagccccagcagcttgaacttgttggacactctattgcgtgtgctccaaacccatatgttgatccatactatggcgggatgatgacagcttttggccagcctttggttcctcctcatgtacttgatatgcactatgcaaggatgcccttgccacaagaaatggctcaagaaccagtttatgttaatgctaagcagtatcgaaggatcctgcagcgaagacagtcacgtgctaaagcagaacttgaaaagaagcaaataaagggtagaaagccatatcttcacgagtctcgacatcagcatgcactgaggagggtaagggcctcgggtggacgttttgccaaaaagacagatgcttctaagggtactggttctgtgagttcatcgggttctgaacctttgcagttcaatgctgctgatattcaaaagaggaatgaaaatggaaggttggccgagcttcagcagtcttattcaaatggtagcagttatggcaatcaaagtagctttcaagaatccaaggatgagtcccagtttgctaaaagcagggaaggaggtttttttgtcaagtaattggagatacgttcatgtgtaaactagctcttgccctgcaacgagggtagagtatgagcaagaggagtttacagggattgtttcatttcttggcttttcaagataggcggcaattcattcttggctttttactttagtgttaaagggagcaacagaggtgacgagggtatcagtgttgcagcatttgcttggagattacatcttcccttatgtacagagatggatgaacttagaactaggattagaaagtttttcagtaagtttatgtttggccagttactgtagttttagtttaggagaccatgtaaaaaggttgttagttttgcaaaaggatcttttttctttccctaattggtgcattaatttctggaaaaaaaaaacaaaaaaaaaaaaaaaaaaaaactcgagactagttctctc

SEQ ID NO: 2001 - DNA, 673 bp, Lycopersicon esculentum
gcatcatccgaggatgcctttgcctcatgaaatggctcaagagcctgtttatgtcaatgccaagcagtatcatggtattttgcggcgaagagagtcacgtgcgaaagcagaacttgaaaagaagctgataaaagtgagaaaggttagtatatgcctcatccactgggctgcttgttgggtgttcttttctcctgttatctaaagaatgcatgatgcacctttttagcagcatatttttgttacatgtgcctggctgttctggagatattccgttgtcccggattggagatgtacccactctttggctgagctcacttttctttaaaaaaaattaaactgttaaagaattttatgttacttaagtaggaggaaatgaaaggtaaaatctgatattacttttatctgtgtagaacacggtcaattcacctttttaaactgatccgtcaaatacaccactcataagtataatttggtgaaaggagttccttatgccaatgtttgggctattaataaccaatatcagtttctccactgctatatttttattgtgaagtcacaggattggctgacatgattttgcacgaatgttatgctgatgatatgcaacatatgctcggtttattctgcttactcatcctcagttgttgatactttctgtcttcctcgtaataca

SEQ ID NO: 2002 - DNA, 467 bp, Lycopersicon esculentum
cctcgtgccgaatcggcacgaggtgtaaatgtacaatctcaagtcccaccagggtttagatttcatccaacagaagaggagctattacaatattacttgaagaagaaagttgcaaatgagaagattgatttggatgtaatccaagaagttgatctcaataagcttgagccttgggatattcaagacaagtgtaaaattggatcaactccacaaaatgattggtatttcttcagtcacaaagacaaaaagtatccaacgggtacaaggacaaatagagcaacggctgctggattttggaaagctacggggcgtgacaaagtgatctattcaaattgtccaaggattggtatgaggaagacacttgttttttacaaaggtagagcacctcatggtcaaaaatctgattggattatgcatgagtatagatttgatgatcatattgccgaagaagaaggttgggttatttg

SEQ ID NO: 2003 - DNA, 494 bp, Lycopersicon esculentum
cacctccaaatcatcacctaactccacaaccccaaaccagacttttcaccttcaccaccttcattttcctccaaacaacagccaacccaacaactcaagctaaaccaccagtcccccgccccattttctttgacgatttcttttcttttcaggtatacagtcgtataacgagctccaagctccaagctctggtagcataaagaaccagacgagctcccagctctgaaactccattctccattttgcgtttctcctccatcagatctgaacgaaaaattcataataaatgtgtttttacaggtacctcggagttgcttctcatcgaagctattccaatggaattcaaatgtacttaatattcattattgtgtatattattgacgttaggcaaaccttagaccgatacttactttattattttgttttattattttgtattattatttgtgtatattacatattaattgtacttgtgtaaaaaaaaaaaaaaaaaa

SEQ ID NO: 2004 - DNA, 618 bp, Lycopersicon esculentum
gcctaaccctcatttcatcattcatttctgtgtctacctgaacttctgcaactttttttttttctttttttaaatttgtccccctcttaacaacatggtacaatcaaagaagttcaaaggtgtcagacaacgccagtggggctcttgggtttctgaaattcgccatccgctgctgaagaaaaggatatggttaggaacatttgagacagcagaggaagcagcaagagcgtatgatgaagcagctatcttgatgagtggacaagttgcgaaaacaaacttcccaattgtgaaggagagtactgataacaacaatgacactactaaattccctttaacttcttcatcaacactgtctagtagcatgctgaatgcaaagctgaggaaatgttgcaaggatccagcaccttccatgacctgtctgaggctcgataacgacaactgtcatattggagtgtggcaaaaaacatcagggaaacattcaagttctaattggataacaaaaatctaacttggaaagaaagaggagaagcctcatgatcatcaggatatgaatgctgaacttggcattactaaaccattggacgaagaaaacagaattgctatgcaaatggtggaaga

SEQ ID NO: 2005 - DNA, 424 bp, Lycopersicon esculentum
ggttgtccgcttgggttccctgtctttcaaaagccactcttagtcaactaggatagagctaaaccaaaacctcatattaagcatgacacaattgttttgtatgttatgtgatatacgtgttgtatatatgttgtataatagttcattattttaaaatcacttttgttaacctagttttaagaatattcataattcaagtccaattttttgaagttaaatagttggaactacgtttgacctgattcctacttcaacgggatacgtaggcgccattaaggctcggtcatcttccccgtaagttttccaaattttaagaacagaaactggggcaaaattttggggaagtctccaaaattttataatggagatagttgttacaatattaaataccggaggtttgtcgaagctgaaacaggggcaaaaa

SEQ ID NO: 2006 - DNA, 451 bp, Lycopersicon esculentum
ggacaattgcttgcccacattcaagtatggtacaggcaaagaagttcagaggtgtcaggcaacgccattggggttcttgggtcgctgaaattcgtcatcctttactgaagaggagagtgtggctaggtacgtttgaaactgcagaagaagctgcccgagcgtatgatgaggctgctgttttaatgagcggacgtaacgccaaaacaaatttcgcagtgcaagcaatggatgaaaataaaaaagacaattataaatctaataattcgacattatcaggatcatcatcatcactctctgctatacttagcgccaaacttcggaagagctgtaaatcgccatcgccgtctctcacttgtctcaggcttgatacagagagttccaacattggggtttggcagaaacgggccggagcccggcctgattctagctgggtcatgacggttgaatttgg

SEQ ID NO: 2007 - DNA, 675 bp, Lycopersicon esculentum
gattccttaactattttcttttccatcctctttcctttttcccggaaaatcggaatttaaatggtgagaggaaaagtagaaatgaaaagaatagaaaattcaacgagcaggcaagtgacgttttcgaaaagacgaaatggacttacgaagaaagcttatgaattatcagttctttgtgatgctgaagttgctttcattattttctcacataaaggaagactttatgaatttgctagctccaacatgcagaagataattgagagataccgaggacgtgcaagagaaacaacgacggtggacaaaagcactgaactcgagcactacatggagaacttgaagcatgaaacagctaatatggcgaagaagatagagatcctcgaaatttctaaacggaagctaatggggcaaggattagggtcatgttcaatggatgaactagaagacattgacagccaactggagaggaccctcaaaattatcagggctagaaagactcaattgttcaaagaggaaatagaaagtctaaaagcaaaggagagactattgctccaacaaaatgcaagtttacgtgaaaagtgcgggcttaggccaatgctatcagagtcagcatctgcacccgaacccataccagcaccaccatcaacaccaccagctcaatcaaaagaaaggggaaat

SEQ ID NO: 2008 - DNA, 538 bp, Lycopersicon esculentum
ttacatttgtaagtgtattgtgtctttccattttagctccaaatagtccttttgcaaccaaaatcttgtctgagatttttctatatttgggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcatacctgaggtaattgaacgatataagaggcatactaaagataaagttaaatctgatgaaaatcaatctgtggatattcagcatactaagcaagagacagcaagtttgatgaagaagatagaactccttgaatcatctaaaaggaaactcttgggagaaggtttaggatcatgcagccttgaagaagttcaacaattagagaagcaattggagcagagtgtcattactattacggctcgaaagatgcaag

SEQ ID NO: 2009 - DNA, 604 bp, Lycopersicon esculentum
tttcgaggaaggaaagtagtattagaaaagtcggggagaaatcaatgctcttcatttttttccccctttttctaaactagggtttctataacaacaactatttgtgtcttcactctattataatttaacttataaagttttttctaatttctttttctcttcatctttcagatctaagaaaccataaagtttttatttttaggggttattatccacttcaagatttagaatctttctatttttggaaacttctcatgaattggtggaaagaggatatttctgaaggacgtctaatacgttaagggcattttttcgcgaagaagaaaatggtgaggggaataactgagatgaaaaggattgaaaatacaacaagtagacaagtgacattctcaaaaagaagaggtggactacttaagaaggcatttgaactctcagttctttgtgatgctgaagttagtctcatcatattttctcaaaaaggaaaactttttgagttttcaagttcaagtactaacaagacaatagaacgttatcaaaagaatgacaagaatttgggtcatgaaaatatattacttgaacaaactacaaagcatttgaaggggga

SEQ ID NO: 2010 - DNA, 413 bp, Lycopersicon esculentum
aattaaggggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcacgcaggagataatagagcgatataagaggcatactaaagacagagttcaacctgaaaaccaagctgggccacagtatctacagtatatgcagcatgaggcagcaaatttaatgaagaagatagagctccttgaaacagcgaaaaggaagttcttgggagaaggtctgcagtcctgtacccttcaagaagtaccacagatagaaaa

SEQ ID NO: 2011 - DNA, 326 bp, Lycopersicon esculentum
ggaacttcacaggaagtttgttgcagctgttggtcagttgggcatcgaaaaagctgtgccaaagaggattcttgacttgatgaatgttgacgggcttacaagggaaaatgtggcaagccatctgcagaagtataggctttacttgaaaaggatcaattcagttcaaacccaacaagcaaacatggttgccgcattagggggaagggactatgtgcgaatgggctcactggatgggcttggagattttcgaacattgggtggatcaggacggtatactcatgctgccttgtcatcgtacagttcagggggcatgcttggcagactaa

SEQ ID NO: 2012 - DNA, 511 bp, Lycopersicon esculentum
gagaagagaaaggattaattctcatcttcatagcctcagaaccctactatcttgcaattctaagttggataaagcttcattactagccaaagttgttcaacgtgtaagggaactcaaagaacaaacttcacaaattatgcaaagtgaaacaaacttattattcccttcagaaactgatgaaatcactgtgttatcatcaaatgattgtttagctgatggaagattactcatcaaggcctctctttgttgtgaggatcgattcgatctcatccctgacctaattgaaaccctaaaatcacttggattgagtcctataagagctgaaatggtcacattaggagggagaatccataatgtgattgtattagctgttgatcataaaaaggagagtgataataacaatactgatcatgatgaatcgtcgttattgttcttgagagatgctttgaggtctatagttcaacgttcgagttatggtacaggtgaacgaggtgaaagacgaagagtatta

SEQ ID NO: 2013 - DNA, 1077 bp, Lycopersicon esculentum
ctcgggcactccatctctgccaacataagatggtgaaggcggagactctgattgtagttgcattctcctgttgtccttttctcacagcttcaacaacagtaggtgttgcaaagacaacaggtccagcaggataaaccatgggtgtaaaaggaatttggacattgatgaggaatgaagttgagaacaaaaaggatgaaaggatcaaaaaacatgggtatggaagaattggaagggcttattctttcatggcaacaatggtgaagagggcctaagctgcaagaaatatgtatcaaaattgtccttggcctaacacctaaaagaacacacaaggacaatagcaataaccaaatactaactgctactgctgccaaagaaagtactgctatttctctaagctatgtatgtgagctgctccaaatctgtgacaacttggttgattgcatgaaggaccatcttctttatctgttacaccagaggatgaaacaagtcagtaagaaatggaggcttgtcttaacatagtcagattaaaataaagcattttttatatggcacctctagtttgtcttctctggccttgtggcctttcggcaatgtcctgaactcagctgtgaggcggaaacattctcgaatgttttcaggagaaacaaaatcagcagcaactttggtacacgactggaaagttgaaaacagatggttggttacttgatgaactttatcatctggattttcatggattatttaagtattgattcttaccttgagattacgcacttggtgagggcatcctgcaggaatgaaaactgactctccaagtctttgctcaaatgtccaaggttcaatccctaaaatagtaagcgtgcacatcttgagtttattaaataaaatgtgatccttgttattgaggaaagataacgaacagggtaaattactaaccgaattcttccttcagttttctcttgtgctccaaagttaagtagaagctctggtcatggattggatgaaaaacctgatcaaccggacaacagaaagtgtgcctaaattcctttgcatgctttaaaagatactcactcaacttgg

SEQ ID NO: 2014 - DNA, 473 bp, Lycopersicon esculentum
gcaaaagcagagtagtacataccaaccaccgaagcaacaaccaaactcaccagagtagccgccggcgaacagatccatcaccggagttcatttacagtaattaaagctcactgtagaaatttaaagatggccggagtaagaaaagagatgatgatgatgaatggaggaaacatgttacgaagtgtggaatatggaagaccgattccgaaaagagggcaagtgaaggttaccatagttttgggattagctcactctttatcttctattttctccaatcgccggtagagatggagtactgaagagagaacccagttttggtaaatttagagagtgttggagggtattattgtccttccataggctaggatcttgagcttggtgtgtcttgtattttgtacatagctggtgattttggcgcccattgtgtagtattttggaacttaatttccaatcaataccacttctcttttacg

SEQ ID NO: 2015 - DNA, 536 bp, Lycopersicon esculentum
cctcgtgccgaatcggcacgaggatcaaaaagaactaaataatactgatacagatgatcatctagttcgtaagaatgattttgcatctgcaaaacaagaaaaagccagtgatgttttttcctctgacgagaatgtgcaattggagggcagtttatcttctgatcaggtggttgatcttgaaaacaagtttgatggaccagaggaagaaaatggtggtgcagtctgggatatctttaggagacaggatgttcccaagctcgaggattatcttaaagagcatcagaaggaattcaagcatacacttggttctccggtggaccaggttgttcacccaattcatgatcaagttttctacttaaccacgtatcacaaggagaaactcaagcaagattttggcattgaaccttggacgtttgtgcaaaaacttggagaagcagttctcattcctgctgggtgtccccatcaagttagaaatctgaagtcttgtataaagggtgctctcgattttgttcacctgaaaatgtgggcgagtgcat

SEQ ID NO: 2016 - DNA, 372 bp, Lycopersicon esculentum
ggtttggaaaaaatgaagtatttgaggatatggaaggcggtgcactgtgggacatctttagaaggcaagatgttgctaagttggaggaatatcttttgaagcacttcaaggaattcagacatatctactgttgcccggtcccacaggttattcaccctatacatgatcaaacattttacttgactgaggatcacaaaaggaagcttaaggaagagtatggagttgagccatggacctttgttcaaaaattgggagatgcaatttttatacctgcgggctgtcctcatcaagttagaaacttgaagtcctgtattaagggtgctcttgactttgtgtctcccgaaaatcttcatgagtgcatccgtctgactg

SEQ ID NO: 2017 - DNA, 560 bp, Lycopersicon esculentum
atcacatattctatcaaagactcttttaaagtctttcttctcaaaaataatagtattagagaccatgtttggctcttccacttcccaagaaacaacaaatgtcatttctcatcaacattatcaaaccataaaccctaatttttatgcttttcatgatcctcttatcaacatgaatcaagatcatgtccacaataataattataataagtatcaagattatgacacttcatttcttgatttgtttgttgatggtgatcaagaatattattccaattacacaaacaataatgcttcaatttatttagaaaatcccttcaagcaacaagagataagtagtagtacctatagtactagtggaaactcatcatcagctagttcatttgatgccacaccaacacatgttcacatgaataatgaaaatacaagcatagggattgagaaagaaaaaaaaggtgaaaaacatgcaattgcttttagaacaaaaacacaacttgagaccttggatgatggatacaaatggaggaaatatgggaagaagaaagtgaaaaccaacataaatc

SEQ ID NO: 2018 - DNA, 740 bp, Lycopersicon esculentum
ttttttttttttttttttttttttttgcgattaacttatctatatatttagcacttgaaaattcgtgcacaacttttttaaaacatatgtcgaaaatgttcaataaaaacactttatcatataatcaaagtgctccattagaacctaccataatacaaatatataactaaactttactgacacgtttaagaggttctaaaggtgaagattgtgaagggcaatattgttgggagggaattgtgtgtagtgaagcacatgaggactctcgtggttgtgaatcccttcataagtagtaatgacatagcttgaatctttattgtccctttctactcttttcttcacattgcatcccccacttgaacatttgtagtaattccttggatttggattattcttgaccatctttttgccatatttcctccatttaaatccatcatccaacacctccaactctgatctaaatctaaatgcaaccttagactttgcatccaccttctttatacctttcatacattttatgttatgacttgttggagtaggattatttgaatatgaaccactagtatcggaaacactttgaacaatttcattttgtgacaaaaaatcgtcactcgatccatcatcgagaaaaagataattataatcggagagctcaaaattctccgatgcgtcgataaaattagggttagggtttgatgagctatagggaaaattttccatagttgaacggaacgaaaaag

SEQ ID NO: 2019 - DNA, 557 bp, Lycopersicon esculentum
ctccattagagacagacaaaattccttgtttccttcttccccactgcctctgtgatctccattgccggcttctcccataaaccaatgcgattctcatttgtcactttactatacccaactcaaaaaaatcccaattctttctttgttttgtttcttttcatcaattctggttctgtaattcaggagtgaaccatttgatatttctatacttttttgtgatacccttttgggcgcactgtagtgggttttcgagatgtttgatcttaatcttagttttgatgatgtttcagtagaacccatctctgttttagcgtcggaaaaggttgatgaaatgttatttaatcaaatggagaactcaggaacttctaattcctctattgttaacatggagacttcaagtactgctgctgatgatgagtattttagtcctgatcatcatcgcgatggttatgcatttgatatattgaaatccgatagggaaagctgggatcgtggtgggtttgttgtaaaagagttgttcccgttggtgaaatggaaaagtgggttggatctttcgg

SEQ ID NO: 2020 - DNA, 709 bp, Lycopersicon esculentum
gattgactctggatccgaatctgataaaccgactaaagagttctctcatcacgattcctctggccacttcaaggattttgatgtcgaagatgactggtttgctgatataatgaaggatgatatcattaagctagatgattcttcacttaatcccagacctgtttccatgatcccggataggcctgaatcctctgaaatatcaaatcatgaagctcaagctgcgatgtcctctgttgttcctttccagggcactgcgaatcgaagactcagactagtaagagaaattgtaatgaagtgtggagtaaaggaatccaaaccatacaaagctattaagaagaataaagtaggagtgggcacgactagttcagtaagatggttgagaaacatgttttcagttaaatggatgaggcaatatgtgataactatatttgttgctaccttgatatttctggtcatgcttcttagtttgttgggagtctcgcagcaagtaaaacagcgtaggcatcttctcgttttggcgagcagctgaagttcatactatactgggatgttgtttaagtaataatgttatttggagtggagattgaagaatgattggttatgcgaaaacgaacaagaaccaactgtgtagagcagatgtacagttgtggtggtgcttgtagcatgtataaccatatatttatattgggatctatttggatgcataaat

SEQ ID NO: 2021 - DNA, 1625 bp, Lycopersicon esculentum
tagtggaccccccgggttttgaaaaaaaataatattttttttatgaaaaaaaaagaagttttttattaattaaaaaaaaaattatgggtgttcaagaaaaagatccacttttgcaattaagtttaccaccaggatttagattttatccaactgatgaagagcttttagttcaatatttatgtaagaaagttgctggacatgattttcctctacaaattattggtgaaattgatttatacaaatttgatccttgggttttacctagtaaggcgacatttggtgaaaaagaatggtatttcttcagtccgagggataggaagtatccgaatggatctagaccgaatcgagtagcaggttcgggttattggaaagcaacggggacggataaggtgataacttcgcaaggaagaaaagttggaattaagaaagctcttgtgttttatgtgggtaaagctccaaaaggatccaagacgaattggattatgcatgaatatagactttttgaatcttcaaggaaaaataatggaagttcaaagctagatgaatgggtgctttgtcgaatttataagaagaattcaagtggaccaaaacctctgatgtctggtttacacagcagtaatgaatacagccatggttcgtcgacttcgtcatcatcccaattcgatgatatgctcgaatcattaccagaaatggacgatcgattctccaatttaccgaggttgaactctctcaaggccgagaaattcaacctcgatcgtctggattcagccaatttcgattgggcaattctcgctgggctcaaaccaatgccggaattgggcccagcaaatcaagctccaggcgttcagggtcaggctcaggggcatgtcaataaccacattcacagcgacaacaacaatatgaattttctcaacgatgtttacgcccatcctccaaatttccgaggcaacacaaaggttgaaagtattaatctagacgaagaagttgaaagcgggaaaagaaatcaacggattgaccaatcgagttacttccaacagagtctcaatggattttcccaagcgtatacaaacaatgtggatcaattcgggatccaatgtccgaatcagacgttaaatctcgggttcaagcagtagaggatactggaaagtaagaaaagttgtagctcgaaatctgaatgccagtatactgtgtatatatacagaaggcctggatttagatttccttggcccaacggattcgaagaaagagcaagtacagtatcatgccaaggaaattaagtccttcgagggcacgtctgggcagacgtcgtggacgttatttgcaagttcttgcaattgtgtctgaagtcattaggctgagtggcacttcttatttgcaagttgtgtttgaagtcattaggccgaaggcacgtctgcgtggacgataaaataatgtacacaaacaggagatatatgcaggggcgtgtatattcttttaggaaactgggcttttagtttgttttattttatgatacatttccagatttggatgtattttgtaatttttacatttctgtgtagcaagttagaagatatatagaaagatacttttaaaaaaaaaaaaaaaaaaactcgagggggggcccg

SEQ ID NO: 2022 - DNA, 1236 bp, Lycopersicon esculentum
ttttcttctctctctacattttgcttacttgtgagaaggaaaaaaaatgggtgttcaagaaatggatcctcttacacagctaagcttaccacccgggttccggttttacccgactgatgaagaacttttagttcaatatttatgccgtaaagttgctggtcatgatttttctctgcaaattattgctgaaattgatttgtacaaattcgatccatgggttcttccaagtaaggcgattttcggagaaaaagaatggtatttcttcagtccaagagatcggaagtatccgaatggatctagaccaaacagagtagctgggtctggttattggaaagcaactggaactgataaagttattactacagacggtagaaaagtcggaatcaaaaaggctttagtgttttacattggtaaagcacctaaaggaactaaaacaaattggattatgcacgaatacaggctcagtgaacctacaacgaaaactggaagttcaaggctcgacgattgggttctatgtaggatttacaagaagaattcaggtggacaaaaatcgagttgctctgatttacagaacaaggatataagtcatgcttcatcatcgtcatcgtcatctcagtttgatgatatgctggaatctctaccggcaattgaagatcgttatttctcattgccgagggtgaattctataaggaattttcaacaaaatgacaagatcaatcttcaacaattgagctctgggaacttcgattgggctgctatggcgggattaaactcattcccggaattacgtaccggaaatcaagttccaacgccgggaaatcaaactccggtgctgataaacaccaatcagtatcacaatcacaacgacaatttgaataatttcaacgaatttttcgccaattcaacggcgttaaattttcacggtgaagttaagtttgaaggaggagttgatcaagaagtagaaagcagtgttagagctcaacgacttaacagcgttaacccgggtttcttccaagagaactcaaccgggttttcaagttcttatacaaactcggtacccgacccatttgggattcggtacccgacccaaacagtaaatatgggttttactgggtaaatagtggaagggtaaaatgtgaatgctcataaattaacttgaagacaaatttggaaaaattgtcatggttatttaggttcaaagggcattttattatttggttggggattaaaatagca

SEQ ID NO: 2023 - DNA, 2244 bp, Lycopersicon esculentum
gtcatacctctcgccaagtatgctaaagcagtgtatcatacgcgagtttctgttggcatgaggttccgaatgctatttgaaacagaagaatcaagcatccgtaggtatatgggcacaattactggcatcggtgatctagatcctgttcgttggccaaattctcattggcagtctgtaaaggttggatgggatgaatcaactgcaggggagaggcagcctagagtttcactgtgggaaattgaacctctgacaacatttccaaagtatccatctcctttctcccttatgttgaagcggccatggccacctggactgccttcatttcctggtctatcaaatggtgatatgactatgaattctcagcttccatggctgcatggtggcatgggtgatcaggggatacaatcacttaatttccagggatttggtgttactccattcatgcagccaaggttcgatgcttctatgctaggtttgcagcctgacattttgcaagcaatggcagcattagattcttctaagcttgcaaatcagccacttatgcagttccaacatatccctagtacttcagcatcttcgattcagagccagcttttgcatccatccaatttgcaacatactttcctccaaggcctcccggagaaccaactaatatctcaggcacagatgctgcagcagcaattgcagtgccaccaatcttataatactcagcagcaacagttgcagcgccagcaattgtatcatgatcaacaacttcaggaaccccatcaagtacagcgtcaagatcagcagcaaaccaaggctcaattgtgttcagctactcagtcacagctttctcatttacaggtcctaggttcaacgggttctcaacaaacattttctgatttagttggtcatcatattaatacatctaacaacagttccaccatgcaaagtctcctgagctcattttcccataatggagcatccacttccctgaacatgtctgagaccaactccctagtgtctccttcctcatcatcaaagcgaattgctctagaatctcagatcccttcacaagctccatacatggtgacacaggctgaagttttgacggtgcctaatactaaggtctcagatttttccactttgttttcaccaaatcctggcagacaagttttggattatcaagctgtagcagttagccaaaacaatgcgctatttggagttaatggtatgtcaaacctgaagggtaacagtccggagaacggatctttacctgtgccttatgctacctctaccttcacaagtacagtgggtggcgagtatcccgttaattcagacatgacgacatcaagttgtgtagatgaatcaggtgtcttgcagtcctcagaaaatgtggatcaagcaaactcacttacagaaacctttgttaaggtttacaaatcagagtcctttggacgatcactggatatctccaaatttagcagctataatgagctgcgaagtgagcttgctcgcatgtttggccttgaaggcctgttggaggatcctgagagatcaggctggcagcttgtattcgttgaccgtgagaatgatgttctcctccttggtgatgacccctggcatgagtttgtgaacagtgtttggtacatcaagatactctctccacttgaagtgcagcagatgggcaaacagggcctcgacctaccaagtgctggcaaaacgcagaggatcactagcaatggcaatggctgcgatgatttcatgaaccggaaccattcgtgtaatattatgaatgggatccctctgggatcacttgagtactaatttatgttgcttggacactcaaaatgttattgcacccgtgttggatcgtacactacttttggaggataagacacactcgttggcaattttgacgagtttgagcaacataaactactaatgaacaagaacaaccaagtgacccctaaggtaaatgtaccatgtagttgctggtatcagcaattctttgtaccttgttctatcaaaatgttattttttgtcatgcatttcttctacctaaaaaaaaatgaggtcaaatctcatttaaaccttgtaaaccagataattttcaatgtaattatttaatgttgtattgttgttattcctgtggaacaacttcaagagacaactgtacaatagtgttactagctgaagcaatgtcttttcttcctattgtatttaagaatagactgattacttaaaaaaaaaaaaaaaaaa

SEQ ID NO: 2024 - DNA, 1087 bp, Lycopersicon esculentum
gtatcttcatcctcatcatctaagcgaattgctctagaatctcagctcccttctcgggttactccatttgtggtgtcccagcctgaggatgtgatagcgcacaatacaaaggtctcggatctttcctctttactgccaccttttcctagtagagaatcgttttctgattatagaggagtagacgatagccaaagcaatgcactctatggatttacagactttttgaacatactgcagaccggtatgtccaacatgaagggtagtagtggtgataatggatctttatctattcattatgctacctctaccttcacaagtactgcgggcaatgagtacccccttaactcagacatgacagcttcaagttgtgtagatgaatcaggtttcttgcagtcctccgaaaatggggaccaagcaaacccaactaatagaatctttgtgaaggttcaaaaatcagggtcctttggacggtcactcgatatctccaaatttagcagctatcacgaacttcgaagtgagcttgctcgcatgtttgggctagaaggcttgttggaggaccctgagagatcaggttggcagcttgtaattgttgaccgagagaatgatgtcctcctcctcggtgacgatccttggcaggagtttgtgaacaatgtttggtacatcaagatactttctccacatgaagtgcaacagatagggaaagagggacttgatcttccaaatggtgtccaagcgcagacgcttcctggcaatgtcaatggatgtgatgattatatgaaccagaagggctcccgaaatactatgaacgggataccattggggtcacttgactactaatgaccattagtgtgatctgcctaaggtaattgtactgtatagttgttgttgcccttggttaatgtctgcaaattttttgtaccatgttgtgtcttaagtgtcatgtatcttttctatctaaagacaagggccaagtctcatttgtagcttgttaccccagagaagtacaatgtaaattataaatattttattattgataagactggaactaccttctagtgatcagctgcaaaaaaaaaaaaaaaaaaaa

SEQ ID NO: 2025 - DNA, 1056 bp, Lycopersicon esculentum
ggaattcggcacgagggaggcaaccaagggtctcattatgggagattgagcctttgactacttttccgatgtatccatctctttttcctctaaggctaaagaggcctttctatcaaggaacctcatcttatcaggatagtaacaatgaagctattaatcgaatgtcatggttaagagggaatgctggtgagctaggacatcattcaatgaatcttcagtcttttggcatgcttccttggatgcaacagagagtcgattcaacaattctcccaaatgatattaatcagcactatcaagctatgctggctactggcttgcaaagtttttgggagtggagatttactgaaacagcaattaatgcagtttcagcagcctgtccaatatctgcaacatgcaagtactgagaattcaattttgcatcagcagcagcagcagcagcagcaaataatgcagcaagcagttcatcagcatatgctgcctgctcaaacccaaatgctgtcagagaaccttcaaaggcaatcccagcatcaatccaataatcagtcagaagaacaggctcaccaacacacttaccaagaagcattccaactcccgcacgaccagctccagcagaggcaaccatcaaatgttacctctccatttttgaaagcagattttgcagatttgacctctaagttttcagcatctgttgccccttcaggcgtgcaaaatatgcttggttcgttgtgttctgaaggaagtaataattcattgaatatcaacagaactggtcagtccgtgatcatagagcagtcgcctcaacagtcctggatgtcaaaatttacagagtcacaactaaatacgtgctccaactcatcatcacttccaacttacgggaaagatacattcaatcctaggggaaattgtagcttggattcccagaatcaagcgctttttggtgctaatattgattcttcagggcatctccttccgaccacagtgtctaatggtactactacatgtgctgatttgtccttaatgccacttggggcttctggatatcagaattctttatat

SEQ ID NO: 2026 - DNA, 509 bp, Lycopersicon esculentum
gagagagagaactagtctcggtttttttttttttttttttcgaaaaaagggaatttactcacaaaagttcaactgcattaacaagtttacaaatcaagattcttagtctacatcacatatgtcctgatcctcagtacagcgatcaagattaactaatacaaatagcattgtaatacaaatgacagatggggattaagtctttactacataaagaacagtgtcttagaaacgagaccggattaattaggcgaaagcaaaagaacgccaagctcttgtgaagcagagccacacttggtttatcgaacaacgacagcagtcagtaatcaagtgatcctatagatggaagtccggacatgaaatctcgaccatcagcactattattactgctcatcctttcaggtggaccgcggtttagggatccaacctcctctttccccagtttctgcacatcctcgggtgaaagaattttgatgtaccaaacattattgacaaattcctcccacggatcg

SEQ ID NO: 2027 - DNA, 595 bp, Lycopersicon esculentum
tggctacgtggtgacatgggagaacaagggatgcagtcgcttaattttcagggatttggtgcaactccgtttatgcaaccaagaatggatgcttctatgttaggtttgcaacctgacattctgcaaacaatgacagcactagatccatcgaaacttgcaaatcaatcccttatgcagttccaacatagtattcccaacagttcagcgcctttgagtcagattcagatgttgcagccttctcattcacagcataatctgatacaaggcttttctgaaaaccacttaatatctcaggcgcagatgcttcagcagcaattacagccgtcaaaacttcaatgatcaacagcaattgctacagccacagctttagcagcaccaagaagtgaactcgcagtttcaacatcaatagcaaactaagaccatatctggtctctctcagatggcttcagccacacagccccatctttctcatttgcaagtcctaagttcgactggttccctgcaaaccttttctgatatactgggtaaccatgtcaatgcatctagtaattctaatatgcaaagtctgttgagttcattttcccgtgatggagca

SEQ ID NO: 2028 - DNA, 512 bp, Lycopersicon esculentum
gagaaaacgagtggatgactaaaatatatagaacgaaaaaaggtggttgtagagatgatataggaaataaatcgaggacaaagttgttaaacgaatgaaatgccgaatattaacggtgaaaaggatctctcacgcgctttaaaaggtgagtaatctcaccaatctggccagtaagcattaagcgttaaaaaatgggcatgaaaagaggagccagagggttgaaatgaaactagattgagttggagtgacaaaatgaaatatcgacacatgttaaggggttgtgtatgtatttggctttctttctttctaaaattcgatttgataatatgttggatagaaggatgattacttgctgctgctgctcatgctgctgctactaatagctgtttcaatgtcttttttaacccaagggctagcccatccgaatttgttatacctctttcaaaatacatcaaagctgtatatcacactcgtgtttctgttggaatgcgctttcggatgctatttgaaac

SEQ ID NO: 2029 - DNA, 577 bp, Lycopersicon esculentum
tttgaatttcaatataattggtcagcagcctgtgatcatggagcatcggcggcagcagaaatcttggatggcaaaattcgcaaattcacaattgaacatgggctccagttcaccctctctctctggatatgggaaagaaacttccaattcacaggaaacatgtagtctagatgcccagaatcaatctctttttggtgctaatgttgattcttcagggcttctcctccctacaactgtgtctaacgtcgctactacatcaattgatgctgatatatcctctatgccactagggacttctggatttccgaatcccttgtatagttatgtgcaagattctactgacttgttgcataatgtagggcaagctgatgcacaaactgtgccccgtacatttgtcaaggtttacaaatcagcgtcccttgggaggtcattggacatcactcggttcaatagctatcatgagctacgacaggaacttggacagatgttcgggatcgaagggtttcttgaaaaccctcaaagatcaggctggcagcttgtatttgttgacagggagaatgatgtccttctccttgga

SEQ ID NO: 2030 - DNA, 610 bp, Lycopersicon esculentum
cgtctatgcaggtttacaaatcgggatgtgttgggaggtcactggatatcactcagttccacagctatcatgagctgcgacgggaattggggcagatgttcggtattgagggattccttgaagaccctcaaagatcaggctggcagcttgtatttgttgacagggagaatgatatccttctccttggagacgatccatgggaggcgtttgtcaataacgtctggtatataaaaatcctttcacccgaagatgtgcagaagctgggaaaggaagaggctgaatccctgaaccgtggagcggttgaaaggatgagcagcactaatgctgatgatcgggatcttatttctggaatgccatctcttggatcgctggagtactgattgttggaatgcttcaaaagaagaggactgattctgattctcaatcttctcaagggtcagaaattcaaatttcatgcttcataacctggcttctttagctttcgtctaattggtccatctcccaattgtatgttgtattttgcgtttggatgtagctgtaataggacttaagggttctcccatttgtatggtgtagttatcattgtaatcctgttgtacaagttagtata

SEQ ID NO: 2031 - DNA, 345 bp, Lycopersicon esculentum
tctcgagtttttttttttttttttttttttagtttgttcggatttcatattagagcctcgtttctcttgcttttcggaaaaaaggacctcccaccataagaaaatgatcttttcattgaagaagcactgtccataaccctttggattcttgaatttgaacttgttccctcatttgtttttgtctcaacacacttttttgtagcaattgaagaacccatagatacggaccttcgcattttttgtaatatttcatcctcttttttcgatgtttcatcatcatcatcgttatcatcgttctctacattcgtgttttcttgaaattccccttctctagcctcactgttg

SEQ ID NO: 2032 - DNA, 969 bp, Lycopersicon esculentum
taaaaactctctatttcttttctttttttctcttttcacttataacaacaatcttgatccattaaaaaaaaaggatataatttgaatttaaatttgaattcaaatgaagattcaatgtgatgtgtgtaacaagaaggaagctatcgttttttgtacagcggatgaggctgctctttgtgatgattgtgatcatcgtgtccatcatgttaacaaacttgctagcaaacatcaacgtttttctcttgttcaaccttctcctaaacaagctcctatgtgtgacatctgtcaggaaaggaggggtttcttgttttgtcaacaagacagggctattatgtgtagagagtgtgatattccaatacacaaagcaaatgaacacactcaaaaacacaataggtaccttcttactggtataaaactctcagcaaactctgctctctactctgctccatcacaatcacaatcacaatcacaatcagcaatctcctccgcggattcgtgtgtttcaaatttgaagtctaaggattccactagtaagcctgttgctggttctgtgtttgtttctcccgcgattattagcaacagtactaagggaggagcagtatcatccgctgtggaatcagtgaaagttgttaaagagaaagttggtggatgtaataataatgtgcaatttgtgaatggagggggaaataacttaacaagtagtatatcagagtatttagagatgttgcctggttggcatgttgaagattttcttgattgttcaactcctaatgtttactccaagaatattggtgatgaggatatgttgtcattttgggatactgatcttgagagtcaatttagttcatttccaccacaaaatgttggtatttgggtcccctcagcccctcctctttcagagtcaaagcaagagactcagatccaatttttcccttcacaaaatttgaactttggtgggcaaattggtct

SEQ ID NO: 2033 - DNA, 548 bp, Lycopersicon esculentum
cagcagcagcatcaacaacaccaaataatgggacaaatttcactagtactgaaacaacaacaacaacgactatgaagataaaggtacaacaacaaaagcacaaaataacaaaagtgaatgccaatcatgttgtacccttcaagaaaaggtgcaaatttttaagtagtactactactcctgcacctgaacctggacttgtacctacacctgctcctcgtgttggttcatcatcatcgtcatcattttataataataataacaacgacgtgcaacaaaagaagaagatctgtttcgaagatttctttatgaatttgagcaataacttggcaatccatcgcgttttccctcaggatgagaaggaagcagcaattttgttaatggcattatctagtgaccttgttcatggttaatggcattataaaattttcttgagtttctattattagtttaagttattaattagatggagtagcaccaaattagttgtgtgaaactgagctagaattaatactagtgagagtgagagtttttataagtcaagctacaaa

SEQ ID NO: 2034 - DNA, 614 bp, Lycopersicon esculentum
cggccatcaactccgggagctgcaccatcttcctcaccttttcgcccttcaaatgataatttggatgctcatacaaatgcattgtctgaccaggaattacagttgaaaactcgaagagaaatcatggcacttggaactaaacttggcaaaatgaatatagctgcctgggctagcaaagatggtgaggatagaaatgcatccagcttgctgaaaactgataagcaagaccaaccaaataccactggtactgagacactcgcagctgcttgggaggatgcagagaaagcgaagcacttagcctggtttaaacgagaagacatcaagatacaagcatgggaaaatcatcaacaagcaaagacagaagccgagatgaggaaaactgaggcggaggtggaaaagatgaaggcacgagcacaagacaagctaatgaacaagatagctgcggttaggtacaaagctgaagagaaactggcagcagcagaagccaggagaaacaaacatgctgtaaaaatagagaagcaagcagaatgcattcgtaaaactggtcgattaccacactcattctcctgctgccgctggtgcttctgaagagcttcaaatcactatctaatgcg

SEQ ID NO: 2035 - DNA, 503 bp, Lycopersicon esculentum
ttttgtccatttggatgttgacaagattcatcactacaatttcactcttttctcagagatactgtcacacccacaagcttgaaatcatcctttatggagtatgaaagaatcgacaagagaaatttacagctgtctcctagaaaactgaggtctatgctactgggagcagaaaagaagaggaaacaagaagggaaggatgacgtagtagaagatcaagagcttgaatctgctactgtgtccttgagatcccatttgcctgagatccatgaatccggttgtaatttggagaattacaaagatgtaaatgttgtaagtgttgttcctgagagttcgacttccttagcacttgattcatcaatgtcattggagatgattaatgacacgagaatcaaagatcaatctttggttagtacaagaattacgtctcaagatgacagtagtttggactgtgatggtggaatcgatagtgttggtactgtatctactctctttgaatttcaaaa

SEQ ID NO: 2036 - DNA, 520 bp, Lycopersicon esculentum
caaaatttactcttcttattgccatgattcccaattacacaaattcttcttcttcttcttcatttccttttgaacttactaatgaagttcatcatgattatctaagtcataataataataatatgtctcttgttagcccttataataataactatcaattcgcttcatcatctacaaattcatcttgtcaaaatttcttcaatatttcaactactactaatattcaagatcaaagtggatatgattatcaatttcatcagccacaacaccatcatgaggttgataattttgcttcaagatcaagtggatcacatgatcatgtagacaagaaaaacaagggactcaaattaaccttatggaaaaaaggggggcaaaaagtgaagaatttgaaagtagaagatcaaaagcaacaaatcatagaaactgattatagcagcaacagctcttccaacaacaatatcatcccaattagggtttgttctgattgcaacactactaaaacccctctttggagaagtgg

SEQ ID NO: 2037 - DNA, 159 bp, Lycopersicon esculentum
cttataataataataataataactatatcataccctcatcaacaaattttcaatatttacaaccaccaccttctcctcctctgaaagaacctcttcctctacttagtttaagtcctattcatcaacatcaaggtaattattattcatctactatggaag

SEQ ID NO: 2038 - DNA, 1596 bp, Lycopersicon esculentum
ggttttgttgatgccaaagtcaagaacaaatattattgaacctaatttttaggttcaaacaacttaattttgcctctatataaaagagtcaacaagcataacatgtccattgtaacttgtgaagaagctgctgcaagtttatcttcttcttccaacatgaataatgatactaatggagccttttgctatccacctcaacatcaattagttactcaacaaatcaagaaaaagagaaaccaaccaggcaatccagatccagaagcagaagtgatagctttatcacccaagacactagtggcaaccaacagattcttttgtgaaatttgtaacaaagggtttcaaagagatcaaaatctacaactccatagaagaggacacaatttgccatggaagttaaagaagagagaaaataaagaagtagtgaggaagaaagtgtatatttgtccagagtcgagctgtgtgcaccatgatccgtctagggcattaggagatcttactggaattaagaagcattttagcagaaaacatggtgagaagaagtggaaatgtgagaaatgttcaaagcgttatgctgttcaatctgattgcaaagctcacttcaagacttgtggtactagagaatacaaatgtgaatgtggtactattttctcaagacgagatagtttcatcacacacagagcattctgcgagactttagctatggagagcgcaagatcagtaataaatgaacgaaatccaacaattttctcacctcaaatgaatctccagtttcaacagcctcactactttaatagccatgaacagattcaagctgctacgtttcccatgaaaaaagagcagcaaagtagcgatttcagacatattgagattcctccatggctaattaccacgaattcacaaccatttcagcttggagctattaatcctagtccttcagtaccgctcagtaattttagctcatcgtcaatttttccagctactactaggttagatcaacaatacagtcaaagcagccacaaagatttaaatcttcatcatcagaacccaaaccctaatctcagaggacctacattaggttacgattcaatgggagaatcaggtgtggtctctccagtacacatttctgcaactgcattgctgcagaaagcagcccagtttggtgctacaattagtaacaaagcaagtgctgtcactgctactgctgcttacacaggcacagcaaaaataccccacaatactcacgtgtctgttactagtactgattctgctaccaaacaaactcagcagaaattgtcctcacgtgaagacctgaccactattactgggcctgcaaataatataagtggcatcatgacatctttttctaatggctttgatgggtcaacaatgtttgaagatgcgatattattcggtggattcaacaatttgaattcaaaaaaggagaacgaggacgaagatcaacaactctacttcaatggaagtatgaatgaggaggatcatatattaaccaaagatttcttgggtttaaaacctctctctcacactgatgacattttcaacattgctgctcttgttaatactgaatttaaaaatcat

SEQ ID NO: 2039 - DNA, 1292 bp, Lycopersicon esculentum
ggaactattaattattactctttgctggcctctttcttcttttaccttttgtcatctctagggtttcagacaaagcagccaaatatattttttatatatatatatatataaacaacaaactacatctcttacttacaccaactactctacttttgcttttattttttatgagagaatgataaaaggtatgctaggagatgatagtatgtcaaatttaacaagtgcatctaatgaagcaagcatatcttcaaccaacaatagaattgaaattggtagtcatgttctctacccacaactacaaaacattcaaacccaaccacctcctaacaagaagaagagaaatctaccaggaaatccagatccagaagcagaagttgtagcattatctccaagaagtctattggcaaccaatagatttgtatgtgagatatgtaacaaaggatttcaaagagatcaaaatcttcaactacatagaagaggacataatttgccctggaaattaaagcaaagaagcaataaagaagtgaagaagaaagtatatgtgtgtccagaagcatcatgtgtacatcatcatccatcaagagccttaggggatctgactgggattaagaagcatttctgtagaaaacatggtgagaaaaaatggaaatgtgaaaaatgttcaaaacgttatgcagttcaatctgattggaaagctcactctaagatttgtggtacaagagagtatagatgtgattgtggaacccttttctctaggagggatagtttcattacacacagagccttttgtgatgctttaacagaagaaagttcaagaacaataatcccaccaccaaattcttcaacttctcatcatcttaatcttcatacacttcaaaacttccaaatgaaacaagaacagcaacaacaaaataacgacctctcctctcagttattcattcaaaaccctaatggcaatagtagtaacatgttcggtgcaccacctcctcatatgagcgcaactgcattgctacaaaaagcagcacaaattggagtaacttcttcttctcatactgctaataacatgagcgccacaacttttttcagtcctactaccagtacaacaactggcattgcaatgtcaggatcaggatcaggagcaggagtagcacgtcaatatcatccatttgaaaataataataataataataatacaaacactgattttgttactggtaatacgtcttttcctgattttggtgcgagtgtcacccctgggttcatggaacaagtccatgacatgcaaaacatga

SEQ ID NO: 2040 - DNA, 702 bp, Lycopersicon esculentum
ggaaaaaacaagatttgtttgttgggttgatgccaaaggaagaagaaaccacaagactggagagttggtagattagcttgaagagggagacgaaagagatcaagattatgatgatgaaagatttaatgaatcaacaagctcaagtacctggtgttgttatggaggagaacatgtccaatttaacttctgcatctggtgaagcaagtgtatcttcttcgaaccgaaatgataataataataataataataataatatttatcctcatcatcagtataactttgctcctccaaatcaacaaactcaacctgcacaacaaatcaagaagaagagaaatcaaccaggcaatccagacccagaagctgaagtgatagctttgtcaccaaagacactaatggcaaccaatagatttgtttgtgaaatctgtaacaaaggatttcaaagagatcagaacctgcagcttcacagaagaggacacaacttgccatggaagctcaagcaaagaacaagcaaagaaataagaaaaaaagtgtatgtttgcccagaaactagctgtgttcatcatgacccagcaagagctctgggagatctcactggaatcaaaaaacacttctgtagaaaacatggagagaagaagtggaaatgtgagaaatgttcaaagcgttatgcagttcaatctgactggaaagctcactccaaaactt

SEQ ID NO: 2041 - DNA, 400 bp, Lycopersicon esculentum
  misc_feature (308)..(308): n is a, c, g, or t
  misc_feature (316)..(316): n is a, c, g, or t
acggtcaaacaacttaattttgcctctatataaaagagtcaacaagcataacatgaataatgatactaatggagccttttgctatccacctcaacatcaattagttactcaacaaatcacgaaaaagagaaaccaaccaggcgatccagatccagaagcagaagtgatagctttatcacccaagacactagtggcaaccaacagattcttttgtgaaatatgtaacaaagggtttcaaagagatcaaaatctacaactccatagaagaggacacaatttgccatggaagttaaagaagagagaaaatnaagaagtngtgaggaagaaagtgtatatttgtccacagtcgagctgtgtgcaccatgatccgtctaaggcattatgagatcttactggaatt

SEQ ID NO: 2042 - DNA, 652 bp, Lycopersicon esculentum
gaatcagttggtagattagcttgaagagggagacgaaagagatcaagattgtgatgatgaaagatttaatgaatcaacaagctcaagtacctggtgttgttatggaggagaacatgtccaatttaacttctgcatctggtgaagcaagtgtatcttcttcgaaccgaaatgataataataataataataataataatatttatcctcatcatcagtataactttgctcctccaaatcaacaaactcaacctgcacaacaaatcaagaagaagagaaatcaaccaggcaatccaggtttgaattcaaagctttttgaagtacttttgttatatgcttttttttgggttatgaaatcctttcaactttttcttttcccctttttgggaccaatcatgtggtaacagacccagaagctgaagtgatagctttgtcaccaaagacactaatggcaaccaatagatttgtttgtgaaatctgtaacaaaggatttcaaagagatcagaacctgcagcttcacagaagaggacacaacttgccatggaagctcaagcaaagaacaagcaaagaaataagaaaaaaagtgtatgtttgcccagaaactagctgtgttcatcatgacccagcaagagctctgggagatctcactggaatc

SEQ ID NO: 2043 - DNA, 569 bp, Lycopersicon esculentum
gctctcaactaacattatatccacattcatgtttgaagtaaaacatcatggcttgtatagatcaagaacaacaacaacaacaaccaatttataagcattattgtagagtttgcaagaaaggttttgtgtgtggaagagctttaggtggacatatgagagctcatggaattggagatgaaggtgcaaacatagatgatgatgatccagctagtgattgggaagataagtttggagggggtgttaagggaggtaataagaggttatatcaattaagaacaaaccctaatagacaaaaaagcaatagagtttgtgagaattgtgggaaagaattctcatcttggaaatcatttcttgaacatggaaaatgtagctcagaagacgcggaatccctagtgtcctcgccctgtttagagggcgaggactacattaataatggtggaagaaaaggctatggatggtctaaaaggaaaaggtcattaagaacaaaaattggaaccattaatagtactacttcaacttatccatcaagtgaagatgaagatcttgtccttgcaaaatgtcttattgat

SEQ ID NO: 2044 - DNA, 542 bp, Lycopersicon esculentum
tgaagaagttgatatgattatactaaatacaaaaagtagatcataacaagaaattatatcataaactatagttatacatttaagtataaaaaactttatcaaatattttttatttcacaattcttattaaatctaaaaatcataatttaactaacaatataatcatatcattcaattaattttctctcttctatatcactttcaaataactttgaacttatttaccatagataaggaaccattttgttatttttttattttttttttaatttatatatacatgatacatccttttaaattttttaaatatttttttttaacaagacaaagtgatttatacaaacttctaaagtattgctattttctagggctgaagaaattggagaaaaagtttgtgtttggtgttatggaagatgaagatttgttaggttgtaacagtgagaagaaaaatggagaaataattgagaaaactaaaattagtaatagtaatggtgtagagatttaagagctacagctttaactatggtttctgggtttagatt

SEQ ID NO: 2045 - DNA, 625 bp, Lycopersicon esculentum
ctcattcctcttcctcctatatcttttctctccgccccattttcactatcacaaatcaaagcttccaaaatttagaaattgtatacaaaaatggaacttctgtcctctaaactctgtgagctttgcaatgatcaagctgctctgttttgtccatctgattcagcttttctctgttttcactgtgatgctaaagttcatcaggctaatttccttgttgctcgccaccttcgtcttactctttgctctcactgtaactcccttacgaaaaaacgtttttccccttgttcaccgccgcctcctgctctttgtccttcctgttcccggaattcgtctggtgattccgatctccgttctgtttcaacgacgtcgtcgtcgtcttcgtcgacttgtgtttccagcacgcagtccagtgctattactcaaaaaattaacataatctcttcaaatcgaaagcaatttccggacagcgactctaacggtgaagtcaattctggcagatgtaatttagtacgatccagaagtgtgaaattgcgagatccaagagcggcgacttgtgtgttcatgcattggtgcacaaagcttcaaatgaaccgcgaggaacgtgtggtgcaaacggcttgtagtg

SEQ ID NO: 2046 - DNA, 1373 bp, Lycopersicon esculentum
gcacaagcaggatgatgatggccttgatactttgtccattcctgtttcttccagagcaccctcatcatcaggaggaggggaaggaaatgtctgggcattgatacctgatctaggaaataaattacgggtacaccaaaagagagcctttgagtttctgtggaaaaatattgctggatccatagtacctgcagaaatgcaaccagagagcaaagagagaggtggctgtgttatttctcatactccaggagctgggaaaaccttacttattatttccttccttgtaagctacctgaagttatttcctgggtcacgaccgttggtccttgctcccaagacaacactctacacctggtacaaagaagtactgaagtggaagattcctgtgccagtctaccaaattcatggtggtcaaacctttaagggagaggttctaagggaaaaggtgaaattatgtcctggtcttcctcgcaaccaagatgtcatgcatgtcttggactgccttgagaaaatgcagatgtggctttcgcaaccaagtgttctcctcatgggttacacctctttcttaacactgacacgggaagattcaccttatgcgcataggaaatatatggctcaggtgttgcggcagtgtccagggctactaatacttgatgaagggcacaacccaagaagtacaaaatcccggttaagaaagggtctaatgaaggtcaatacacggcttaggattttactttctggtacattatttcagaataattttggagagtatttcaatacacttaccttagcaaggccaacttttgttgatgaggtcttgaaggagcttgatcccaagtacaagaacaaaaacaaaggtgcatcgcgcttttcattggaaaatcgagcaagaaagatgtttattgataaaatttcaactgtcattgattcagacatccccaagaaaaggaaagaaggcctaaacatattgaagaaactaacaggtggattcatagatgtgcatgatggtggaacatctgataaccttcctggtttacaatgttacaccttgatgatgaaatcaactactcttcaacaagagatcttggtgaagcttcaaaatcaaaggcccatctataaaggatttcctctggagttagagctgttgattacccttggtgcaatccatccttggttgatcagaacgacagcatgttctagccagtacttcaaggaagaggagctggaggctctccagaaattcaagtttgatctgaagctgggttcgaaagtcaaatttgtgatgagcctaattcctcgttgtctcctcaggagagaaaaggttttgatattttgccacaatattgctccaattaatctttttctggagatatttg

SEQ ID NO: 2047 - DNA, 450 bp, Lycopersicon esculentum
aaaattctcctctgacctgacatggttaatgactgcatctgtcctgaaagaagctacatttgatgtgagatcgatacataaccagattgtctatgagattgtggatgatgatctagtcagaaaagaaacaaattctaaccaacattcttactcagtgaatttcaagttagaaggcggagttcaaacaaccactgctattcaattcaatagggatatcccagatataaattctaccagtgaccttagtgaatccgggcctctagttctgtatgatctaatgggcccacgaaggtcaaagcgtcgatttgtacagccagagcgttattatggatgtgatgatgatatggcagaatttgatgttgagatgacaaggttagttgggggtaggagaaaagtggagtatgaagaactaccacttgcactttctattcaggctgatcatgcttatcg

SEQ ID NO: 2048 - DNA, 975 bp, Lycopersicon esculentum
gagagagagaactagtctcgactttcaccaccacattcaagaacttgcagcagtaatccaaatcccaatttctccaaagaactcaaaatcccagaaaaaagataaaacacaatgaaagctgtgaagggtcatcaagaagaggaagaagaggaggaagatgagactggtattgttaagaaggatgccacaccttctagcagtaataccaaagatgggaagagtaatgagaaggctagtgccctaaggtctaaacattcagtgactgagcagcgtcgaaggagcaagatcaatgagagatttcagatattgagagatctgataccccatactgatcaaaagcgagacactgcatcattcttgttggaggtaattcagtacgtacagtatttacaggagaaggtacagaagtatgaaggaccatatcagccttggagctcagagcctacaaagcttatgccatggagaaacagtcattggcgcatgcaaagtttacctgcacagccacatgccttgaagaatggtagtggcccagaatcaacatacctgggaaggtttgatgaaaatctcgctactgttacttctacgatgcaaccaaatcagcagaatccaattgaatctcatactagcagggatgtatcatttaaagcacttgatcaacaaaatgaactagctaacaagtcaatcacaacacccattcctcttcaggccggtatgaagatgtcagtgccaaacaatagtgctttctcagagcctcaacccagaccagtgtctgatcaatgtcctaacacaattgatgctctgaatcatgacgaggatgacgtaatagatggaggcagaatcagcctttcaagttcatactcgcaggggtttctaacttcgttgtcgcaagcgctgcagagtactggtctagatctttcaaaggctactatctcagtgcagattgattttgggaagcgcgcaaaccaagcaatgacc

SEQ ID NO: 2049 - DNA, 544 bp, Lycopersicon esculentum
gccaataattagctatacaactcacatttctctgtagtatataagttttgcaagtgttgttaataatcggagccttttagcgaaatcgccagtctctctgtttaatcttcttttgttaacagctaataagttgttatttcgactgaattttgttagctggtttcagattttgaaatggtgaggactgtgaagaatcatcatgaagaggacgaagaagacgatgaagagttttcatctagaactcccgatggctcttctcaaaaggggaaattagaagggaagagcaatgatgggaaggtaagtgctcatcgttcgaagcattctgagacagaacagcggaggaggatcaagattaatgagagatttcagactctaagagatctcataccacaaaatgatcagaagagagaccgagcgtcattcatgttagaggttatacaatatatccagtttttgcaagagaaattacagatgtatgagggaaccaaccaaggatggagtgcagaaccctcgaagttgctgccatggagaagtactcctgggc

SEQ ID NO: 2050 - DNA, 520 bp, Lycopersicon esculentum
aaataaaatcttaaaatcttgaaaaaataagatgaaatctggaaagggtcatcatgtggaagaagaagaggatgagtatgattttggttctaatagagatgccacaccttcaagtaatagtactaaagatgggaagaacagtgacaaggcaaatgcaattaggtcgaagcattcagtaactgagcagcgccggaggagcaagatcaatgagagatttcagatgttgagaaatttgataccccatactgatcaaaaacgagataccgcgtcattcttgttcgaggtaattcagtacgtacagtatttacaggatacagtacagaagtatgaaggatcatatcaaccttggagctcggagcctacaaaacttatgccatggagaaacactcagtggcgcgcgcagagttttcctgcaaaccctcaagccttgaacaatggtactgacgctggaccaacatattcaggaaggtttgatgagaatctcttaaccgtcacttcgtcaatgcaagccaatcagcgg

SEQ ID NO: 2051 - DNA, 780 bp, Lycopersicon esculentum
taagccgacaacagttcctatgcacccaaacacgttttcattttctgggactagtagcacggcagcgctttattcatcaaagctgatagctgatactgataagttggagtcaaagtctcattctcaattttcacttagcagatcgcatatgactgattatgctattccaaatgctaatccagaaaggctggagctgcctatagaaagtggtaccatcagcatctctagtgcctattctcaagggctattgaacaccttgacacaagcgctgcatagttctggagtagatttgacccaagccaatatctctgtgcaaattgatcttggaaagagagcaaatgggagagtaaattcatcagcttccactgttaagggtgacaacgtttcaacaagcaatcaaccaattccaaaatctagagttacaaccacaagggaggagcctgatcacgccttcaaaaggcggaaaacaagctaatgctaatttgaaacactagtgttctttcttcttttttttccattggttaaatttaattgttttcctctttcccttccccttctcaaccaatatcgatgtccacacctgatacagaaaatctcccaaatgagagatcacaagccactgtatatgtaatgaactagtactactactatttttctgccccttcaaattgttgggctgcacaaatttacctgactagagtgtgatattttattacttgggtagtaaactactgtattaatttattactaaggctttcaatgatgatgatgagacagctg

SEQ ID NO: 2052 - DNA, 1252 bp, Lycopersicon esculentum
  misc_feature (1088)..(1088): n is a, c, g, or t
  misc_feature (1206)..(1206): n is a, c, g, or t
  misc_feature (1210)..(1210): n is a, c, g, or t
  misc_feature (1212)..(1212): n is a, c, g, or t
ttatagcaagtcagagtatccactttctcattatgcaaaaatgtttggactgcaagctgcagtagctatacgtctacgtagtatctcaactggttcatctgattttgttttggagttctttctaccctcagactgcagaaatcctgaagaccatagaaaaatgcttacttcattatccatcatcatacaaaatgtttgccggacattgagggttgtgacagataaagagttgcaggaagaaactatatctgtgggagaaatggcaaaccacacagttgaacaacataaggagcacactgaaacctctcaagaaaggacatcgtggacctcttgtgacgcagagttccaggagagttctgttatgtctacattccaggatgaaaaaccagatgaaatgctaaggaaagattcggtggagtttaggcaccgtaagaattctgcttatgaggagggtgtctctcgtaatctgggtaaaacgggagacaggagacgtgcgaaggctgagaagactattaccttgcaagttcttcagcagtattttgctggtagcctaaaagatgctgcaaagagcattggtgtttgtcctaccactctgaagaggatatgcaggcagcacggaattaaacgctggccttctcgaaagatcaagaaggttggtcactccttacaaaaaatccaacgtgttattgattcagttcagggtgcctctggcactttacaaattgaatccttctattcaaacttcccagagttggcgtctccgaatgcatcaagaatgagcccttttgcagactcaaagtcaaatgaacatccaacagccttgaacacacaacaagagagatgcattacgagccccaatcctgatgcatctaagtcaccctcttcttccagcagtcgaagttcaagttcaagtcaatgttgttcatccgggacaaaacctcaatcgcctcaatctcaccctttgagtattgttggcgatgaagatctaatcgtacaggaagagtctgtagataatgcagtgaaaagggttaaaagtgaaccagagcttcatttatcaagtgaagcactgaagactataccaagatctncaaagccatttatgtgttgctgagaatcctatatcagaaaaccttgtattgaaggaggagtccatcaacatctcaagaagaagctccacgagtaaaagtaacacatggagaagaaaanattnangttccgaatgcaaaacagttggagataccatgatcttcta

SEQ ID NO: 2053 - DNA, 456 bp, Lycopersicon esculentum
cggtttggcatagatgatcctagtggacttcaactcaagtaccttggacgatgactccgagtgggttctattaacatgcgatgcagacttggaagaatgcatcgatgtttgtatgtcttcccaaatccaaatgatcaagctcatcttagttcaagattcacagcatcattttggaagctctttcggtagcagcagtcctatattagtacagtaaccaactggtataccccctagttgccaaaatggatatagttcccttttaggattagatttggtatgagacttgaagaaatgttgcttgcttaattgtaaattcattctgtttgagtcttcatgtaagtcaatccttttgactgatatgaactagtattgagccgtaaggctattattgtttcatctagagtactcaaaactcattatagtttcaaagtttaataatttgttgaaattttagtt

SEQ ID NO: 2054 - DNA, 593 bp, Lycopersicon esculentum
tccgaaaattgtacatctatggctaataattctactcccaccgacgcttctagcaagaaggtacggaaaccatacaccataaccaaatctagagaaagctggactgaagaagaacacgacaagtttctcgaagctcttcaactgtttgaccgtgattggaagaaaattgaggatttcgtaggctcaaagacagtaattcaggtacatttgtaaagctttgcttacaactttaagctctttggagttaattgttggtgtgtgacatgcattcaaacgtacctggtatataatctagagccgacttattcaatgggaatttatttggccatgtgttaatgtgcgcgatcttttgtattctattaggccctttttcattattcaatttggagaaacttgtcatgaattcctttcgttctgttttggttcagagcacttggcatagcataacgatgtatagagtatgctatgtatgtatacatggaaaatctgtttatatggaacatttgccctaatattatcggttacagattcgcagtcatgcacaaaaatacttcttgaaggtccagaagaatggttcaatagcacacgtgcca

SEQ ID NO: 2055 - DNA, 480 bp, Lycopersicon esculentum
gaaacaacccagcgctcattttcacttctccatcacaacctaacaccgccgccgccgccgccaccaccggagtacccacacaacacctacttctccaattatccagcaaacgagcctactgaaacctctttctccggcgagcttttggctccattgaaccgtcaacaacaacaacaaagccacgagctccggtgagcaaccaaacagtccccagtgaactcgtgagaaacaaccggcaaagcccagctgcggcgacgtcgtctcaggtgaacctccgagctccgacggactcgtgatccaaccaccaacgtcgaaaatagacgacctggaagctccaaacttcagcaacacggagaatgaggtatttgaagccatccaacttgtttcatgaattactgaagtcaaatgcacttgccagtagccgtattcttgggttggatgtgggtgataagtacgttggtctagctgtttcggacacaa

SEQ ID NO: 2056 - DNA, 2282 bp, Lycopersicon esculentum
ctgatttttgcgtccccctctctctcacatctttgctaccccagaagatgaaccctactaaattttcaattttttttattttcatgtaattctttcacagtatcagatccttaaaagttttcttcaatttgttcttgcaacctgtttgattttccctcaaagtttcaaactttaaggcaatttcaagaacaagattccattttttgaggtaagggagttaaagggtgttctttttatttatttattggaacttaatctgttggatgttgttgatttttagatgggttttggttgtgaaggtgtttgatttgctcaaaccaaaaaaaataatcatttcttgaaataagggagttaaacagcaggtatctcttctgattggaaaatgaaaagttctttgtttttttgggttgtttaggggtttgattaagtttccagttttaagaggtgtttgagtacaaatttcccccttatgaggtaaaggattatagggttttcctttgacttgtgtctgagaagtttttgtatggattttgggtttctgtaggcataatttcttgaatttgatagagggtttcaattgtgtctgagaagtttttgtttggattttgggtctatgttggcatattttcttgaatataacaaggttttcaattgtatgtgagaagtttctatttggattttgggttgttgtaggcatattttcttgaattagataaaagggattttgcttgtatctgagattgtttttttttaattaggtttttgtgatggtataaatatgatggagaaacttgttcatctagttgctaggaataaagtgttaatttggagttaaaatggattgaaattgatcaagaaaacattgtgcttggaagtttaacttagactccctctaggtatttgtgtgtcgtagtagttgatacttggttggtttcttgtgcttcaatggatgacattgaggataatgggagatatccttccaacccttatggcatgaaccagggttatgagtcatccaatcgccagaagcttcctgttcacgacccttcttattcaaggcatgtcgacaatcagtatgtggaggaggcggatgatgatgaagaagttgatggcgaagaagaagaagaagatgatgatggcgaagaaaatggtgttcagcggatagggaaagatgtgtttgatgacgatgacgatgatgatgatgagtatggtgatttgcagaggcatcaaaagaagaggaagttaaagagcttgttatcaagttatgagtttgcacctcgagtaccaccaccatctactacagctgcaactgctcctaagccttcatttggtggtaggaatccactttcagattggtctgaaaatgagacatttattttgcttgatgcatggggcactaggtttgttcgacatgggaggaagagtcttcgatcagaggaatggcaagaagttgcagacagagtgtcacgggggtccaaaattgagaggacagacacccaatgtcgtaaccgtttggatactttgaaaaagaaatacaaaaaggagaagatgaagtttgcagagactggaagtagcactagcaagtgggtgtacttcaaaaagatggacatgttactaacatcaactccccagaaagctggtgtttcatgtggaatggactctggagagtatgttttcatgagcccaaaagcttatctgaatcgtgctaatggcttggatgagatgagggacagtcctgctaactcataatctgctgatggtgaggaggatggttcagaggatcttccaccaaaaagatcaagaaatgtacaaccaggagggaacgggaatgggaatggacattctttcaaattaatagcagattctatccataaatttagtgagatatatgtgaagattgagaatagcaagagacagcaaatgatggaactggagaaaatgaggatggacttccaccgagaattggaactccaaaagaggcaaattatggagagagctcaggcagaaattgcaagaatacgtcaaggaagtgatgaagagaacgacatgtctgctgaaaatgttagtggatgacaagccagattatctctctattcgttgtatgttggctattttccactgttgtattatatcttgcattttagtttctcaccattgatggctatatgcaaggcaacttaatgtgatgtaagaatgtatctggatgttgtttcaacagtcaataataacattatggaggtctgttaacctaaaaaaaaaaaaaaaaaactcgagggggggcc

SEQ ID NO: 2057 - DNA, 656 bp, Lycopersicon esculentum
ctgatgtgaattttgaatcatcaaaaaccctaagagaagggatcttgaaaaaacccagtatttgttcactgcatatttgattgatatgaatgattctgatgatgaaactccatactcttcaagacccggcgctgccatttacaatacgtcttctcttcgatcaagacgctcaattcgaaaccctacctcttatcttagaaatacccattatgagtataataacgaatttcaatataaccatcatggtggtgctgctgctgcccatgatgatgatgaatctgatgatgaagaagaaaatcaagaatttagcagtggagaaaatgatgttgataattttcaaggtaagaagaagagaaagttggaaactttagtttcaaattacaattttgcccctcgttcaggttcaaaggatatttggagtgaagaggagagttttgtgttgttggaagtgtggggtgagaggtatttggagctcggacggaggagcttacgtgctgaagattggggtgaagttgcagagaaggtaacagaaatggttggtgttgataaaactgaagttgagtgtaggaatcaattagatgtgctcaagaagaagtataagaaggagataacaaaaatggagaaaactggaggtgggtttcatagcaagtggacat

SEQ ID NO: 2058 - DNA, 540 bp, Lycopersicon esculentum
agtcccatctctcaaggcatcaaattgtttggtgcaacaatagaaattcaagaaaaacaagccaaagctactcatcaaccaacaaacaaagttgttgttgatgatgatgatgataatgatcaagaaaaaaggccagacaagatcatcccttgccctagatgtaaaagcatggaaacaaaattttgttacttcaacaactacaatgttaaccaacctagacacttctgcaaaggttgtcagagatattggacggccggtggagccctacggaacgtgcccgtaggagccggccgtcgcaaagccaagccaccatgcgggcccggcccgcatggcgacttggctgacggttgtaatctatttgatgtggctaatcagcttgactttgatggatcagtggtggctcatgaagatcaatggcatctttttccggcagctaagaggaggagaagcacctccgatagccaatcttattgattccctctttgtcgtttagtaattatatattttatgtacgtggaattagtaaatggttaattaatt

SEQ ID NO: 2059 - DNA, 521 bp, Lycopersicon esculentum
cttggatcctgccttgttagtcatccgtagagctaaagggaattttggaagccattcccattcccacacaccaataccaaccagggtggctgttcagtcagtcctacccctaagagaaaggagaaattgcttgcgcgcttcgtcaagtaatagagaggatcttaggccgaacagatcaccggctccgaaggcctgcaatcgtgactttagttccggtggttcgatttgctgccggggtgcaacatttgtgagacttcgaatggagtggaccgtacgcccctgccgctcgccaagcctgaagaaaggagcaacttagatacctctttgttaactatattcctggtttgctaaaagggtccttgggcccaatcaatctctatactcttgatgcaatggactccccaaagccactaaaccgttctcttccacccgatttgaactgaacctcgttctagtgatattttctccctttggaaactgaaactcagttgcctatctgatccttgggctaattgggcctt

SEQ ID NO: 2060 - DNA, 521 bp, Lycopersicon esculentum
aaaaaagtagatttttattttttaatttcaaagaaaaaaaaaaggattaaaatggtggaaattatttcaccaggatttagattttatccaacagaagaagaattaatatctttttatttacataaaaagcttgaaggaaaaaagccagagcttgatagagtaattccagttgttactatttatgattttgatccttggcatcttccaaaatttcatggggaattgtgcatgggagatagagagcaatggtttttctttgtgccaagacaagaaagagaagctagaggaggaagaccatgtagaacaacaaattgtggttattggaaggcaactggttcaccaagttatgtttattcatcaaataataaagttattggagttaaaaaaagtatggtattttataaaggaaaagcaccaactggtaaaaaaactaagtggaaaatgaatgaatatagagctattcaagaagaagttaattcaactcttgctattccaaagttaaggcatgaaatgagtttatg

SEQ ID NO: 2061 - DNA, 348 bp, Lycopersicon esculentum
tagagagaaatatatatatattatatacatacataaaaaaaaaatattgggaaaaatggagaataatgtgtatgataattataatcataataataataataatgtgttaccaacaggatatagattttatccaacagaagaagaattggtggaattttatttaagaaataagcttgatggaaaaagagatgatattcaacgtgttataccgaaatggcaggagaagtgattaaacatgacacggagcaatggtttttcttcattccaattcaagatagggaagcaagaggaggaagacctactagacttacaacacaaggatattggaaaagctacaggtactcctgg

SEQ ID NO: 2062 - DNA, 395 bp, Lycopersicon esculentum
ccttgacaaagagttagtggagtaactacctaggagtaaattcaatagtagaccttgaaaagaactttagcaaagtcatcataaatgctcttcacgtctcatgtactatgttaaggaatggtcacatttctctctgcattaaagctagttcatgttaaaagttgaggccggtagtagtttcaactttcaatttaattccacctttcctggcccacttctgtacggaacaccaatcagaatctttagttcatcttaacaccaaagcatctccacttagacacttactagacttcacataggaggaaaaatatggaactggtggtcctcacacgttctcctcacagggatggaaactaacaaatgggaagggaagagaagcattactgaagctgaaa

SEQ ID NO: 2063 - DNA, 362 bp, Lycopersicon esculentum
gattctctgtgcctagatactgtgcatagacaatatttcctaggttggattacacggctgacccgcctgtgcagaccgtgacagccaaagatgttcatggtgaaagttggaagtttaggcacatttatagaggtactcccaggaggcatttgttaacgactggttggagtagttttgtgaatcagaagaaacttgttgctggagattccattgtgtttttgagggcagaaaatggagaactttgtgttggaattcgtagggcgaaaagaggtggtattggtgggcctgaagccccatctggatggaactctggtgctggaaattatggtggattttctgcgtttttgagggaagagatgagc

SEQ ID NO: 2064 - DNA, 191 bp, Lycopersicon esculentum
taggaatgaggttgaatttgatgatgatggggttgttgggatgaatggttcggataaccaagataagcctagttcatttgctaagacgttaacgcaatcagatggcgaataatgggtggaggtttttctgtcccgaggtattgtgcagagacgatctttcctcgtctggatactctgcggatcctcctggt

SEQ ID NO: 2065 - DNA, 409 bp, Lycopersicon esculentum
gaaactcaaaaaaaaaaacaaatctttctccaattgtcccttcttttttttttagccctctaaagttttcgcaattagaaacaaaattaagtttttcaaactgtctataactcactaaaggcctcgggtttcttcattgatcctctttttttctctggatcagtaaaaaaaaggggcaattcctctgttttactctgttttcctgaactctgttctctcattttatgaagttattataaatggacagaattcaagaaaacaactctatgtctagtatatttgatgagggtgctcaaattcgatcttcattatctcaactaattctaacaagtagtacaaacacattcgatacaattttttctcattgtcaagaaaataaccaaatgagtaatagtcctgtttttgagcc

SEQ ID NO: 2066 - DNA, 1096 bp, Lycopersicon esculentum
gaagagatcgtcgtgtaaggctttcagttcctactgctattcaattatatgatcttcaagacagattagggcttaatcaaccaagtaaagttgttgactggttgcttgatgcagctaaaaatgaaatcgatgaattgcctcccttgcaaattcctcctggaagtttgaaccctaatctttatcctatgttaggtaatgctcctcaaattactactaataaagaaggtcgcattaattgggataataacattccattggaaccacctaataataatgctttgggctacaatcccaatttttttaaatgggatccttcaaatttatccttagctcattcagaaaattcattatctcatcaacatgatcatcatcaaaacttcaatttgatgtctagtatgccattaacttcacatcatcaacctgttgtttatccaccaggattgcctcaatttttccatcaacataataataatattaatgttggagcatcgtcgtcatcagaatttgatcccaaagaaatcaacttccaaatgttgagtaacaattccggttcagaaaatcccttgtcaactagtactaattcctttagacattctattgactccacaaaccaatctataagacctttccattttctgccttctcaaaattgtgatgacacggagccttccaattaagatcatttacttcctctctgctctttataacaacttaagtttttacacaaagtatcgtattggtcatataatttcaacatgataacagagcagatcaacatattattggttgatcggatgtttcattaagctattccactttcaagatcagagcaagttatcaactgtatgttccccggtgagtactgaataatttgatactagtatatatatatatatatatatataacaacaattgtatgttcttttggtcataattattcctatagctacaagactcgtgattggattgtttgggatgcttcaatgtactccaatttcaaaatgtattatgctatataaagttgtacgttcggttattaaaagacaatataatatatatatttttggccccaaacaaaaaaaaaaaaaaaaaaaac

SEQ ID NO: 2067 - DNA, 628 bp, Lycopersicon esculentum
acagaagactttaatgccattaagagattcttgtgagctgcaaaatctgacttgagttcaatttcatccttcctcaattccttatacatagatatcttttcatcctcaacgcgtcccaagaaatagtgtatcagatcaacagcaacaacaacaacagagacatcgaggattcagtcttttatatatctattgatcaatgatgaagaaaagagtgattagtacttgatcattatgaactcaagaaagcaagaaactggttcaggggttgataccaacaacagtaaaacaacgtcaacgactactgctactactattccatcaagttcttcttcaaggcagtcatcttcatgggggaggagggtttaaaaatccaagaatagtacgcgtatcgcgtagttttggagggaaagataacacagtaaagtgtgtacagtaaaaggattaagagacaggagaataaggctttcagtaccaacagcaattcaattgtatgatcttcaagataggcttgggttaagccaccaagcaaagttgtagattggctaatagatgcaactaaagatgaattgataagcttccacctttacaaataccaccaccatcactctctcatttcttcagtacgaaa

SEQ ID NO: 2068 - DNA, 738 bp, Lycopersicon esculentum
  misc_feature (673)..(673): n is a, c, g, or t
gctagaatctcgctatacgaatactcaatcgatttatgttcatgtactgctattttgttaattgtccgtttcaatatacaattgtgatcaacaggttgttctgaagtttcctccctcagtttttgatgggtgcacctaagcaaaagtggacttcagaagaagaagctgcccttaaagctgggatacttaagcatggaccaggtaaatggcgaacgattctcaaggatccagaatttagtggagtattgtgtttgcgttcaaatgtagatctcaaggacaagtggaggaacatgactgtaatggcaaatggctggggttctcgagagcaagcaagattggctgtcaaaaagatgagacaggcccctaagcaggatgggagtcctttgactgatactactgctgctgatagtgatgaggaagcagctgaaacaaggactgtcacaacttctagtggttctcctcagacacatggttcaaaacgatctatgataaggttggataatcttataatggaggctataaacaccttgaaggagccaggtggttccaacaagatcacaatagctgaatacatagaggaccagtactgggcacctccaaattttaaaaggctactgtccgggaaactgaagtatttaactgcaacagggaaacttatcaagatgaagcgtangtatagaatagtacctatgtcaacaccatctgacagtagaagaaacctgtcccttccacttttgg

SEQ ID NO: 2069 - DNA, 748 bp, Lycopersicon esculentum
gctacaaactttaaaaggctactttcagcgaaactgaagtatttaactgcaactaggagacttgtcaagatgaagcgaaagtatataatagcaccaacactggtattatctgacagaagaagaattccttccgttcctctcttggaaagcagccagaggatctcctcccgggttgatccggatgatataaacacacttactaaggctcaagtagattttgagttaactaagatgaggagtatgacacctcaagaggcagcagtagctgctgcacgagctgttgcagaagcagaagtagccatagcagaagctgaggatgctgccagagaggctgatgctgctgaagctgatgccgaagctgcacaagcctttgcagaagctgcaatgaaagcactagaagggagaagcatcccaaggatgatgatccatgcttgatgggatcttccagagttgtggcttgatactatagctttgatggattttttccattttgttatttttcaaacctttagccagctacttgctggcttgtaaatttggtaaatagttgtggaaatgtatacactgtttgtgatagtaaagcctttccggtaaatagcataaaaaaaaaaaaaaaaaacttcgagactagttctctctctctttttttggagaaattgtgcgatttttggaagagagagttatggagtagaacattgaagtttgaaaattctcgcgatgacgtttgatgaagtgtcaatggagcgaa

SEQ ID NO: 2070 - DNA, 608 bp, Lycopersicon esculentum
ggccttctccatttttcttcattcaacggcatctctctcaaattcgccggaatatactccaccagcggaagaagattttagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcac

SEQ ID NO: 2071 - DNA, 508 bp, Lycopersicon esculentum
caattatgcagcttatgaatgtggaaggattgacgagagagaacgtagcaggtcatttacagaaatacagattgtatacgaagagaatgcagccgaacgagggtccttcttcgtctgatcatttgttgacttccacaccggctacagagattatgcgtgagtccagtgagagtggtcacctccgcaatactaatggccacatggcaatgccaactctgatgccgtaccaacaacaaatggtggcgatgccaatgatggggatgccaaatggaggacatgtaggcatgcctgttggttacgggggtggaccgccacttgggtttcatcatcactataatgtggtgcaacagcgggattggtctggaaataattttggttactatcatcctgttgcttctaatgataagtagctccacaagctgggacctggatgatgtcatttgatcgtggaggaatcatggcaggttcatgaagtgttgttctctggtaaaatgtgggacaaatatga

SEQ ID NO: 2072 - DNA, 1236 bp, Lycopersicon esculentum
gggaaaccctagttccggcaccccccataaagctttactcttttggctttcttttcagttttccgttcgatccgcttcggaattcaacggacttttcggcgagttcaccgtgcgcgaagaggaattgacgatttccggtagagaaacctctcctgttatctgaagaattgtcggtcgacgggcggtcggttggtcgtcgctgattggattcgattcaattcaatcgatctgaagaatccggtgttctataaacccatagaaagcttctgagtttatcggatagaatcatcaacctcttcaagggtatccgctaagagagacgcccggcgtgattagatagatcggatcgagatcgtccccagtcgaaggagtagcggtagcagtggtttgattttggttataataagcttgcctttagatattgctgctgacggaagcttgcggattattttgctcgtggaggatgttcctactgatctattggaggaatttggtttgactgattttcttgagttattgaagagaagttgtgagctagaaaaaagagcttttaatatttttgtactttatatcaattttctttgagttcaatatcaggcctattatgattttttgatcggcctcgttgttgttatattgtttttgtttgaggaaaaaaaggaattttaagaaaaaaggagctatgtcagtttattttaagtttaaaagtgcgaaagattatgattcaattccaattgatggtcactttattactgttggtaatttgaaagaaaaaatatttgaatccaagcatctgggcaggggtacagatttcgacctcgttgtcaccaacgcccagtctaacgaagaatatcttgatgaggacaccttgattcccaaaaatactagtgttttgattcgtcgcgttcctggacgacctcgcatgcccatagtaactgcacctgtaacagaaccagacgagccccaggtagaataccgatctgaggaggctcaagcagttagaagtaattttgtgggaggggagtcatctgccaccaaatatcctgaagatcttgaatgggatgaatttggaaatgatctttactctattcctgaaacaatatcagtacagtcaagcaaccaagtgcaggatgctcctcctccaagtaaagctgatgaggagagtaagatcaaagctttaattgacactccagccttagattggcagagtcaaccctctgatggctttggtgctgg

SEQ ID NO: 2073 - DNA, 332 bp, Lycopersicon esculentum
ttttttttttttttttttttttttttcctgcctccccaactacaggcttttgctgaacctcttcatcagccaatggagcactccccggggatacaggttctttaacactgacggactcgtgtgtagcttcagaaacatctgcaaccttcaaagttcttcctctttccaacatttgctgagaagcactgccattcttaccctcttctgcaatctcctgggctttagaattttcctccttaacaggtggaggaggtggtggtggtggcaacggctcaccccttgaagctgcagattgtgaaggagatggaatctttggtgggagaatgcgcgct

SEQ ID NO: 2074 - DNA, 533 bp, Lycopersicon esculentum
ctagcaaaaatatttcagttatggcagtgtatatcaagtataaaagttgtaaggattatgattcgataccaattcttgatcattttatttctgtgggcaatctgaaatcaaagatatttgaatccaagcgttatggttggggtaaagatttcgacattcttctcaccaacctacaaactaacgaagattatgttgatcatgccaccttgattccaagaagtacaagtgttttgattcgtcgcgttgctggattaccttgcttccccattgtaatcaaagaggagcccaagcaagtgctgtgtaaacaggaggaggttcattcagttaaaaaagagtccaaatattctcaagatattgattacaatgattttggcgatgatgtgtatgtaattccaaaaatagcagtgccaattcaattaggcagtccagagtccagttgttctagtagtataatcaagaattcagtaggaaacatatcgtataataacacaagatcagctggctctagtgttggacaaggtagaacggaatgg

SEQ ID NO: 2075 - DNA, 1746 bp, Lycopersicon esculentum
gaaaaaatctccaactttataggacataatattaagattagctgtgtcctgatctcctcttaattaattaaagtaagtcactaattcctttaatttccttatatattttactttttatgtgtatccatttccacaattttatttggatttttttttatttttgttcaggatttctccacattgtttttgggatttttcaagaatttcgtaatttacgaggtacaattctatccactggagcgaaataaacttttagcgagaattaaaattttttctttttactcgatagaattgccacttaaatataaaatagtcaattgtgggtaaaaaaaaagttatttttgttgcaaaaatgtgtggtttcaaagcccaaactcttaaaaatctagacaatttttcacgttttttttttcaagattattgaaatttagaattgaatatttatatttttgttgcaggaaatggaatattatgggtttaatcaacattggcctattagctcatatgatgagctaagtgcaatatctatagcaaattcatttggtcatgagaataatttgcatgaatcattcatctctcatcatcagccactattatgccataaaaggcctatagaattgtcccaaattattgaagaaaggccactaaaaaattccaaaacaagtcatagctggaacaatactattgaaattgatcaaatattgagctcacaatctgtggtttctcccaattattcccatttgatgaactcatcaaataattacactaaccaacaagttgtgacaatgaagcccaaagaggaaacaactaatttgtcatcaagcagtataacttttgcagctgatcattgtcataacaatatggtttgtcatcaagattcttttgctaatcagaattatatgatgtttaaggctgcatcatgtcaaggtgctaataagagtgttagcactaatggaaaattaacacaagctcaagatcatatcattgctgagaggaaaagacgcgaaaagcttagccaaagattcattgctttatctgctctaattcccggactcaaaaagatggacaaggcttcagttcttggagatgcaataaaatacttgaaacaacttcaagagaaagtgaagacgcttgaggagcaaacaaagaaaaaatcagtggaatctgttgtatttgttaagaaatatgaactttatggagatggtgaaaattcttcatcagatgaaaattactcaagtggtactgtgccagttgatgaggcactcccagaaattgaagcaagaatatctgaaaaagatgtattaattagaatccactgtgaaaaaagcaaaggagttgttgagaaaacagttgctgaaattgagaaacttcatctatcagtcatcaatacatgtgccttgtcttttggaacttctgctcttgacattaccataattgctcagatggatgaggaatttgcaatgacagtaaaggatcttgtcaaaaatttgcgctcagctctcaaagtgtttatgtgaaggggtgtgatcgttgaccaacttatcgtaatttcttttaaagcgtttgatacaacaaaagtcattttaccgttttctttttccagttctataattggatgtttagggttgtgaggtcaaattcaccttttttttttttcaaaaccaagtcctttgaagcttgtttgccgtggggttaattaagtcatttttttagggaggatttattttttaacctctcatttttgca

SEQ ID NO: 2076 - DNA, 616 bp, Lycopersicon esculentum
ctgaaatggtatgagaactcttgtatactgccttgttggggagaggactattaattgtatttgattttatgtaccgatagttattaacaatattttttttcatttaatcaaatactacaggagactagcaatatgaatgatcacaactttgttaatcagagccaggcgatgacacaatttaatgaatttcctttcaattctaagcccttttctacttttacccctcctcctccctccaatgtaatttctaattacagctactccaattcaatgtcaaccaaaaatcaattcgaaaagttgaacacctttaaagtcgttaagcatgaggttccatctggaactacaataaacttctcttcttccgttaattctatggacgattctgattttggtgatatcgaggccgccatgggatttggtgctgctattacgactactactgatcagaagaaaagttacaatagaacaagtgttcaggcacaagatcacgttctagcggaaagaaagcgaagagaacgcttaactcagcgttttatagctttatctaccctcattccaaacctcaagaaggtaaatctttttttcttcttcatattcctgctcaaatcaattgaat

SEQ ID NO: 2077 - DNA, 429 bp, Lycopersicon esculentum
atgcaagatcaagctctcattctacatgagacttcaatcaagagtttaagcattgataataaacctggtcttcctaaaatggataagagcatgaagatggatgatgcagataattcaattccgccatggaaatccaacgatgtcaagtcgtggatatggatgcagcatgccatgcatccagaggtgaactacaacagctatttccagaaaaaatggatgccgtggaacataggaccactaaagaatgtgtcaatcaagaaatggatcaaagaaattaagcagaagaggaaagaagaaaagagactacagaaggctgaagtacatgcagcgatatcagtggcaggtgttgcagctgccttagctgccatcgctgctgaaaacatgaaccatgatcagtcagggtgtaccaaggagtcagctgtggccagc

SEQ ID NO: 2078 - DNA, 731 bp, Lycopersicon esculentum
aaaaaataaaaaaaaatctcaaaaattgcaaaaaaaaatcatggtggttttaccaatgaaaagagaaagagaaggagaattcgatataacaaccatggcaaattacttgatgttattttcacgtcaagaaaatcatttcaacactatggtaaacaactctcctagtcgagttttcgagtgcaagacttgtaatagacaattttcatcgtttcaagcactaggtggtcatcgagcaagtcataaaaagccgagattaatgggagaaatgaattttcatttgccgatttcaccgcctaagccaaaaacacatgagtgttcaatttgtggacttgaatttcctattggacaatctttaggtggacatatgagaagacatagaggtatgttaaatgaaaataataataataataatcaagttcctaatcacgatgttatgaagaaatcatcaaataatccaagagttttgtgtttggatttgaacttaacaccattggaaaatgatttagagttcaagttgaagaaggcaaatcctatagttgattgctttttgtgatcaatcaataatattggatcggatcgcgaatctacgataggagttctacgagttcaaagttatcaatccaatcatttacatatgctgaactcgctgattcaaaattctgaattcatatcgatatatttttgcacatatatatctaaaacatctagatgtttcattattttaatttttt

SEQ ID NO: 2079 - DNA, 1667 bp, Lycopersicon esculentum
gcgtcaccgttccattttttttctctctctttcatacccctagggtttcatcttagctcgttcgatttcgcctgaaaaatgatgccacaaagtggagttgctcagccagcaatggcacctatgtcaatggatcagtatcagcagcaagctccgccgacgcagcagcaacaacaatggatgatgcaacctccgcaagctcaacaacctcaatttcaaccttcttggggtcagcagcaacaacagccatcgcaaactatgtctcaacagtatgttgcgactaattctagccctagctcgaatgttaatccaaatgaggttaggtctctttggattggggacttgcagtattggatggatgagagttatctctccacttgtttctatcacaccggcgagcttgtttctgctaaggtcatcaggaacaagcaaagtggccagtctgaaggttatggattcctcgaattcaggagtcatgcggctgcagaaactgttttacaaacatataatggcgccttgatgccaaatgtggaacagaatttccgtatgaactgggcatctcttggtgccggtgagaggcgagatgattcacccgagtacacaatatttgttggtgatttggctgctgatgtgacggattatgtgctacaagagacattcaaacccgtgtattcatcagtaaaaggtgcaaaagttgtaacagatagaattactggacgtaccaagggatatggatttgtcaagttctctgatgagagtgaacaattgcgtgctatgactgaaatgaatggtgtactttgttcatctaggcccatgaggattggcccggctgcaaacaagaaaccaatgggtaccccccagaaagctacctaccaaaatcctcaagctactcaaggcgaaagtgaccccaataatacaactatatttgttggtggtttggatcccagtgttgcagaagagcatttgcgacaagttttctccccatatggtgaattggttcacgtgaagatagtggctggaaagcgctgtggctttgttcagtttggtagtagagcttctgctgagcaggctttgtcaagcttgaatggcacacaattgggaggacaaagcattcggctttcttgggggcgtagcccctctaacaaacagtccgatcaggctcaatggggtggaagtgccggtgctggtgctggtgcatattatgggtatgcccaaggatatgaggcttatggatatgctcctcccgctcaggaccctaatatgtattatgggaattacccaggatatgggaattatcagcagccacagcagtgaagtttaattattttcaaggaggctaagaagtagacgacgttcaaatttccagtgcttaggctgatctttcccgtcggtgtgactggttgtacaatgaatttgataaactgagtgattgtgagtttttgtgggacattttcttttctcctgtctgtaacttgagtttgctattacactaacgtgtaccgaaacattccaaactgtaccttgacctgtgtgtagactctgttaagttttttcttaccaaaaaaaaaaaaaaaaaaattgcatttggtttgcttgtgagcagcatctagtaaatgtgatgcttataattgacgaaacaaagatggtagagaaaaaaaaaaaaaaaaaaa

SEQ ID NO: 2080 - DNA, 738 bp, Lycopersicon esculentum
tttttttttttttttttttttttttttttttttggagcaacgagcaaaatagggtgttcagcattgccaggatagccaaaaagcacaagtatacagttacatgcctacacttctccaaagaccttcaagtatatctagatctcatatctaagtaataaaagggcaacgcaaaaataaaaaaacaaacagcatacaatcagttgatcgaaaccataaattgtatcctcaatgaaatagcctacaaaggtttccaacaccctaagattgtgaaatacacatctggatcccaactgataacctcatgtcccgcttttgaaatcaatacacaaatcacgccgggaagcactcagtaaatcctttcaccagcatatatcactgaggatgctgcaaaacttgctgctgctgttgaggttgtgcgtaatttccatatccagcatagcccgcataatactgatttggatcctgagcagggggggcataaccataaccttcatatccagcagtatacccataataaccagcatattggtttggatcaagctgaggctgctgcttgtttgcaggacttcgaccccatgaaagacggatgctttgtccacccagctgagttccatttaatacccgtagagcttcctcagcacaacttctgtcagcaaactgaataaagccacaccgcttgcctactggtatttttacatgaagcaactgcccatagtgtccaaaaatctgccttaaatc

SEQ ID NO: 2081 - DNA, 604 bp, Lycopersicon esculentum
aggccgccaccgcgtgccgtcgccgtcgtcaaccttcttctctactctgctcaccgaaaccctaagaatgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgatgagatccggagcttgtggatcggagatctacagttttggatggatgaacagtatatccagaactgcttcgctcacactggagaggtggcctctgttaaagttatccgcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttggtggagacttggcagctgatgtcactgactat

SEQ ID NO: 2082 - DNA, 600 bp, Lycopersicon esculentum
gcgccgttgccgtcgccgtcgtcaaccttcttctctactctgctcaccgaaaccctaagaatgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgatgagatccggagcttgtggatcggagatctacagttttggatggatgaacagtatatccagaactgcttcgctcacactggagaggtggcctctgttaaagttatccgcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttgttggagacttggcagctgatgtcactgactatatg

SEQ ID NO: 2083 - DNA, 723 bp, Lycopersicon esculentum
ggccgccaccgccgttgccgtcgccgtcgtcaaccttcttctctactctgctcaccgaaaccctaagaatgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgcagcagcaatcggcgtattattaccagcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttgttggagacttggcagctgatgtcactgactatatgcttcaggagacattcagggccaactacccctcagtcaagggtgcaaaggttgtgactgatagggtcactgggcgcacaaagggctatggggtttgttaaatttgcagatgaaagtgagcaattgcatgctatgactgagatgaaatggcaagtctgctccactagggccatgcggataggccctgcagctaacagga

SEQ ID NO: 2084 - DNA, 364 bp, Lycopersicon esculentum
tcaggatccaaatctatattatgggggttacgctgggtatggaaattaccctccacagcagcaacaaccacagtgatctctgctggttaaaggagtcgacgaaagcttcctagcacagtaatgcaacgatgtagaaagggaggggcatggattcgaagtttgcatcagatttagtataagataaactactgtaggctggttcttgaagatcagtatttatggttgtgttcaaccatcgcttactttttcattagttaccttctgttatttttcattggtttttttgttgatctttttggtttttgcgcttttatgtttacttttcatgagtcccacttggtacttggatttttgttctagttgg

SEQ ID NO: 2085 - DNA, 755 bp, Lycopersicon esculentum
tttgattattcggttttgttgggggcagtagctcttgtgataagagtggttaattatcagtttaagctgtagttcatttagcatatgaatttggttgttttcaacttctacaatcagtatagctgcacaactcttgcgagtcttaaacttggatgaacttgctttgttgttttccactgtttaagggaagagcttgccatatatgttttagactgagcttaacctacaattttcctcattgttgtttcttgtttgattgaatcataagagttttgaatagattaattcattatgcttcgaatgtctgttctctcactctatttcttaatgcatcgatttttacttctatttcacattaaagtcgatgagttcttagctttgttctgagaaatattaaaatttgttaaagaatgactaaagtcccacatcgatggttaatgagatgggtggacggactccttataaaacttggacaactaaattcttgtcccttccctatatctgtgccttgtcttctcatatcatttattcccatgattttcttatcagtgttccatgttgctagtttctatcggaatttggaactaattcttatctgtttttgttttgttttcttaccaaatcccttttttgagtccaaatagattctgtctcgatatcttgcacctcccaatggttcatatttctcgagtcagccccatggcaaattgtgaaagtcggtgacaggtctttggaagctgatacagggtttcgca

SEQ ID NO: 2086 - DNA, 471 bp, Lycopersicon esculentum
gcaccgaggttcaagatttcccagatcataccagtctaacaaacatatcttttttttttgtcaactaagtagtaattaatcagttcttgtatttaaggtcaaaactgattaattattggtattaatggataatttccattcaatatttcctttacaaccggatgatgatgcgaattatgattcccatcaacaacagctcatttttccacatgaaacctataccaacccttgtaatttcatataccaacaagatctggtaaatgattttgcttcttttgattcattggagttaagagacaacaatcttacatttaacaacaatactaacaacaatcagaaagggaaatcatgtggcgttgaggataagaagaaacacaagaaagtgatgcatagagaaattgaaaggcaaagaagacaagaaatgtctactctttatgcttctcttcgtcaacaacttcctcttgaaaatat

SEQ ID NO: 2087 - DNA, 572 bp, Lycopersicon esculentum
ataaatgcagaaaatcctttattttcatcattgctttatatacatcgcaattttcaacaccagaccattagtgaaattaagctgtaccaacgcattctctacaaacccccaaaaaccctactgccaaattttattttatttatttttaataaaaaaagtctaattactgccaaattttatttatttattttttaaaaaaaaaataaatctaattttgacaatatcagaccatgtgcctcatggtaaaaagcttgtagaaatgcagttgcatgatatgttattaattgtaaactgagaactataagtccaggttgatcatatcaatcactttttgttgcaatgccaagtgatcaatgttgttcatatcacacgcctcagtgtgaattgagtagagtgacctttgatccgcttttgcagaaacacaactcaccacattaagcccttgtttcaaaagctcacccagaatttttgaaagaggaaaagttttcccttcacaatcgacgctgattgagatctctataccttcctgcagccaggggctaactgtgacagtacaatctgtgaatctgtta

SEQ ID NO: 2088 - DNA, 542 bp, Lycopersicon esculentum
ggggattcctgcatctttggagcttgatcaactgcagcagagcaagtgtgccacacacataggagagttgaatcctttggatgagtcaggactgcatacagtggccagtacattcacgaactctagattggttggtagcgcaaacagctctatgcccaatgtatcaaataatcctattttgcttcaagtaaattcccagcaaccactgacggggatgggatttggaaatcagacttctctcaacgtagcctcttttagctctgaggccttcaatactggtgtaagtggttcttccaattttctggaccatgatagatattctaacgagaattggcaaacttctctccagcctctgaagttccagtcaacctcctttccgttaaatgaacctttcagcaacagccatttgcctcaagacagagtacgagacaatgatacttcaactggccctcatttgcagaacaatcctgttgatttttcaacctccaccatagtttccgtacctttcgaagcttcaagaggagaaacacaatgccgtgaaa

SEQ ID NO: 2089 - DNA, 443 bp, Lycopersicon esculentum
  misc_feature (17)..(17): n is a, c, g, or t
gagaactagtctcgagntttttttttttttttttttttttttacctttaaatctcaaattcttgtcaatctgcacaatggatttttgattttcacatttacaaactaattagtgcagcctatgtatacaacaactctaacagccatggataacaaatactaatcccccaatgggatattatttaccccaaactccagggggcggaaggcttaaaagattcttctcccattaattccccaaaaccaatcaaacctcctttgaaaccaccggcttcccctaatttgaacctggcggcagaacaatggggttcttgcttgtcgaacacaaaattcaccaccctccaaaacgggcccctaccccccgggaattgaaccatcaactttaccctttccaaagccttctgcaacctttcttcagttggctttcggccttcttttaaaaaa

SEQ ID NO: 2090 - DNA, 734 bp, Lycopersicon esculentum
gatcatcacaaaaatacaacgataataactacgcctcaatttcaaactgatcagaataacaagttgtttgaaggtttacgtgccgataatactattgatttaccttcatctcatcattatcaacaacaatgtttgaaaggaagtgagtttgatgttgatgagttaggggtagaaaggtcattaatggagaagaagctaaatcataatgcaagtgaacgtaatagaaggaagaagatgaattttctttattcaactcttcgttctttgcttcctcctcctactaataaacatcaaaagaaaaaattaagctttccagcaacagtatcatatgtacaagaatacatcccagagttgaagaaagaaatagagaggctaagcaaaacaaaagatttgcttttatcaaagaaatcaaattattcattactcaaaattgatgataataataagagaaaattaattattggtggaacttcttgtaattcttcaacaacatcaatttgtgcaagtcaactaagtaattcacaagttttggtacaaatttcaacaactcaagaaaataattttccaatttcacaagtatttgcaagtgtagaggaagatggattaattttgctaaatgcatcatcctttaaatcttttggagacaagatttttcacagcttgcattttcagatgcaaggaccaattgaaatggacattcaggttttgaagactaagcttttagtaatgtgtga

SEQ ID NO: 2091 - DNA, 605 bp, Lycopersicon esculentum
gctgttccatcttctccccttctttatcctcataccaaaatcactcttcaaaggagcgaaaacactcttccaatctcaattcttcgcctccaccgacgtctactcgtatcaaatcctcaaccaccaacgctatttactcttcatggtcttacatcaaacgtattttctcatccaataaacaaaaaatcaacaacacccaaactcacaataacccttcaattcaatctccctgttcttcaacaaggtccctgcaaaaacccatttcatcagatgacctaattaaccgctccgtttctccaatacccgaatccgaaatcacctccgatcaattattcttccctttacgaaacgatatctacccatgtactttatgtggggaagtattccaaagccccattcatctcgaacaacaccaatcgattaaacatgcaatttcggaactcacggatgaggattcgggtaacaatatagttcggatcatttttcaaacgggctgggttgataaagagaaaaacccggttatcaatcggatccttaagatccacaacagcaaacggatcctatcccggttcgaagaatacagagaatgcgtgaagctgaaagct

SEQ ID NO: 2092 - DNA, 956 bp, Lycopersicon esculentum
gctctctttcttcaaagcttgagcggtttatctcgaattttccgtagggttcttctctgatcgctttcaactttcgataacagagaaacctagcaatgtcatcgtcactccatactgaagattctcaatggaaaaaccctagcatttatagccgcaaggacaaatcgctcggtcttctttgctccaagtagaaatgtgtggaggaagctgatgatatgccttaaaaacataaaaacccaatttcttgaagctatgtgatcgggaaggggtggactccaccattggtttggacaatgctgcagatcaattaggtgtcgagaggcgtcgcatttatgatattgtcaatattttggaaagtgttggggttttgtcaagaaaagctaagaatcagtatagatggaatgggtataatgcaatttctaaggctgtagatttgcttaagaaagaaggactaaaagatctgtccactgtctcctccacttgccacaatgtttcaaatgtcatagcttgtaacaattcagatgttaaggaaaaaggagaaggcaagactgctggatcacataaaattgacaaccggaaggagaagtctttgatgattctagcacaaaattttgtaaagcttttccactgttctgatgttgacttgatatctcttgacaaggctgcatcagctttgcttggtgatgtccacgatccgatggctatgaagacaaagaccagacgcttgtatgatattgcaaatgtttttgtgtccatgaatcttattgagaagatacgcagcccagataatggaaaaccagtgtttaggtggatagcctggaaagaaaatctgaggagtgggtcccttgcatctgctaaatcagatgattcaacaaggagaacttttggggcagagatcacgaatacaactcccaaacgatacagggatgattcttcatctgatgtaatgtcaaatg

SEQ ID NO: 2093 - DNA, 1153 bp, Lycopersicon esculentum
ggtcatggggaactactgtttctggtcaatcggtttctactagtagcagtattgggtctccatcgagcagaagtgaagccgccatggctacccctgccagtgacaacacttttcttaggctaaacaatcttgacattcatgctgatgatgcaggatctcaagggacagctgggaaaaagaaaagagctcagcgtgctactggaggggataagagtggtagaggactcagacagtttagcatgaaagtttgtgagaaagtggaaagcaaaggaagaactacgtataatgaggttgcagatgaacttgtagctgagttttctgatgctaccaatagtgttgcaggctcagatcagaaacaatatgatgagaagaacatcagacgacgagtctacgatgctctgaacgtacttatggctatggatatcatttctaaagataaaaaggaaatacagtggaagggattaccacgcactgatgcaaatgatattgaggagctaaagactgagcgtcttaacttgagaaataggattgaaaagaaagcagcttatttagaagaacttgaagatcaatatgtagggcttcaaaacctcataaaacgcaatgatcagttgtatggctcaggcaatgctcctagtggtggtgtggctttaccgtttattttagtgcagactcgtcctcatgctacagtcgaagtggaaatatcagaagatatgcagctggtgcatttcgacttcaacagcactccgtttgagctgcatgacgataattatatcctcaaagcaatgaatttttgcggaagatcaaatgacggttctgtcccacagaatgtatctgctgatggaggtgaaggtccgagttccagtatggccaacatgtttcagcatcatatccctaatccatctgccccaaactcatctggcaggcttccgacctcacctcctctccccggaatactaaaggctcgtgtcaagcatgagcattagtcttctggcttctttcttgatcgattactgtactcattaacgcatagtatttctgtacattatgtaaagtatttttactggaagcagcctcctctgttgactaaatacttctcttgacccttgtctcaatttgagggaggttactagttgagcttttaaatttttttgct

SEQ ID NO: 2094 - DNA, 993 bp, Lycopersicon esculentum
ggctccatgtacatgggatcatcatcaggaagcttaagtatgaaggtgcatcaattcacacgtggattcttagagcatgaagctgcttctccttcacttacacttggttgcaaacgtttaagaccacttgctcctaagctcaacacaaccaataatgataccacaactaccattgttactcctccttttgatcttaagagtttcattaggcctgaaagtagcaatagccctcctaaacttgcttacaatgaagacaagaaagactcctctcaggtggaatcacacccaggaggaacaagatggaatccaacacaagaacagatagggatacttgaaatgttgtatagaggtgggatgcgtacacccaacgcacaacaaatagagcaaatcacagcacaactaggaaaatatgggaaaatagaaggcaaaaatgtgttctactggtttcaaaaccataaagcccgtgaaagacaaaagcaaaagaggaatagtcttggccttagccaaagtccaagaacaccatcagccatagtcactagtcctttgtcatttgacactaggggagaagtagtgagggatgaagatagtccatacaagagaaagtgtaggggatggacatttgaatacatggaggaagaacaacaacaacaagatgaagaagaaattataaattgtagagaaaatggtgataggactcttcaactcttcccattgcatccagaaggcatgagatgatgaatttattataagaatattcttttttcctttttaattatgatctgactagcttccttttttttttttacttattttcgtcatctttaatttttactttcttcatttgcatgctttgtttccttttcttttatttttttccttgttttgggaaagagaaaagagaaaagagagacatatgaatcatcaaatctatgtagtaccaattcacttctcttgaattttgggcattttagtgaaaaaaaaaaaaaaaaaaaa

SEQ ID NO: 2095 - DNA, 561 bp, Lycopersicon esculentum
gcataaacaaaaacctaaaaaacatccttcatttctttttcatccttttgtcttctcacttactaaagtccccctttcattttttttttcttccttcttattaacctttttttcctatgaataaagataattctttttatttttttttggtatgaaatcatcttgaccttaaatttaatcatctactaactcttttaactcaaaaacaaaaaaaaagaagataaaaaagagtgttagatgtttcagccatggagttaaccaacaacaacaacacaactattagtactattactactactactacagtgaaaaccccagaagctgaaattgaaaccccaactcagatccagaaactgaaaccttttccttttagtaatggtgttctgaaaaggaaaagttcatttaaccataacaatcatcatcaccctgttgtggttatttacagagagtgtttgaaaaaccatgctgctagtttagggggtcatgctgttgatgggtgtggagaatttttgccgtctcctgcagcgaacccatctgacccaacttcactgaaatgtgctg

SEQ ID NO: 2096 - DNA, 639 bp, Lycopersicon esculentum
  misc_feature (591)..(591): n is a, c, g, or t
caaaaaccaagatttttgttatctatagtcataaactctcatcatcatcaaaactcaaaatcccaaagaaaaacaaacccactttttttttttcttctctttcttaacatgctttttcttttcattttcttaatcatctaagttctaagagtgaggggaaaaaaagaaaaaagataagtagtagatgtgtttcaggtatggagttaaacataaacacaaacacaacagctgctattactaccgtgaaaacaccagaattagctgaaactgaaactccgagtcggatccagcaaccgaagcctttttcgttcagtaatggggttttgaaacggaaaaatcatcatcatcctgttgtggtggtgtacaaagaatgccttaaaaatcatgcggctaatttagggactcatgccgtggatggatgtggagaatttttgcctattccagctgcgaacccagctgatccaacttcactaaaatgtgctgcttgtggttgtcaccgcaattttcaccgccgtgaaccggaagaaccgccgcctatcgctaccgcggctattgagtaccaaccacatcaccgccatcatcctccgccgnctcgtggggaccacggtagcccgaattcaccatctccaccgccgattt

SEQ ID NO: 2097 - DNA, 594 bp, Lycopersicon esculentum
ctgaccaggcagtttgggctactgaggatgattataaagcctggaacagtggtccctattgtgaaaccccttccaattccagtcaggatggtaggcattcacaaaaccggtcaggcagtgagcctcccaacaagaagtcaaggaatgtgcaggattcagatgctcgcattatagtcaccagtagctctaaagcaatcggaaagatgttctttaaaacgaagttgtgttgtaagttccgtgccggtgtctgcccctatgttactaattgtaactttgctcatggaatagaggagcttcgcaaaccaccacctaattggcaagagatagtagctgcacatgaaaatgagcggggagtaatggtggaactgagagaagaacaccagataccaatattgagctctcctgatttacgtggagagtctcaaaggtccgctaaagggaggcactgcaagaagttctacactgaagagggatgtccttatggagatagttgcactttccttcatgatgaacaatcaaggtctagagagagtgttgcaataagtgtgactcctactgttggtggatttggaaataatgctactggagcaaccc

SEQ ID NO: 2098 - DNA, 823 bp, Lycopersicon esculentum
gctcttctttctcttttgcctcaagctttttttttcttcttcttcttcatgggtttctagttagattttctgaagtgactttaatttttttttgtaaagttttgatttttttttctctggcattttgaatgttgttttggggttgtcttcttgagagtaatgggtgttcactgttgttttctgatagctaaaaaaagggatttttactaacttttttggtgtttgtagttgggattttcttgaagtgagtttaatttgtgtaaagttttaatctttttcaaggcattttgaggaatgctgtgtggggtttgttttctgatagttaaaaaagaagcatttttcataagtagataatgtcagtcaagaatagaaagatatcttcttgactaacttttttgagtttcagggggggtggaaaaagatgatagctttaggaaagttcatttcttttagaaagttatctgagtataagtagaggaaaagttacatttttttagttatattgaagggttgttgaaaagatagaatcttgaaaatgggggagaagaagaatatgccagcagtttggtttactttaaagagatctttgcattgtaaatcagggccatcagatgttcatgacccaaaaacaagaaaagagttgagcacaattttgaccaaaaagggaggaggaaggtctggttgttcaaggtctatagcaaatcttaaagatgtaatccatggaagtaaaagacatttggataaaccacctagttgtagtcaagatctattggtagtagtgagtttattaatcaataactcatgaaagtattctgagtaattc

SEQ ID NO: 2099 - DNA, 478 bp, Lycopersicon esculentum
  misc_feature (466)..(466): n is a, c, g, or t
ggaggaggagatttaaaaaaaaaatgccagcagtttggtttgctttaaagaaatcattgcagtgtagatcagagataaaagatgtgtatgatccaagaagtgaagggaaaaatttaagcaagatatcgacgaaaaaggcgacgacaggtaggtcaggttgttcaagatcaattgcaaatctgaaagatgttatacatggaagtaaaaggcatatggagaagccaccattacagagtccaagatctattggaagcagtgagcttttgaatccaattacacatgaagttgttttgagtaattcaacttgtgaactcaagattactagttgtaatttccaagatggtaatggtaatgggagtagtgggaataatgttgagagtatttctgcttttatgggtactttaaaaccagggacccctggccctggaggacaccatattggttcatcaaggaaatacagaggctntggtagtcctat

SEQ ID NO: 2100 - DNA, 606 bp, Lycopersicon esculentum
ctcatatacaactactacgattatcaaaaatgacgagccaagtagcggaaaacttcacaaaatactttgaaaattggatgatccaacttgaagagttgctgaaacaactcgttattgtacctagggagacgtcatacgtgaatgatcacgagttattggtgagtaaaatgacgacacatcacaagaactactacacagccaaatgggccgcagctcatgaagacatcttagcatttttcactccaatgtggcttagtcctttagaaatcgtctactcgtggatcacagggtggaagccttccatggcgtttcgattagtgagtggcggtggaggagcgttttcggatgaggaattgaagaatattgatggtttgagggtgaaaattcgcggagaggaagagaaagtggagagggaaatggagaggcaacaggttgcaattggggatagaaaaatggtggaattagcaaggattagaaatgataatgatgagttggtagaattggcgttgaaagggttaaggatgagtttagaaagggttatgaaaatggcagattgtgttaggcttaaaacgttgaaaggtttgttggagatattgagtcctttac

SEQ ID NO: 2101 - DNA, 454 bp, Lycopersicon esculentum
  misc_feature (15)..(15): n is a, c, g, or t
gggagatatctttangcatttttttttttttttttttataaaagtaaataaagtgactacccaatcaccaataacatctatcaactactccaaatgaagcaagcatatcaccacatctcagttcaaatgtttgcccatagtgtgcacaaactttgattacattccataaatcctcaccttcttctcaaatctcatcctaaatatttagctcaaggttagacctggtgccctaatgtctgcaggagaagccctaagctgtctgcataagcagcggccttaccgcatgataaaagggcgactgcataaaccctgtgctcaaggcgtacgaaactccctggccaatgagccttggtcttgaacacttttggtcaggcgggtgggcgccggccttccgattacggctattttttttatccccttttttttatttttggggtgttttctcttttcctat

SEQ ID NO: 2102 - DNA, 960 bp, Arabidopsis thaliana
tggttcataccaaagtctgagctcttctttatatctctcttgtagtttcttattgggggtctttgttttgtttggttcttttagagtaagaagtttcttaaaaaaggatcaaaaatgggaaggggtagggttcaattgaagaggatagagaacaagatcaatagacaagtgacattctcgaaaagaagagctggtcttttgaagaaagctcatgagatctctgttctctgtgatgctgaagttgctcttgttgtcttctcccataagggaaaactcttcgaatactccactgattcttgtatggagaagatacttgaacgctatgagaggtactcttacgccgaaagacagcttattgcacctgagtccgacgtcaatacagactggtcgatggagtataacaggcttaaggctaagattgagcttttggagagaaaccagaggcattatcttggggaagacttgcaagcaatgagccctaaagagcttcagaatctggagcagcagcttgacactgctcttaagcacatccgcactagaaaaaaccaacttatgtacgagtccatcaatgagctccaaaaaaaggagaaggccatacaggagcaaaacagcatgctttctaaacagatcaaggagagggaaaaaattcttagggctcaacaggagcagtgggatcagcagaaccaaggccacaatatgcctccccctctgccaccgcagcagcaccaaatccagcatccttacatgctctctcatcagccatctccttttctcaacatgggtggtctgtatcaagaagatgatcctatggcaatgaggaggaatgatctcgaactgactcttgaacccgtttacaactgcaaccttggctgcttcgccgcatgaagcatttccatatatatatttgtaatcgtcaacaataaaaacagtttgccacatacatataaatagtggctaggc

SEQ ID NO: 2103 - DNA, 2481 bp, Arabidopsis thaliana
cataagtgaacacagaagaagcggtggctctgagccggcgaaatctcctttctcatccctaaaattttcatgtccatcttgcctcctccgattatccaaggtcacaattcgtcttctccttcttcagattcctctctaaaccctagctctgagcatggcaacaactcttcttcttctctctctcctcttccctcctctcctccttcccggatctcttcttccaccggaactcgattctccggacattctgaatcctctcacaatttctccggtggctctagggaaccgagtgttgcagctgaggagggacatagccgtggatcttccaaagagatgacacaaaatggagcagggaaggagagtttttccccacctaatgcagataagcgtgaccattttcgatatgatggtcgaaggaataggtctagagggagaggtactggagctgctggttcttcttcttctcaattgcagcataattccggaccttttaattctcctagaggcggtgtttcgcatcataatccaactggtagaagagctaatatgataagtgggaatcatttactgaattttcagtatgatccgatttcgcaaccgcaatctaggggtcctcctccgcctcaaagaaggcaacaatataaggggaggccttttaacaaggatttgtttcttaaggccaattataagtttgttgtgttggacactggagatcattctcctgattcaatggatcctgataaaatgctgcagtgggatgatattatttgtgtaaggtattctactccgtctcctgtccagtgtccgatttgcttggagtatcctctatgtccgcagattacttcctgtgggcatattttctgtttcccgtgtattctacagtacctgttgactggtgttgataaccacaaggtggactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcagtctgttgatggtcagcacattatccttcacactttgaatgtgaagtgccttctgcatcactatggaagctatgactttcttccaccaagattgagtggaaagatactggaaatggaaaccattacccaatcagaagcgataaggagacgctaccgctttttaagtcatttttctttatcaactacacttcagatatgtgagattgatatgaaggaatccttgcctcctgatgcatttgctccatttatacatgaaattaagaagcgtgtgaagcagcggaaagaacgtgcttggaaggatcgaaaaaataaaatcaaagctgaagtagctgcagctgcagagcttgtaccattgatggccagttttgggcagtcgtcttctagtgatgactttcccccattttccttggatgactttgaagctctgggaaactctgccccaatatcatcaagccctccaaacattggagagagaagttccttctcacatgtgacaaggctcggtttcgcagctggtcacgactccccaaacctgaataacgagccaacaaacgttcaaagcagcagcagcagcagtgaagtctcaaacgcaaccacaggtgcaagaaacacaaacataacatcctttgcgagtgtagcttcaagaacaacaacaccaatggcaccaaccgtcaaagagcccggtaagagagggaagaaacagagccgagtacttctatcgacaactagtgtacgccgttactgaaaaggcctatggatttgtgtatgtataataatcttttcatctaagaaaaactgagtaaagaaagaaccagagattatggtgagtgagtaagtg

SEQ ID NO: 2104 - DNA, 2617 bp, Arabidopsis thaliana
ttctgtgtgattcagttctcgatccatcttttcgtgaaaagtatcaatcttttaattctctagttgtttgtcaaatctggttagtttcttctcttgtatttatttgatgaacttcggtagtctcttcgataacacacccggtggtggctctaccggagcaagacttctctccggtttaagttatggcaaccacaccgccgcaactaacgtcttacccggtggtgctatggctcaagcggcagcggctgctagtctcttctctcctcctctaacgaaatctgtttacgcttcttctggcctctctctagccctcgtacgacgtcgtcttcctctactactaatacttatctttttatacttaaacctaatttgtgttttggataggagcaaccggagagaggaaccaaccgtggagaagcatcgatgaggaacaataataacgtcggaggaggaggcgatactttcgatgggagtgtgaacagaagaagccgagaagaagaacatgagagtagatctggtagtgataacgttgaaggtatctccggtgaagatcaagacgctgctgataagcctcctcggaagaaacgttatcaccgacacactcctcaacaaatccaagaactcgaatctatgttcaaagagtgtccgcatccagacgagaaacaaagattagaactaagtaagagactttgcttagagacaagacaagtcaagttctggttccagaatcgtcgcactcagatgaagactcaattagagaggcatgagaacgcgttattgagacaagagaacgataagttaagagctgagaacatgtctattcgtgaagcaatgaggaatccaatctgcaccaattgtggtggacctgccatgcttggtgatgtctctcttgaagaacatcatctccgtatcgaaaacgctcgtttaaaagacgagcttgatcgtgtctgtaacctcaccggtaagttccttggccaccaccataatcaccactacaactcctccttagaactcgctgtcggcaccaacaacaacggtggacatttcgctttccctcctgatttcggcggtggtggtggttgcttacctccgcagcagcagcagtcgacggtgattaatgggattgatcagaagtcagttttgctggagctggctttaactgctatggatgagttagtgaagcttgctcagagtgaagaaccgttatgggtcaaaagcttggacggtgagagagacgagcttaaccaagatgagtacatgagaacattttcatctactaaaccaaccggtttagctactgaagcttctagaacctctggtatggtcatcatcaatagcttagctctcgtcgagactttaatggactccaatcggtggacggagatgttcccgtgtaacgtcgcaagagctacaaccaccgacgttatatccggtgggatggctggaacaataaatggtgcacttcaactgatgaatgcagagctacaagttttgtctccactggttccggttcgtaatgttaatttcctccggttctgcaaacagcacgcggagggtgtgtgggcggtggtggatgtatcaattgatcctgtcagggaaaactctggtggtgccccggtaatccggcgactaccatcaggatgtgtggtgcaggatgtgtctaatggatactctaaggtcacgtgggtggagcatgcagaatacgacgagaaccaaatccaccagctgtacaggccgttgctacggtcaggccttggttttggctctcaaagatggctcgctacacttcagagacagtgcgagtgtctcgccatcctcatttcttcctccgttacatctcacgacaacacatcaataacgcctggtggtcgaaaaagcatgctgaagttagctcaacgcatgacgttcaacttctgttcgggaatctcggcgccgtcggtccacaattggagcaagctcactgttggaaatgttgacccggacgttcgagttatgacccgtaagagtgtggacgatccaggagagcctccggggattgttttgagtgctgccacttctgtttggctacctgctgcaccacagcgtctgtatgatttcttgcggaacgaacggatgagatgcgaatgggatattctatccaacggtggtcccatgcaggagatggcccatatcaccaaaggtcaagatcagggtgtctctctgctccgctccaatgcaatgaacgcgaatcagagtagtatgctaattcttcaggagacatgcattgacgcatctggagcgcttgtagtatacgcgcctgtcgacattcccgccatgcatgtggtgatgaacggtggtgattcatcctacgtggctctccttccgtccggtttcgctgttcttcctgacggaggcattgacggtggtgggtcaggtgatggtgaccagcgaccggttggtggtggatccctcttgacagtggcgtttcaaatccttgtaaacaatctcccaacggcaaaactcacggttgagtcggtggagactgtcaacaacctaatatcatgcaccgttcagaagattcggccgctttacaatgcgaaagctgatcttgatcaagactggcgcgtgcgtgtgtttc

SEQ ID NO: 2105 - DNA, 2243 bp, Arabidopsis thaliana
actatttctcctttctcagctgctttcaccattttctctttttctcctccatcaatctttctcacggttttctagggttttatatatgctttcctcttcatccatgtcatcgtcttcgttatctgctagattttgcttcaaccacgaatgttttgagttcaaactcgaccattgccgtcctggttggcgtctccgttctggcgatttcgtcgacctctgtgatcgttgcgcctctgcgtatgaacaaggaaagttttgtgacgtatttcaccaaagggcttctggatggaggtgttgtgagtcatgtggaaagcgaattcattgtggatgtattgcgtctgcttctgcttatacgttaatggatgctggaggaattgagtgtttggcttgcgcaagaaaaaagtttgctttgggacccaatttttcgccatcaccgtcctttcttttccagtctccaatttctgagaaattcaaggacttgtcgatcaactggagttcttcaactagatcaaatcagataagctaccagcctcctagttgtttagatccttcagttctgcagtttgattttcgtaatcgtggaggtaataatgaatttagtcaacctgcttctaaagaaagggtcactgcatgtaccatggagaaaaaaaggggaatgaatgacatgatagggaaattaatgagtgaaaactcgaaacattatagagtatctccttttccaaatgtcaatgtatatcacccactgatctcactaaaggagggtccatgtgggacacagcttgcgtttcctgtgccaattacaacaccaattgagaaaactggtcactctagactagatggaagtaatttatggcacacacgtaattcttctccgctaagtcgcttacacaatgacttgaatggtggagcagactcgccattcgaaagcaaaagtcgtaatgtgatggctcatcttgagacgccaggaaaatatcaggtggttccacgattttggcccaaggtttcatataaaaaccaagttctgcagaatcaatcaaaagaatctgaatccgttgtcactcctctctttgagaagatcctgagtgcaactgatactggaaagcggctggtcctgccaaagaaatatgcagaggctttcttgccccaactttcccacaccaaaggtgtgcctctcacagtacaggacccaatgggtaaagagtggagatttcagtttcgcttttggcccagcagcaaaggcagaatatatgttctagagggagtaactccattcatacagaccttgcagttgcaggctggtgatacagtcatattcagtcgattagatccagaaaggaagttaattttgggattcagaaaggcttcgattactcaatcgtctgatcaggctgatccggctgatatgcattcaccgtttgaagttaagaagtctgcttatataactaaagaaaccccaggagtagaatgttcctctggtaagaagaaaagcagcatgatgattacaagaagtaaacgtcaaaaagttgaaaagggagacgacaacttgctgaagctaacatgggaagaagctcaaggatttctcctgcctcctcccaacctcactccatctagagttgtgatagaggattacgagtttgaggagtatgagtttcagatcaacgtgcactgaagttgaaggactgttgatatcaccaacaaccacaaagcacccacgacatagagatggctgtacttgcatcatttgcatacaatccccaagtgggataggtcctaaacacgaccgatgctgttcttgtgcagtctgcgacactaacaaacgccgtaggcgttccctgttgctacggagggaaaagaagcagatggagaaagaagacaatgcgcgcaagttgctcgagcaactgaattctgataatggacttcaccaatctgctaacaacagtgagaatcatgagcgtcatgcttcgcctttgaaagttcaattagatttgaacttcaaaccagaaaaggacgaagaatctctccctggttctaacaaaactaccaagagcgagactctgcctcatgatgacacagtaaagtctagcttcacgtcaccaagctcatcaagtgctcatagccaaaataacaaggaagatgaaggaaaactcaagacaaccacagaaattgcagacaccaccaccacaagctccatgtagattttgcagactcttatagctgcaaggtgaatagattatgatgggaaa

SEQ ID NO: 2106 - DNA, 828 bp, Arabidopsis thaliana
tgttttggtaaattgaggaaatggaagagaggcataagtgcaagttatgttggaagagcttcgctaatggaagggctttgggaggtcacatgaggtctcacatgctcattcaccctctccccagtcagcccgagtcatattcgtcttccatggctgatccagggtttgttcttcaggacagagagagtgaaaccgagtcgtccaagaagccctcccgcaaacgatccagacttaaccggagatccatctcatcattacgtcatcaacaatccaacgaagaagggaaaagtgaaaccgcaagagcagcagatatcaagatcggggttcaagaactcagtgagtcgtgtacggagcaggaaccgatgagttcggtgtcggacgctgcaacaacggaagaagacgtggccttgagtctcatgttgctgtcgagagacaagtgggagaaggaggaagaggaaagtgatgaagagagatggaagaagaagaggaataagtggttcgagtgcgagacttgcgagaaagtgtttaagtcgtatcaggcgttagggggacacagagcaagccacaagaagaagatagcagaaacagatcaattaggctcagatgagttgaagaagaagaagaagagtactagtagtcaccatgaatgtccaatctgtgccaaagtcttcacatctggtcaagctctcggaggtcacaaaagatctcacgcttccgctaataatgaattcacgagaagatcaggaataataattagcttgatagatctaaatctcccagcgccatcggaggaggaagagatggcctcgtcggttttttaatgcttga

SEQ ID NO: 2107 - DNA, 840 bp, Arabidopsis thaliana
aaattcacaccattggcaggttttattcttactcatctgaatgtgtatggttaaaacagaacattgaaaagtactactgaaagttactatatgaacatgtaaatatagtttttgaagtgtttgaaggatgtctcttatgatcaacgctggcccaaacttctttcagtgtcctgagactatataagaagagctagagtccttagatttccaagatctgtaaattttgttttatatacttttgttcctgcatcttactgtttcgcttgatgtttggcaatcacctctagtttgaatcgatgcagaaagactgatgtaaccagctttgtctaccttttatagttaaggatttccgatgtaagttatgaagagcgggaggatgtttatggtgaactggaagctagaggcttatcgggtgactctttaaggaaactaccatgctatataatgtcaagtgaaatggtcaggaggcaggtcactcactgcacaatttgtctgcaggtttgtctgcttcttggtttttatatgaattgattgaactatcatggccctttcttcatcttataccttggcatttacaggacatcaaaacaggggaaatcacacgaagcttaccgaaatgtgatcatacgtttcatctggtatgtgttgataaatggctcatcagacacgggtcatgccccatttgcagacaggcagttaaagattaaaacacgactgttgccgagctgtgtacatagcaaaaacacattatccttatatgttgttgtaacttgtaagtctaaaacccctttcttctgtatttttcctcatttcatttagagcaatgctcagctaagggtg

SEQ ID NO: 2108 - DNA, 2629 bp, Arabidopsis thaliana
ccaatctttcgtttctgggtctgttgaaaaacgatgactgttgaacaaaatttagaagctttggatcagtttcctgtaggaatgagagttcttgctgttgatgatgaccaaacttgtctcaaaatccttgaatctctccttcgtcactgccaataccatggttcctctctctctctctctctctctctctctctctctgttttcttggatctgtttttcatcaagtttttagattttatgtctctttgatctgtgatttgatccacatatggtggaatcttttgatatctatctacctaacttcttgtatacacaaatctaaaaaaaacttagctttttttattccattgttagattttgtaagatttgacatttgtcagagagaaagtttcattgttgaattgaattaaaagtttaagactttatggaatctgttgcagtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataagtaagtcttattattattattattttctaattaaacttttgtcatttatttccttaatgactcactacaggaataaagttttgatctctagacttggttttgtgatgatgattttcttgttgttgcagtgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatcagaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagagtaagcttatcaatatgtcacttgatatgagagtaagcttatcagtatgtcacttaagttctgttttgtgtgtgttgttttgattgcagaggctatgcctaaaaagattttggatctgatgaatgttgagaagctcactagagaaaatgtggccagtcatcttcaggttacaaagaatctttcatgtttttaacttgcgtaacccgaagatttgttttttaacacctcggaagcttatgactttgttcgctgtggtttgcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatactccttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtgacattaaagcttttgccaatattaaccattctgatttggagattattgtgatttctgacatgaagattttgtgaatgtgacaggaacagagccagggagatttgtctggaggagatttgggatatggagggtttagttcactcagaacatgcatatgagagaacaaacatttagacataaatcaaatatcatcatcttgtttgtctctttttctcgctaatcttttgtgtattaaaattgtaaactatttgttttcccactggttctagcaatttaggactc

SEQ ID NO: 2109 - DNA, 3008 bp, Arabidopsis thaliana
ctctgtagctccttttcctctcagcagccatggaagaaaaaactcatcatcatcatcacagtaccaacaaacacatccctagttccaaatcaagaacacctcttctccacaagccttatcatcaccatgttcaaaccaatcctcctccttttcttttgcacccttcttctcaccaaaacctcaatcttgttgcctcaaatcttccttctagctactactactattactactgctacttctactctcaatttcacaactctcttcctcctcctcctcctcctcatcttcttcctctttctcctcctcttcctcctttacttcctcttcctcctcctcactcaatgacccgtttccacaaatctctccctgtttctcaagttgtggagagaaagcagcaacaccaacagaagaagaagatacaagtttctaacaacaaagtgagtggatccatagcaatagaagaagcagcattagtggttgctaaaagaccggactttggtggtcaagatggttctgtcatttatctcctcgccaaccattttcttgtcaagtttgattcgtcacagaggatttaccattacaatgttgagatatctccacagccttcaaaggaaattgctagaatgatcaaacagaagcttgttgagacagatcgtaatagcttctctggtgttgttccggcttttgacggcaggcaaaacatttacagccctgtggagtttcagggagataggcttgagttctttgttaatctccctatcccatcttgcaaggctgtgatgaattacggtgacttgcgtgagaagcaacctcagaagaagattgagaaactgtttagggttaatatgaagcttgtgtccaagtttgatggtaaagaacagagaaaggaaggagaggattgggctcctctgcctccagaatacattcatgctcttgatgttatcttgagagagaatccaatggagaagtgtacatcgatcggaagatcgttttactcgagttctatgggtggatctaaggagattggaggaggagctgttggactcagagggtttttccagagtcttagacatactcagcaaggtttagcacttaacatggatctctcaatcacagctttccatgaaagtattggagtaatagcttacttgcagaagcggctcgagtttcttacggaccttcctaggaacaaaggtagagaattgagtttagaggaaaagagagaagtggagaaagcacttaagaacataagagtctttgtttgccatagagaaacagttcaaaggtatcgagtttatgggttaacagaggaaattacggagaatatatggtttcctgatagagaagggaaatatctaaggcttatgagttacttcaaagatcattatggttatgagattcagttcaagaacttgccgtgtctgcaaatcagtagggcaagaccttgttaccttcctatggagctatgcatgatttgtggaggtcaaaagtttcttggaaagctatcagatgatcaagctgcaaagatcatgaaaatgggctgccaaaaacctaatgaaaggaaagctattattgatatggttatgacaggatcggtcggtccatcgagcggaaaccaaacaagagaattcaaccttgaggtttcaagagaaatgacattgctgaaaggaagaatacttcagccaccaaagcttaaacttgaccggccaaggaaccttaaagaaagtaaagtttttaaaggaactagaattgagagatgggctttgatgagtattggaggcagctctgatcagaaatctaccattcccaagttcataaacgagcttactcaaaagtgtgagcatttgggagtcttcttaagcaagaacacattaagcagtaccttctttgaaccatcacacatactcaacaacatttcgcttctcgaatcaaaactgaaggagattcaaagagcggcatcgaacaatctccagctgattatttgtgtaatggagaaaaaacataaagggtacggagatctaaagaggatatcagagacaagaattggtgttgtgacacaatgctgcttataccctaacatcactaagctcagttctcagttcgtttcgaacttagctctcaagataaacgccaagatcggtggatccatgaccgagctctacaactcgataccttctcacatccctagactgcttagacccgatgagccggttatcttcatgggagctgatgtaacgcatcctcatccattcgatgattgtagcccttcagtagcggctgtggtagggagcataaactggccagaagctaaccgatacgtctcaagaatgaggtctcagactcataggcaagagatcatacaagatcttgacttgatggtcaaggaacttcttgatgatttttacaaagcggtaaaaaagcttccgaatcgaatcatattcttcagggacggtgttagcgagacacagttcaagaaagttctccaagaagagcttcaatcgataaaaactgcttgttcgaagttccaagattacaatccaagcatcacattcgccgtggttcagaaaagacaccacacaaggctgttccggtgcgatccagaccatgagaacatacctcctggtacagtggttgatacagtgataactcatccgaaagagtttgatttttatctctgtagccatttaggagtgaagggcacgagcaggccaacgcattaccatattctatgggacgagaacgagttcacttcagacgaattgcagagacttgtgtataatttgtgttacactttcgtgaggtgcacgaaacctatatcgattgtgccaccggcttattatgctcaccttgctgcgtacagaggaaggctatacatcgagagatcatctgaatctaatggaggatccatgaatccttcttctgtgtctcgtgttggtcctccaaagacgattcctcttcctaaattaagtgataatgtcaagaatctcatgttttactgctgattcttt

SEQ ID NO: 2110 - DNA, 1897 bp, Arabidopsis thaliana
gagttgagagccatactttcactataccagttgcttcctcagatatgccatcggctgaagaaagtgacaatgtctggtctttaatacctcagcttaagagaaaactgcatttgcaccagaaaaaagcttttgagtttctctggaagaacctagccgggtcagtggttcccgcgatgatggatccgagttcagataagataggtgggtgtgtagtttctcatactcccggagcaggaaaaacatttctaatcatagcttttctcgcgagctacttgaagatatttccgggtaaaagacctttggttcttgctccaaaaacaactttgtacacttggtacaaggagttcatcaaatgggagattccggtccctgttcacttgctccatggtcgtagaacctactgtatgtccaaagagaagaccattcagttcgagggaattccaaaaccaagccaagatgttatgcatgttcttgactgtttagacaaaatccagaaatggcatgcacagccgagtgttcttgtaatgggttacacatcgtttctaactttgatgagggaagattcaaagtttgctcatagaaagtacatggctaaagtactgagagagtctcctggattactggttctagacgagggacataacccgaggagtaccaagtcgagattacgaaaggccttgatgaaagttgatactgacttgaggattctgctttctggtacattgtttcagaacaacttctgtgagtacttcaacactttgtgcttggctagacccaagtttgttcatgaggttctagtggagttggacaagaagttccagaccaaccaagccgagcaaaaggcgcctcacttgcttgaaaatagagctcggaagttcttccttgacattatagccaagaagattgacacaaaagtgggcgatgagcgcttgcagggtctcaacatgttgaggaatatgacgagtggtttcatcgataactatgaagggagtggaagcggaagtggtgatgttctcccaggtttgcagatttacacattgttgatgaattccactgatgtacagcacaagagtcttaccaaacttcagaacataatgtcaacttaccatggatatccactcgagctcgagttactcataacgttagctgctatccatccttggttggtcaaaaccacaacctgttgcgccaaattcttcaaccctcaggagcttttagagattgagaagctcaagcacgatgcaaagaaaggatcaaaagtcatgtttgtgcttaatcttgtgttccgggtggtcaagagggagaaaatcctcatattttgtcacaacattgcgccgatccgcctgtttcttgagctgttcgagaatgtattcaggtggaagagaggccgagagctcctgaccttgacaggggatctcgagctgtttgaaagaggcagagtaatagacaaatttgaagagccaggaggccagtcccgtgttctgctggcttcgattacagcctgtgcagaaggcatcagtctaaccgctgcttcacgggtgatcatgcttgattcagagtggaatccttctaagacaaagcaagcaatcgcacgtgcattcagaccgggacagcagaaagtggtgtacgtttaccagctcttgtcgagaggaacacttgaagaagacaaatacaggaggacgacctggaaagaatgggtctccagtatgattttcagtgaagaatttgtggaggacccatctcaatggcaagctgagaagattgaggacgatgttcttagagaaatcgtggaggaagacaaagtcaaatccttccatatgatcatgaagaacgagaaagcttcaacaggtggctgattgctgaatttttccagttcaagtttctgtttcaccatgcc

SEQ ID NO: 2111 - DNA, 1126 bp, Arabidopsis thaliana
ttcacaaccgagattctgaacaactaaaaaacaaaacttatcagaagaacaacactttagcaatcatttaactcgctgtagaaatcaggcgtaaggaaagaatctaaatcaccgaagataacatcatcttcctccgccgttaacttgccggagttttgacacccgaaatacgtctggatatcttccgggaagctccgacgaggcggagcaatctcaggtggcgtcgatggtccgattacctcctctgccactaaaggtgacgacttcaagagctttgttttccgatcatcgttgtcctctgacgaagattgactctgtgataagtcagactcgtggttaggttttataaatgggctaagatcagaatgcggactctcgaggagattattcgcggtatcgatagggttctccggcaccgggagtttcagataacggctgatgtcgaagttagtaacggcgttgagtccacggtactcgatagctgcgatatcgtacgctatagctgcttcttcttgcgtcgcgtaagttccaaggtataaatatttattgccaaacactcttccgattcgagcttcccatctcccattgtggtgatgctttgcaacgcctctgtattttgatacacctcgtgaaaacccactactttttcttctcaaagatccaatatactcttcctttgactggctttccatttctttgatgtcttcttcataattacacaataggattccgagaaaatttacagggaagttcaagatggtgtctcgtccccaatatttcaatgctgctaagtcgtaggcacgtgctgctgcatcttcctcgtcatatgcccctaaatatacttgtcttcctttcttggtctgagtttcgttccaactattcttatcccacaaatgtgcttcgtaccttccagtccatcgatgccttgtgacgcctctatggacggagctacgttggggtggagcgtctcgtggttgcgatcggcgtttgcgtttagctttaaggactactgatgttgctgactgatcatcgccggtttcattctcaaccgaagtttttttgctctgccgtgtgatgtcttccattaccggagaaacttcgacggcgatgaacataaaagaagagg

SEQ ID NO: 2112 - DNA, 757 bp, Arabidopsis thaliana
tctctctctgcattctctcttacacctgtctttatctgaaaaataaccgatgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtaataatttatctctgtttctctgtttttagagacttcaaatttcttagtttgctgctgatttctgagtttagttagttatagactgaacaaacagaggaaagtttatgttacttagcttaggtctagtagtaacttagctataaaaaatctgcttagctaaaaagatctgcttcttggagcacttcaactgtaataaatttatagttgtgttgactttttgaaagtgttattgatgtaactaggacctgattctgctgatactactactcctctatgttccttaggtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgg

SEQ ID NO: 2113 - DNA, 1761 bp, Arabidopsis thaliana
cctatcattcatcgtacacacacactctctatgacaaagctccccacaacactcaaccatctatttgatctgccggggcagatttgccatgtccagtgtggtttttgcaccactattttgctggtataccttaacttcttctcttattctctcccttcctttctcccttcctctctttatatatatgatcatgagtttaatgagtgtaaatgtgttgcaggtgagtgtaccgtttacaagcttgtcaatggtggtgactgtgagatgtgggcattgcacaagccttctctctgtcaatttgatgaaggcttccttcattcctctccatctccttgcttctctctcccatcttgatgaggtttccataacatctatacatagacaaacacacaccatctaaatatgaccaatatatatatatatatacttacttttgattatatgtaaatatatgtgcagaccgggaaagaggaggttgcagctacagatggtgtggaagaagaagcatggaaggtgaatcaggagaaggagaacagtccaacgactttggtttcatcttcagacaatgaagatgaagatgtgtctcgtgtttaccaagttgtcaataaacgtacgtttgagtataaattcaacttaaactttagttttgcgatttctcctttcatcagtcgtctaattatgttttgagtttgtatatatatagcacctgagaagcgacaaagagctccttcagcttacaattgcttcatcaagtaagaaataaattcaacacattacatgtgtatgtatattatatatattcttacaaatttaaccacttaaggttttgagtttgtaaaatggttcttctttgggggttgtattggagcagggaagagatcaggaggttaaaggctcagaatccaagcatggctcacaaggaagctttcagcttagctgccaaaaatgtacttaagcttaattagtcttaagatttaaaagaaaaccctaatatagttttcatctttttgttagcttaattgacagatcgagttagctaataacattttatgatttcaattttttgatttggggatggcgaagtgggcccattttcctccagctcacaacaagagagctgcttcagatcaatgtttttgtgaggaagataacaatgcgatactaccatgcaatgtttttgaggtaatcctcagcaaccatttatattttttaatcactttcgcttcaaaatcaattaccatattcttgacaagtaaactccacaacaagtgtcattttccaaagcaaaccaaataattaaagcattaactagatccaaatagcatcgctctcagtcaaaatttcagaaccctagctagactaattatataaagagaaatcatttactaattattagagtgaaagcaaggagaagggtaagtgagattgtgagaatatatcattgatcttcaactactacaatgtgtgaaatttatgacctaaacccttttatagtattgaagcttacactgcacacagtttacttttatagaaacccattcaactaatttaaaacattgaagctgaatatgtatagttttcaattaatataccaaataattgttgaaatgtttgtgatgcaggaccatgaagaaagcaataatgggttccgagagagaaaggctcagaggcattccatttggggaaaatctccatttgagtaataacaatttgggatatgaaaatttaacaaaaaaataaataatggcgtatgacatgtga

SEQ ID NO: 2114 - DNA, 1773 bp, Arabidopsis thaliana
gtcaccatcacatgtcatacgccattatttatttttttgttaaattttcatatcccaaattgttattactcaaatggagattttccccaaatggaatgcctctgagcctttctctctcggaacccattattgctttcttcatggtcctgcatcacaaacatttcaacaattatttggtatattaattgaaaactatacatattcagcttcaatgttttaaattagttgaatgggtttctataaaagtaaactgtgtgcagtgtaagcttcaatactataaaagggtttaggtcataaatttcacacattgtagtagttgaagatcaatgatatattctcacaatctcacttacccttctccttgctttcactctaataattagtaaatgatttctctttatataattagtctagctagggttctgaaattttgactgagagcgatgctatttggatctagttaatgctttaattatttggtttgctttggaaaatgacacttgttgtggagtttacttgtcaagaatatggtaattgattttgaagcgaaagtgattaaaaaatataaatggttgctgaggattacctcaaaaacattgcatggtagtatcgcattgttatcttcctcacaaaaacattgatctgaagcagctctcttgttgtgagctggaggaaaatgggcccacttcgccatccccaaatcaaaaaattgaaatcataaaatgttattagctaactcgatctgtcaattaagctaacaaaaagatgaaaactatattagggttttcttttaaatcttaagactaattaagcttaagtacatttttggcagctaagctgaaagcttccttgtgagccatgcttggattctgagcctttaacctcctgatctcttccctgctccaatacaacccccaaagaagaaccattttacaaactcaaaaccttaagtggttaaatttgtaagaatatatataatatacatacacatgtaatgtgttgaatttatttcttacttgatgaagcaattgtaagctgaaggagctctttgtcgcttctcaggtgctatatatatacaaactcaaaacataattagacgactgatgaaaggagaaatcgcaaaactaaagtttaagttgaatttatactcaaacgtacgtttattgacaacttggtaaacacgagacacatcttcatcttcattgtctgaagatgaaaccaaagtcgttggactgttctccttctcctgattcaccttccatgcttcttcttccacaccatctgtagctgcaacctcctctttcccggtctgcacatatatttacatataatcaaaagtaagtatatatatatatatattggtcatatttagatggtgtgtgtttgtctatgtatagatgttatggaaacctcatcaagatgggagagagaagcaaggagatggagaggaatgaaggaagccttcatcaaattgacagagagaaggcttgtgcaatgcccacatctcacagtcaccaccattgacaagcttgtaaacggtacactcacctgcaacacatttacactcattaaactcatgatcatatatataaagagaggaagggagaaaggaagggagagaataagagaagaagttaaggtataccagcaaaatagtggtgcaaaaaccacactggacatggcaaatctgccccggcagatcaaatagatggttgagtgttgtcgtcatgttggggagctttgtcatagagagtgtgtgtgtacgatgaatga

SEQ ID NO: 2115 - DNA, 636 bp, Arabidopsis thaliana
gataattcatggtgtgtgtgtatgaagatgctgttttggttagactcgagcaagataagaggatatctctaatcaaagcttgggaagaggctgagaaatccaaagtggagaacaagtgagtcctaaagaagtttatataatccattgttttgatgaatttccaaatttttagttccatgatatttttttttgtgttccctatatatttgtatgtaatctcatttattaactttatgaaacagagctcagaagaagatttcttcagttggagcttgggaaaacagcaagaaagcttctgtggaagctgagctaaaaaagatcgaggtaaaagtgtaattctttattctttcaattttgttgttttatttttaacttttacatgaaatgctttccacttttcacattattctaatttatccgctggaaatatgaatgataacaggagcaactaaataagaagaaagcacactacacagagcaaatgaagaacaagatagctcaaatccacaaggaagctgaggagaagagagcgatgaccgaagctaaacgcggagaagatgttctcaaagccgaagaaatggctgcaaagtaccgtgccaccggaactgctccaaccaagctatttggattcttctg

SEQ ID NO: 2116 - DNA, 1014 bp, Arabidopsis thaliana
ggtcatatatggctggtggtatcggaaaatggcaggatttttctcgttaggacacggcggaggaggaaacactccagacaaccacagaacaaacactaataatccttcttcatcgggaacagaatcttggctttggtgcagaaaccctaactctaacgctgacggtggagaagctggtccttcttacaaaggaacccttgagctatggcaacacccaaacaatcaagaaatcattttccagcagcagcagcaacagcaacaaaggctggatctttacacttccgctgcgggtttaggtgttggaccgagcaaccggagcttaattgaaacttccggcggtgcgttgatgatgatgagaagcggtagcggtagcggcggaccaagctgccaggattgtgggaatcaatctaagaaagactgctctcacatgagatgtaggacttgctgcaagagccgtggccttgactgtcccactcacgtgaagagcacgtgggttcctgccgctaaacgccgagaacgccagcagcagctttctaccggtcagcaaccgcagcaactgggagggagcgtccctaaacgacagagagagcgtatcccggcgagatcgacttccatggcctacactcgtataccttctaacaacacttcagggttggaggttgggaattttccgccggaagttagctcgtcggcagtttttcggtgcgtgcgtgtgagttccgtagatgatgaagaagaagagtatgcatataaaacagctgtgagtataggcggtcacgtcttcaaaggtgttctctacgatcaaggcccggccgagagaagctcctcgggcggtggatctcagccgttgaatctcataaccgcaggcccatcggcctcatcatcaagcccaaacgtgagctgcaacaatggagtcgttggctccacttcagatcattatatcgatcctgcctcacttaattatcctactcccattaacactttcatgactggtacgcacttcttctccaactc

SEQ ID NO: 2117 - DNA, 1458 bp, Arabidopsis thaliana
agaagaagaagagagagctattcaagcttaaagcataaaacaatctctgctccttatatagttcttcactatggaagatttgagtaatcagaatctcctcccgcgtcaatcagatatctccatccctgcggagaagatggattcgtttcaaaagtcgctagaacctccgccgtgttctccggtgaaatcttctcaacaatcagaaacggaagtcacaccgcctcagaaaccaccgcttcaccaatttggtcacaaccaagttcagaagaatcgagtgagcaatcaagatccatcgacctcacgaagacataatgaagttgaatcgaaagagaatactccaaataaacaacaaaaacattgcaattgcaaaaactcaaagtgtttgaaactgtattgtgaatgctttgcttctggatcttattgtaatggttgtaactgtgtgaattgtcacaacaaattggagaatgagtcttcgagacaagtagctatctcggggatcttagagcgtaaccctgatgcgtttaagcccaagattgctggtagtcctcatggaatgaaagatttgcaggagaatgtgcagcaagtgttgcttattggaaagcacagcaaaggatgccactgcaggaaatcaggatgtctcaagaagtactgtgagtgttaccaggcgaatattctatgttcggagaattgtagatgtcaagactgcaagaactttgaaggaagcgaagaaagaaaagctcttcttcatggatctcaggtctcggatacctacatacaacagatgaccaatgcggctgttaaccgtgccatcgacatgtctgcttatctgtaccctcctgaatcaagaaagagaaagagcaaggacatttcagattctgtagtttcatcatacggtgtccaataccagagggcaaaccacgttagaagaaatggtgaaaattctctattttcactccctaacaacaaggccgtgtccggatctaccacaagtgcttacaggtcttcttggtcaaatacattccaaccacatcatgtcagagagctatgttcacttttggtctcaaactcggtgatgtagcaaataaattgtcagacaaagggaggaagaacgacaaaggcccttcttcacttgatggagcccaaagagttgctaatgagatcaatgactcaccagattgtgtccttgatgctaatagaatggacgagaagcctatatctcccgcaacacgtgcattgatgtgtgacgaagaacatgagatcgggtcagagaaagagacatcggcccgagtgaaaacaagccaagagaaagaagacacagacacaagctcggggatttacttagagcaagaaagacagatattgtcaatcttcagggactatctcattcagctctcaaaccgtgcgaggataaatggtaaaaatatcaaaagcaacacaaatccaagttgaaagaaacca

SEQ ID NO: 2118 - DNA, 4053 bp, Arabidopsis thaliana
gctacacgcgtggagtttccttctgtgaagtcgaatcagcgaagtaaaaattgaatctttagggttttcttagtttgtatttacctttttgttttggaaatcaaatctctggcctcgtttttttttttaataatccggaggccttgattagggttttcaaaatctagtagctttgtgtcatgatctttataagataagtaatagatatatgtatttttttgctttttatatcagatacaaattttcaatggcaatttattacaagtttaagagtgcaagggattatgataccattgccatggatggtccttttatatccgtcggtattctcaaagacaaaattttcgaaactaagcatttgggcactggtaaagaccttgatattgtcgtctccaatgcccaaactaacgaaggtttgtcttctatgtcaaatgttgtgctgcgcttttcgtattattagactgtttgcttgcagctgtgatacaatgaactttattttatgttatgattgtttactagctgagctttgtcttattttttttttacttttgtgaactattaggaaatggtttgttggaatatgattcttgaatttctcaggaagctttagtgtactgtgtctcgtgccaatatgattgcaatctgtggcctttatatgttctctgttttgaattttcagagtatctggatgaagcaatgttaatcccaaagaatacatctgtccttattcgtcgggttcctggacgtcctcgcatcacagttattaccacacaagagtactttctcagatctttagtttctatattctttgtctacttatttagctattaaacttaaatagacatgatattaaaagcattgcattttactggtgcatcgttttagctaaacataagttaattgtctgactatcggatttaagaaacttcgggatcctcaatgatgcaaatatcttaactttgcaggcctagaatccagaataaagtggaagacgttcaggctgaaaccaccaattttcctgttgctgatccatctgctgctgaatttgtaagttgattatagtgaacttttctcggcttctgttggcattgactgcacctaattttcttctactacaaaagtactaatgtcatccgtattcacctcttagcctgaagatgagtatgacgagtttgggactgatctttattccattcctgatacccaagatgcccagcatattattccacgtcctcatcttgcaaccgcagacgacaaagtagatgaagaaagcaaaattcaggcgctgattgacactccagcacttgactggcaacaacggtaagcaatcttccagaaatggtgcaggtgaaactgttggattttgtgagaaggtttaacagacctcttatatttattcaatgtaacagacaaggtcaagatacttttggagctggtagaggttatgggaggggtatgcctggaaggatgaatggacgtggttttggtaacttatacttacttttattctttgattttggttgaattctggaatgtcaaaatacagtatacaaaacatttacttctgtcaaaatattttatatttttgttctatttgctcaagttgtaagatacttagtttggttttgctggctggataggaatggaaaggaaaacgccacctccaggttatgtgtgccatcgttgcaatatccctggtatgtcagctctgaaaatctttatttttctctcacttttgtagatggatatataatagataagaagtgttgagagcattttctttgctgtctcaggacattttattcagcattgccccacaaatggagaccctaactatgatgttaagagagttaagccacctactggtatccccaagtccatgttgatggcgaccccagatggttcttattccttgccaagtggcgcagttgcagttctgaaaccaaatgagtaagttgtactgaattagtttgggaatgttgctattgggtacttcttcacatatattgattatagtttaaatgtttgttgtgtcttcaacaaattcagggatgcttttgagaaggaaatggagggattgccatcaacaacacgttctgtaggagaacttccacctgagctaaaatgcccattatgcaaagaagtgatgaaagatgctgcgcttacaagcaaatgttgttacaagagcttctgtgacaagtgtaagttcttttaatgcattctgctgttccacaaaaaccttttctgaccgttgtcagttccagttctacattattatcctttttcactgattcaggtatcagagatcacattatttcaaagtcaatgtgtgtttgtggaagatcagatgtacttgctgacgaccttctaccaaacaagaccctcagggataccataaaccgtattttggaagctggaaacgatagcactgagaatgtgggcagcgttggccatatcccaggtccgtcattattttaaattcatgtgtttttaaactttgtttgattagtcctcactactgaattatcatggacaatatagatttggagtctgcacgctgtccacctcccaaggctctatctcctactacatctgttgcatctaaaggcgagaagaaaccagtacttagtaacaataatgatgcttcaactttaaaggcgccaatggaagttgcagagatcacaagtgcccctcgtgcatctgcagaagtgaatgtagaaaagccagttgatgcatgtgaaagcactcaagggtccgtgattgtgaaagaagcaacagtgtcaaagttgaatacgcaagcccccaaggaagaaatgcagcagcaggttgctgctggagagccaggtaaaataaagatgtactaatattagcttcactggacattgcgaatgattggtgactgatagtccagttcagatttccctactgagattaatcaagctggacctcacatgaaccttttttttttcaattactgaggaacccttgttgtcattcatcaatgtaatacgtacttattgtctctatacaggaaaaaagaagaaaaagaaaccaagagtgcctgggaatggtaaaagctttctttgctacgctgaaggcaatacattgtcagtttcgaagtctatgtgaatcgaatgggaggtctaaaagatggtttgtttatgtgatttattgcagacatgcaatggaatcctgtgccagatctagcaggccctgactatatgatgcaaatgggaccaggtccgcagtacttcaacggcatgcaacctggcttcaatggcgtacaaccaggcttcaacggtgttcaacctggcttcaatggctttcaccctggcttcaatggatttggaggcccgtttccaggcgcaatgcctccatttatgggttacggattaaacccaatggacatgggatttggtgggggtatgaatatgatgcatccagatccattcatggcacaaggatttgggttccctaatataccaccaccccataggtaaaacactcactctatcaaagaagagcaataaagctttctcaacaagtctcatgatggaactttctgtgcatgcgcagggacctagctgaaatgggaaaccgaatgaatctccaacgtgctatgatgggcagagatgaagccgaagcccgaaacgctgagatgttaagaaaacgtgaaaacgagagacgacctgaagggtaaaaagaaaacactcactctatttttactacagattcaaacaaggatatgctaaaacctaaacattggttgttgtttggttgtatatacagtgggaagatgtttagggatggagagaatagcagaatgatgatgaacaacggtacttcagcctctgcatcatccatcaaccctaataaatctgtatgtctccttttgtttgactcatcttcccctctcgctctctctttcttcttttctttgttcacctgtgcttcgctctctcccatttacttttggttatatgttattattatatcagaaaatggctccaaattctcttccctgattccctcattttgcttattttgaaaacc

SEQ ID NO: 2119 - DNA, 2267 bp, Arabidopsis thaliana
ctcaagctatgaacttccatactttgaatcttctacttctctttcttcctcttacttgatcttcctatagcatacttccatcatgtaagttcctttttgtatttttatttctcttacttgctaaagttttatcttcacattttttgatgattagggttttggtttgagattaggggtgaagatgatatagtggagctcttatggaacggccaagtcgttcgaaccagccaaccacaaagaccttcctcgggtaaaccttctcctactccacccattctgcgtggtagcggaagcggcagcggagaagaaaatgctccccttccacttccacttctacaacctccacgtcccctgcatcatcagaatctcttcattcgggaagaagaaatgtcttcttggcttcactattcttacactggtgtcacgtccacaccggctactcatccgcaaagttctgtttccctgccaccaccaccacccattgctccgtacatttccgttctttttcctttcattctcttactctttgcaatttgacgagtctgatattttagggtttggattttggtttgaaattaggagtgaagatgatgtggtggaactcttatggaaaagcggccaagtcgttcaaagcatccagacacagagacccattcctcctcccattttccgcggcagcggaagtgggggaggtgaagaaactgttctgcctctgcctcccctgcatccgtctcatcaaaatatcttcatccaggaagacgaaatggcctcttggctttaccatcccctccgtcaagattatttttcctctggcgtcgcctctacttcagctactcgcccgcaaagttccgcctctctagcaccaacaccaccaccacccagtgttccctacggtcagattcccgttgagagaaggacagagaattttatgaacttcttgaggctaagagggaacatattttccggcggtagagttgaagctggtccggtggttatagaatcgacgcagataggctcaagcgcgaccccgtcgtcttcagccgctgaatcctgtgtaataccagcgactcacggcaccgagagtagagcggcggccattaccggagtatcccgtacttttgcagttcctggtcttggtcggaggggaaaggaggtggcaaccgagacggccggaacatcatattcaggggtaaacaaggccgaaacagagcgggttcaaatacaaccggagagggagacgaaaattaccgaagataagaagagagaagaaaccattgcagaaatccaagtgagtcacagctaccataggttcacctgttgacacgtgcagtgtagcagtcaaggcttaattttatcttgtttcttggcgtacagggaactgaagaagctcatggttcaacgtctaggaagaggtcacgagctgcagatatgcataacctctccgaaagggttcttatattttactttctaggttttaataatggactctttgtttcgtctctccattaaaacgtagtttgtataattgtttaacagagacggagggaaaggatcaacgagaggatgaaaactctgcaagaactccttcctcgctgcagaaaggtctctctcagttatttataacctgtggctgttaaacataaaaaaagttagattctgatgacatctgtttctattctgatcagactgataaagtttcaatgcttgaagatgttatcgagtacgtgaaatcgctacagctgcaaatacaggcatgtactcaaaaactgaatgtgtgttaaagcaaaacacaaccggaaattaagtgctgtggaatagttgaacatggttatttgagtgctatggaatggttatactctttgtttatcaaccagcgtctctgcattttaaacaaccaattttttagatttgatttctgcagattcatcttggaagggttttaaagtgtcatggaagataaatgcaaatcttataagtcatgttcttgaggtcttactcttctgtattgcttcacacgtttacaggattatgttgaagaatctacagcttataactgagattttaatatatgaatcaatgttgttatgccagatgatgtcgatgggacatggtatgatgccaccgatgatgcatgaggggaatacgcaacagttcatgccccacatggccatggggatgaagggtatgaaccggcctcctcctttcgtaccgttccccggcaaaacttttcctaggccgggtcatatggcgggtgtaggtccatcata

SEQ ID NO: 2120 - DNA, 1545 bp, Arabidopsis thaliana
tctcaaagtcataatcttcgaatccaaaaacaaaaaaaaacaatggaactatcattagcattaacatcaacagaccataatccatcgccttcagaggcacatccagatactatggactttctgtctcgagaatggtgtaatttcgctgttcaatcacttcatccagaccctatcctctacgatcgttccattgttcccgtcgagacatcgatcgccaagtttcaaggcgactcaagtcctgtttcttgtgctgtaagtaaccagagattgttttttgttatattttcttcaattttgttggttagtgtttaatttatgatgattgtaaaagtagatgatggatacgagcatgaagatggacgatccagattttaagccctcgatgccttcatggaaaaccaatgatgtgaaggtataacaaattaggtgtgcaaaatatagtttttaaaataacaaaaatcacagtaacgtttaacattatgatatcatagttttcaacatatattcctcatttttatgttgtctatgtttatttgatgcacattcgaatgaaaattcggtatatatatgatttaaattgtaatacgacagcatattggaattgtagaaattgaaaataaaactgctacatgatagaatgacatatacaattaagtgaagaaagttaagagattaaatattgatactataatttgttgaatgatgtgaacagtcatggatatggatgcaacaagcaatgcacccggaattgagctacgaaggctttttccgcaagaaacttgtaaaacccttttggccatttcgtttggttttgatttatcaaatcaacaatattggttttctaaaccaaaacaataatggttttgtagaaacttccatggaaaattacgccgtcgataaagaaatggtggaaagagataaaggcgaaacgaaaggaagaagtgaggctacagagagctgaagtccacgccgccgtgtcattggctggtcttgccgctgctctcgccgccgtggcttcagagaacgctggaaaagatggtggaaacggtcgacctagcacgagggagactgctgtggcttctgctgcggctgtggtggcggcacaatgtgcgcaaatggcagagacaatgggagcaaacagagaccagctcagcacgatgattggttcagccatgaccgggacaagtgttagtgagatactcactctcactgcctcagctacaacttgtaagaagattgttttttgtttttgtttctataagaatgctctgtttctgagacattggtgcttggtaaaataagcgttgagaggtgccgcgacgctgaaagcaagaagaggttgcaagattaatagattgaatggctctgcacctgtgttgcctattgaagactcttcttatttgcctcctgaattcgataagaacacatctgttcttgctaagggaacagatctcttcgtcgagacaccagatggtatataaatcctctgtttttcttgttgaactcctttgttttgtagagagactaaagagatctttggattaa

SEQ ID NO: 2121 - DNA, 1568 bp, Arabidopsis thaliana
gtcgacaagatcatcagactggaaaatggcacaattacccatgatgatcttggttgtcagaagagtcaggggctggccaaaacgttgagtacttcaaccattctgcttcttgttggttccccattgatgatgacccatcttttacatcatgatgagtggtagaagaagtgcagcccattatgagttcttccaatccggaagctgaccttcctcccatcttcccatcattatgttcttcttctccttcttgacgtagttgctgttgtgtctggtaattttcattggggagcaagattctatgaacatgataaggattatcgtcaagaatattaatggaggcatggtgaagcgaagtagatggagaaataatggttgatatcggatgtgtaggctggcttatgttgaatgcatgatgccgttgttgttgttgttgatgatgatgatggtgatgatcatgagccatatgatgtgatgttgatgatgatggttgatgacgatgacgatgttgttctgccattacatcctcacatgtagcgtgcccagtctgaggagtttccctcctcgccacctcatcaaagcttttcataaacggaacaaagctgagctgatccattgcataactcggaagcccagctgcaaccgccgcagccgcagctgctacggccataacgccaccaccaacgccgcctatttcatcggatcgattcggaggattaacattaataatttctctagacgaagaacaactcccaccactagtagtcccactatctctcctcatatgatactctccgccgcctccgccgctactcgcttcaccgccgccaccacctatagcgttcaagctcgatgtagaagacgaccagttgcattgcctaggctgagtttgataaaagatcttagacacaacaagttctccttctttctcttcctcatgtgtccccaaatgatattgatgcattacccaattggttttctccggttttcgattcttaccaaaattggtatacaaaaccaaaatcttcttacaacctttttgcttaccgtttaccataaccggtcttgtcttaccggtcttatgccacctcgtctcaccggagctactacttccttgcaaattattgtcacattctgtttgaatctttcttcgctttcttgttcccgtcgtgtacgcctttgatggtctatgaaagaagtgtcggcttaaaccatctctagtcactccaggaagtttctcgggatgagtgtagcaaatgccgtcttcgccttcaatggttgggatgaattcgtcaatgagagggtgagatttgaagtctttagctaacactttcgcttctaaatgttctatcaattcttgatccgttgggtcaaatttcactcctgctggtaaaccaacccaatcctgttactggtttgccttcgagcttgtggccgcagctaggacacttcttggatccacaaagttgatgttcttcgatcttggcgtctattatatccgaaccagtcaccgaaccagcaggattactcttgttcatctcaatctcgaatatctttgatcaactctctct

SEQ ID NO: 2122 - DNA, 3318 bp, Arabidopsis thaliana
tcatcgtacggattcctatctctcactactcagatgcttccttcttcactttaatcacccttttcgattttcgttttccagctttttgattcctctgtttcaccaagtagacgaagtagaagaagaagaagaagaagaaagttttcacctttactctaaaagtttcactttttatgtctgctttgaagctctgagatcggagaaagcaatatctatggcggaagcaagacgattcagcccagttcatgaattagatgttggacaaatactctcagaagcacgacatcgatggcttcgtcctcctgaaatctgtgaaattttacagaattaccaaagatttcaaatttctactgagccacctactacaccatcaagtgggtctgtttttatgtttgatcgaaaggtgctcagatacttcaggaaagacggtcacaattggaggaagaaaaaagatggaaagactgtgaaggaagctcatgagaggttgaaggcgggaagcgttgatgttctacattgttactatgcgcatggacaggacaatgaaaactttcaaagacgcagttactggttgcttcaggaagaactttcccacatagtttttgttcactacctcgaagttaagggtagtagagtttctacttcttttaaccggatgcaaaggactgaagacgcggctcggtctcctcaagaaactggggacgccttgaccagtgaacatgatggttatgcttcttgcagcttcaatcaaaatgatcatagcaatcattcacaaactactgactcagcaagtgtcaatggttttcactctccagaacttgaagatgctgaatcagcatacaatcagcatggaagttccacagcttactctcatcaagaacttcagcagcctgcaacaggaggaaaccttactggttttgatccttactatcaaatctctttgacgcccagggatagttatcaaaaagagcttcgcacaatccccgtaactgattcttcaattatggtagacaaaagcaaaactatcaacagtcctggagtaacaaatgggttaaaaaacagaaaatccattgattcccaaacctgggaagagattctgggaaattgtggttctggagttgaagccttacctttgcagcctaacagtgagcatgaagtgctggaccaaatactcgaaagctcttttacaatgcaagattttgctagtctacaagagtccatggtcaaaagccagaatcaggagttaaattcaggacttacatctgatcgtaccgtgtggttccaaggacaagatatggagctaaatgctataagcaatctagcttcgaatgaaaaagctccatatctatctacgatgaaacaacatctgttacacggtgcattgggcgaagaaggtctgaaaaagatggacagtttcaatcgctggatgagcaaagaacttggagatgttggtgttatagctgatgcaaacgagtcctttactcaatcaagttcaagaacctactgggaagaagttgagagtgaggatgggtccaatggtcacaactctaggagggacatggatggatatgttatgagtccttccctctcaaaggaacagctctttagcatcaatgacttctctccaagctgggcttatgtgggttgtgaagtggtggtttttgtcactggaaaattcttaaagactcgggaggagactgaaattggcgagtggtcttgcatgtttgggcaaacagaagttccagcagatgttatatctaatggtattctccaatgtgttgctcctatgcatggggctggaagagttcccttttatgtaacatgttccaacagattggcatgcagtgaagtgcgtgaattcgagtataaggttgccgagtctcaagtttttgatagagaagcagatgatgagtctactattgacattcttgaggcaagatttgttaaactgttgtgctcgaaatctgaaaatacaagccctgtttctgggaatgacagtgatttgtcacaattgagcgagaagattagtttactacttttcgagaacgatgaccagttggatcagatgctcatgaatgaaatctcccaagaaaatatgaaaaacaaccttttgcaggaatttctgaaagaaagcttacactcatggcttttacaaaagatagcagaaggtggaaaaggtccaagtgttttggatgaaggtggccaaggtgtattacattttgcagcttctcttggttacaactgggccttagaaccaacaataatcgctggtgtaagcgttgattttcgcgatgtaaatggttggaccgcacttcattgggcagctttctttggcagggagaggataattggttcactcatagctcttggtgctgctcctggaactttaactgacccaaatccagatttcccatcaggaagcacaccttctgatctagcctatgctaatggtcacaaaggaattgctggttatctctcagaatatgccttaagagctcatgtttctttgctcagtctaaatgataaaaatgccgaaactgttgagatggctcctagcccatccagctcatcattgacagactcgttgacagctgtacgtaacgctactcaggcagcagctcggattcatcaggttttcagggctcagtctttccagaagaagcaactaaaagaatttggagataaaaagcttggaatgtcggaggagcgtgctctttcgatgcttgctcctaaaacacacaaatcaggaagggcacatagtgatgattccgtgcaagccgctgctattcggattcagaacaagttccgaggttacaagggaagaaaagactatttgattaccagacaaagaatcatcaaaatacaggctcatgtgagaggttatcagtttaggaaaaactacagaaagataatttggtcagtgggggtattagagaaggtgatattacgttggagacggaaaggagctggtttgcgcgggtttaagtcagaagcacttgttgagaagatgcaagacggaacagagaaagaagaagatgatgattttttcaaacaaggaagaaagcaaacagaggacaggctacaaaaagctcttgcaagagtgaaatccatggttcaatatcctgaagctagagatcaataccgtagattgctaaatgttgtcaacgacatccaagaaagcaaggttgaaaaagctcttgaaaattcagaagcaacttgttttgatgatgatgatgatctgatagatattgaagcattgttggaagatgatgacacattgatgttgcctatgtcctcatctttgtggaccagttaaatcac

SEQ ID NO: 2123 - DNA, 753 bp, Arabidopsis thaliana
ttacgtatctgcatgattattagttataaaagttattgcaaacattaaattactttcatagagagcaatcattatattaaggtaatttaattttattatatatagtcaagatttaaaggaataaagaaaagattctcaaaacatttcatctctctccaacaactattcaccacattcaatggagtcaccaccactatacgagatatcctcaagctcttcttctgaaaaacctagacaccatttccaatcccttgatctcttccctaacctcaaccaaaactcttgtatcaacaataccctaattgagcctttaccgcttattgatcgcataaacttgaactcaaacctagacctaaaccctaatcccttgtatgcggaagaaggagagcaagaggaggaagaagaagaagaccgtgaagtggacgtggacttacacatcggccttcctggttttggtaaaccaagcaatgatgctaaacagctgaagaagagaaatgggaaggagatcgccacatatgacgccggaaaaggcatcgagaatgaactttccggaaaggcatactggatcccggcgccggagcaaattctcatagggttcactcatttttcttgccatgtatgcttcaagacattcaatcgctacaacaatcttcaggtacgagtcaatatatctcatgcgcattgcttttccatgcacaaacatatataataaattcatcttatagagttatatctccggatctaatgttatga

SEQ ID NO: 2124 - DNA, 579 bp, Oryza sativa
ggtccgatccgtaacagtagtagctagttaatttgattattgtccgtccgcggccggtcagtggtcgcaatcgatcgatcgatatcatggacggcgacggcggcggcggatgggacgatcagggcaacggcggcggcgagacgaccaagtaccgtggcgtgcgtcgccggccttctggcaagttcgcggcggagatccgtgactccagcaggcagagcgtccgcgtctggctgggaaccttcgacaccgccgaggaggctgcgcgggcttacgaccgcgccgcctacgccatgcgcggccacctcgccgtcctcaacttccctgctgaggcgcgcaactacgtgcggggatcaggctcgtcgtcctcgtcccgacagcatcagcagcggcaggtgatcgagctggagtgcctagacgaccaagtgctgcaagagatgctcaagggtggcgacgatcagtacaggtcagcagctgggagcaagaggaataactactagctatatatgctgctaacctacttacaatcgcgatacatatcgaggtttggggattttcttctcacctgtgtgcagaggctgc

SEQ ID NO: 2125 - protein, 136 aa, Oryza sativa; identical to SEQ ID NO: 690

SEQ ID NO: 2126 - DNA, 514 bp, Oryza sativa
atcgatcatctgctacgaactcaccctatatatatatactccatcttaggagctgcttgatcgatcgacatatatataactaatggatcatcatcatcagcagcagcagcaggagggtgagctggtggccaagtacaggggcgtgcggcggcggccgtggggcaaattcgcggcagagatccgcgactcgagccggcacggcgtccgcgtgtggctgggcaccttcgacacagccgaggaggccgctcgcgcctacgaccgctccgcctactccatgcgcggcgccaacgccgtcctcaacttccccgccgacgcccacatctacgcccgtcaactacacaataataacgccgctgctggctcttcatcttcctcttccgccgccgccgcagcagccaggccgccgccgatcgagttcgagtacctcgatgaccacgtcctgcaggagatgctccgagaccacaccaccaacaagtagcttactactccactatatatgctgcctgctgcttgt

SEQ ID NO: 2127 - protein, 131 aa, Oryza sativa
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 2128 - DNA, 375 bp, Oryza sativa
atggaggacaaccggagcaaggacacggcgaccaagtaccgcggcgtgaggaggcggccgtggggcaagttcgcggcggagatccgcgacccggagcgcggcggggcgcgcgtctggctcggcaccttcgacaccgccgaggaggcggcgcgtgcctacgaccgcgcggcctacgcccagcgcggcgccgccgccgtgctcaacttcccggccgccgccgccgccggcaggggtggaggagccggcggcgccgcttccgggtcgtcgtcgtcgtcgtccgcgcagcgcggcaggggcgacaagatcgagttcgagtacctcgacgacaaggtgctcgacgatctcctcgacgacgagaagtaccgtggtaaatga

SEQ ID NO: 2129 - protein, 124 aa, Oryza sativa
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 2130 - DNA, 321 bp, Oryza sativa
gctctaaactaccataaaatcttaactcggcattttttttttcacgctaatggaaagtagcggtggaagccagctgggaaagaattccaaaacaagtgatggtcgtgaaacaaaagaagttaatagcactgcgcaaaattttgttcatttcacagaagaagaggaagatattgttttcagaatgcacaggcttgtcgggaacaggtgggaacttatagctggaagaataccgggaaggacagcagaagaagtagagaagttctgggcaattaaacatcaagccacatgatagcagaaagaggatgtttgccccaaaagtag

SEQ ID NO: 2131 - protein, 79 aa, Oryza sativa
MESSGGSQLGKNSKTSDGRETKEVNSTAQNFVHFTEEEEDIVFRMHRLVGNRWELIAGRIPGRTAEEVEKFWAIKHQAT

SEQ ID NO: 2132 - DNA, 356 bp, Oryza sativa
cataaggtcataacaagggtctgaggatcttagctagcacaagatctcaactcggcatttcattggagtttttcacgcctaatggatagcagcagtggtagccagggaaagaattccaaaaccagtgatggttgtgaaacaaaagaagttaataacactgcacagaattttgttcatttcacggaagaagaggaagatctcgttttcagaatgcacaggcttgttgggaacaggtgggaacttatagctggaagaatccctggaagaacagcaaaagaggtagaaatgttctgggcagtaaagcaccagaatacataaggggggaaaaagggtgtatgccctaaaagtagcgtaca

SEQ ID NO: 2133 - protein, 78 aa, Oryza sativa; identical to SEQ ID NO: 1065

SEQ ID NO: 2134 - DNA, 1231 bp, Oryza sativa
ggccgcttctcttctccagcgtccgatctccccctctcgcctctccgcctcacctccgctccgcttcccacccccgcttcctctctctctcctctccccccccctctctctctctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggaggaggggggagccacgagagcgggagcccgagggggggagggggaggagggggaggtgggggtggggggggcccactcgtccggcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattcccaaaaaaaaaaaaaaaaaaaaaaaaaaaa

SEQ ID NO: 2135 - protein, 185 aa, Oryza sativa
MADGPGSPGGGGGSHESGSPRGGGGGGGGGGGGGPLVRQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 2136 - DNA, 610 bp, Oryza sativa
tggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggatagtgaaaattttcagtaactggtgtcctctgtgagttattatccatctgttaaggaagaacccacattagggc

SEQ ID NO: 2137 - protein, 164 aa, Oryza sativa
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 2138 - DNA, 837 bp, Oryza sativa
gtcgagatccggcggccggtggcgtcctcctccctctccctcctccccaaccaacggcgctgatcccctccgccatctccgtccatctccgcctaaaaaaactaagcgatgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtaggacgaggagtgtgatagcatctaggaaggagaaccatcgtttttagggaaagaacgctccagcatcctgttatgttgtaagcaggatgcttctaaagttccaataccttgttaccacgaatgttagtcgtcgttctttttgaaatgttcttgtgttagccaggatgtccaaatttgttgtaggttctagttcagtcgtgtgttgtgtggttgtgtctaaccatatttggccgtttccggctgtcctgcatatgctaaattcagaggggtaaagagatctaagaaaaaaaaaaaaaaa

SEQ ID NO: 2139 - protein, 143 aa, Oryza sativa
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYRETEGDTKGSRASELPVKKDVVLNGDPGSSFEGM

SEQ ID NO: 2140 - DNA, 720 bp, Oryza sativa
gcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaaaacaggggcgcttgacatcgctccgagacgagtagcatgcaccat

SEQ ID NO: 2141 - protein, 219 aa, Oryza sativa
MPDSDNDSGGPSNYAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASTTGAGTSAASTTPPQQQHTANAAGGYAGYAAPGAGPGGMMMMMGQPMYGSPPPPPQQQQQQHHHMAMGGRGGFGHHPGGGGGGSSSSSGHGRQNRGA

SEQ ID NO: 2142 - DNA, 761 bp, Oryza sativa
cctctcctcttcgtcttcctcctcgccttcgcttcgactgcttcgatcgagggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggt

SEQ ID NO: 2143 - protein, 224 aa, Oryza sativa
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPPPPHHHHHQMVMGGKGAYGHGGGGGGGPSPSSGYGRQDRL

SEQ ID NO: 2144 - DNA, 920 bp, Oryza sativa
ccaggtcattgagacttgagagacatggcagggaacaaaaagcgtggtatagtagtatagtcagtactaggattagtacttgataactagcacaacaaaaagctactatcatttttgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtgtacactgcatgcatgcgtggagggtcaaacagagtcaagactcttgtggtggtttcaataagtctctagtgacaatataagttgtgtatcgttgtttcctttgtaaaaaaaaaaacgtcatgtatcgttgtgtgtcctcatccggtaatcctttacgtgggtgggttatggc

SEQ ID NO: 2145 - protein, 193 aa, Oryza sativa
MIILIVPLHLFWMSGGRNMDQVKKAAVRSDGVGGSATNAELPMANLVRLIKKVLPGKAKIGGAAKGLTHDCAVEFVGFVGDEASEKAKAEHRRTVAPEDYLGSFGDLGFDRYVDPMDAYIHGYREFERAGGNRRVAPPPPAAATPLTPGGPTFTDAELQFLRSVIPSRSDDEYSGSSPAIGGYGYGYGYGKNM

SEQ ID NO: 2146 - DNA, 257 bp, Zea mays
ctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatt

SEQ ID NO: 2147 - protein, 78 aa, Zea mays
MDSSSGSQDKKFRDNDRPEAKEANSTAQHLVDFTEAEEDLVSRMHRLVGNRWEIIAGRIPGRTAEEVEMFWSKKYQER

SEQ ID NO: 2148 - DNA, 534 bp, Zea mays
tcgacaagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctagc

SEQ ID NO: 2149 - protein, 164 aa, Zea mays
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 2150 - DNA, 735 bp, Zea mays
cggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgccgcctcagccgccacagcagcagcagcaacatcaacagcatcacatggcaataggaggcagaggaggattcggccaacaaggcggcggcggcggctcctcgtcgtcgtcagggcttggccggcaagacagggcgtgagttgcgacgatacgtcagaatcagaatcgctgat

SEQ ID NO: 2151 - protein, 222 aa, Zea mays
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPPPQPPQQQQQHQQHHMAIGGRGGFGQQGGGGGSSSSSGLGRQDRA

SEQ ID NO: 2152 - DNA, 803 bp, Zea mays
tttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtcggagttcatctccttcatcaccggcgaggcctccgacaagtgccagcgcgagaagcgcaagaccatcaacggcgacgacctactctgggccatgaccacgctcggcttcgaggactacgtcgagccgctcaagctctacctccacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatgggacagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggcatggctcccgccgccggcttcttgcttggtgtcggtaattagcgctggtggcctgcgctggttaagttcaccat

SEQ ID NO: 2153 - protein, 212 aa, Zea mays
MPDSDNESGGPSNAEFSSPREQDRFLPIANVSRIMKKALPANAKISKDAKETVQECVSEFISFITGEASDKCQREKRKTINGDDLLWAMTTLGFEDYVEPLKLYLHKFRELEGEKAATTSASSGPQPPLHRETTPSSSTHNGAGGPVGGYGMYGGAGGGSGMIMMMGQPMYGGSPPAASSGSYPHHQMAMGGKGGAYGYGGGSSSSPSGLGR

SEQ ID NO: 2154 - DNA, 1322 bp, Zea mays
tattgtctatgagggaagcagatcctctacgctgcaattgggccactgacatgtgggaccaggtctagattggacccacacatcaatgaccgaaatgcagaagagggtctcgttgccactgtaagctatctcctagagttcagagcagggcaagaatcttgcaatgctcacatgaacataatataatcgttgtgttagctatgcgtcggcatcactaccgtcctcccactggcatctcccgtctactattttgggacgaacagaacagagacactagctaactagcttattagcttgctcccctccttcctttcaagctttaaaaggagaccatctcttgcaccacctcttcatccatccggccaagcaaggggcatgaagaacaggaagggctacgggcaccagggccacctgctgagccccgtgggcagcccgctgtcggacaacgagtccggcgccgcggcagcggccggcggcggcgggtgcgggagcagcgtggggtactgcggcggcggcggcggtgagtcgccggccaaggagcaagaccggttcctgccgatcgccaacgtgtcgcgcatcatgaagcgctccctgccggcgaacgccaagatctccaaggaggccaaggagacggtgcaggagtgcgtgtccgagttcatcagcttcgtcacgggggaggcctccgacaagtgccagcgcgagaagcgcaagaccatcaacggcgacgacctgctctgggccatgaccacgctcggcttcgaggcctacgtcgccccgctcaagtcctacctcaaccgctaccgcgaggccgagggcgagaaggccgccgtgctcggcggcggcgcgcgccacggcgacggcgcggcgcggcggacgacgccggcccactcgccgcgcaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggccaggttgtgaccgtcgccgtccatgcttgcatggccatggcatggctcagtcccgccgccggcttcttgcttggtgtcggtaattagcgctggttaagttaaccttcggtttttccccccttttcttttcgtggtaagtaatgttgtgctgaatggagccagtgatatggttaagatagctccataacctctcggtaaaaaaaa

SEQ ID NO: 2155 - protein, 246 aa, Zea mays
MKNRKGYGHQGHLLSPVGSPLSDNESGAAAAAGGGGCGSSVGYCGGGGGESPAKEQDRFLPIANVSRIMKRSLPANAKISKEAKETVQECVSEFISFVTGEASDKCQREKRKTINGDDLLWAMTTLGFEAYVAPLKSYLNRYREAEGEKAAVLGGGARHGDGAARRTTPAHSPRNGAGGPVGGYGMYGGAGGGSGMIMMMGQPMYGGSPPAASSGSYPHHQMAMGGKGGAYGYGGGSSSSPSGLGR

SEQ ID NO: 2156 - DNA, 268 bp, Zea mays
cctaacccctctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagattt

SEQ ID NO: 2157 - protein, 78 aa, Zea mays; identical to SEQ ID NO: 2147

SEQ ID NO: 2158 - DNA, 302 bp, Glycine max
agaacttgttattgcaatgactgacatagatcgctcctctgataatgtttcttctgattctattgagaaatcaagccaagtttctgatgttgaattttctgaagctgaggaaatccttattgccatggtgtataatctggttggagaaaggtggtctttgattgctggaagaattcctggaagaactgcagaagaaatagagaaatattggacttcaagattttcgactagccaatgaagtggcagaaattaaacgaagcaagacaattttgggtgcctgcaactcattatacagtgactta

SEQ ID NO: 2159 - protein, 73 aa, Glycine max
MTDIDRSSDNVSSDSIEKSSQVSDVEFSEAEEILIAMVYNLVGERWSLIAGRIPGRTAEEIEKYWTSRFSTSQ

SEQ ID NO: 2160 - DNA, 258 bp, Glycine max
gagaacttgttattgcaatggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 2161 - protein, 74 aa, Glycine max
MADIDRSFDNNVSAVSTEKSSQVSDVEFSEAEEILIAMVYNLVGERWSLIAGRIPGRTAEEIEKYWTSRFSTSQ

SEQ ID NO: 2162 - DNA, 250 bp, Glycine max
gttattgcaatggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 2163 - protein, 74 aa, Glycine max; identical to SEQ ID NO: 2161

SEQ ID NO: 2164 - DNA, 264 bp, Glycine max
attctccacgcctccttgcaatggctgactcggatctctcttcaagtcaaatttctacacattctactgattcaggaaatcgagggtcttccaaagttgaattttctgaagatgaggaaaccctcatcatcaggatgtataaactggtaggggagaggtggtctataattgctggaaggattcctggaagaacagcagaggaaatagagaagtattggacttcaagattctcgggctctagtgaatgaagctccggagtactac

SEQ ID NO: 2165 - protein, 75 aa, Glycine max
MADSDLSSSQISTHSTDSGNRGSSKVEFSEDEETLIIRMYKLVGERWSIIAGRIPGRTAEEIEKYWTSRFSGSSE

SEQ ID NO: 2166 - DNA, 268 bp, Glycine max
actcttctagctccttgcaatggctgactcggatcgctcttctagtgaagtttctacacattctactgattcagggaagcgagggtcttccaaagttgaattttctgaagatgaggaaactcttatcatcaggatgtataaactggtaggggagaggtggtctttaattgctggaaggattcctggaagaacagcagaggaaatagagaagtattggacttcaagattctcaggttctagtgaatgaggtgccaagagttctactacc

SEQ ID NO: 2167 - protein, 75 aa, Glycine max
MADSDRSSSEVSTHSTDSGKRGSSKVEFSEDEETLIIRMYKLVGERWSLIAGRIPGRTAEEIEKYWTSRFSGSSE

SEQ ID NO: 2168 - DNA, 285 bp, Glycine max
cagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgta

SEQ ID NO: 2169 - protein, 80 aa, Glycine max
MSTTATTTSEEVSSNEWKVIHMSEQEEDLIRRMYKLVGDKWNLIAGRIPGRKAEEIERFWIMRHGDAFSVKRNGSKTQDS

SEQ ID NO: 2170 - DNA, 555 bp, Glycine max
tcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttcta

SEQ ID NO: 2171 - protein, 174 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 2172 - DNA, 556 bp, Glycine max
gtagggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatc

SEQ ID NO: 2173 - protein, 173 aa, Glycine max
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 2174 - DNA, 547 bp, Glycine max
taaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcaacagcagcagcatcagggacacgtgtatggatctggaactactactggatcagcatcttctgcaagaactagataacaggtttatgca

SEQ ID NO: 2175 - protein, 171 aa, Glycine max
MAESDNESGGHTGNASGSNEFSGCREQDRFLPIANVSRIMKKALPANAKISKEAKETVQECVSEFISFITGEASDKCQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 2176 - DNA, 1818 bp, Glycine max; identical to SEQ ID NO: 802

SEQ ID NO: 2177 - protein, 170 aa, Glycine max
MADSDNDSGGAHNGGKGSEMSPREQDRFLPIANVSRIMKKALPANAKISKDAKETVQECVSEFISFHSPGGLAGECQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 2178 - DNA, 553 bp, Glycine max
gatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagggacacgtgtatggatctggatcagcatcttctgcaagaactagatagcatgtgtcatct

SEQ ID NO: 2179 - protein, 177 aa, Glycine max
MAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQGHVYGSGSASSARTR

SEQ ID NO: 2180 - DNA, 600 bp, Glycine max
tcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagacagtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttat

SEQ ID NO: 2181 - protein, 188 aa, Glycine max
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPR

SEQ ID NO: 2182 - DNA, 528 bp, Glycine max
ggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattc

SEQ ID NO: 2183 - protein, 165 aa, Glycine max
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYHQGHVYGSPAYHHQVPGPTYPAPGRPR

SEQ ID NO: 2184 - DNA, 568 bp, Glycine max
tcgacttgtagggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttctacgcatcgc

SEQ ID NO: 2185 - protein, 174 aa, Glycine max; identical to SEQ ID NO: 2171

SEQ ID NO: 2186 - DNA, 602 bp, Glycine max
ttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcagagttcatcagcttcatcaccggcgaggcctccgacaagtgccagcgcgagaagcgcaagacgatcaacggcgacgacctgctctgggcgatgaccactctgggcttcgaggactacgtggagcctctcaaaggctacctccagcgcttccgagaaatggaaggagagaagaccgtggcggcgcgtgacaaggacgcgcctcctcttacgaatgctaccaacagtgcctacgagagtgctaattatgctgctgctgctgctgttcctggtggaatcatgatgcatcagggacacgtgtacggttctgccggcttccatcaagtggctggcggggctataaagggtgggcctgcttatcctgggcctggatccaatgccggtaggcccagataaagagcctattatta

SEQ ID NO: 2187 - protein, 191 aa, Glycine max
MADSDNDSGGAHNGGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPLTNATNSAYESANYAAAAAVPGGIMMHQGHVYGSAGFHQVAGGAIKGGPAYPGPGSNAGRPR

SEQ ID NO: 2188 - DNA, 579 bp, Oryza sativa
atggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccaggtcaatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggtcaacctactaaccataggaagtctcatccaccaagaaaacatggaactgtacagaaaggtcaacctgattcgccaagaaaatgctgagctgtacaagaaggtaagccaacaaaatgatgctgagcaaaccacacctcctaaactagggtaa

SEQ ID NO: 2189 - protein, 192 aa, Oryza sativa
MGRGKIVIRRIDNSTSRQVTFSKRRNGIFKKAKELAILCDAEVGLVIFSSTGRLYEYASTRSMKSVIDRYGRAKEEQQHVANPNSELKFWQREAASLRQQLHSLQENHRQLMGQDLSGLGVKELQTLENQLEMSIRCIRTKKVNLLTIGSLIHQENMELYRKVNLIRQENAELYKKVSQQNDAEQTTPPKLG

SEQ ID NO: 2190 - DNA, 1105 bp, Glycine max
gtcttgtcctccctccttcttcttctctcccctgcttctctttctccttccaaatcactcctataattttcaagtccaaggtggtatttgtgaaggaaccctaaaatataattttttgaccaaagatggggagaggtaagattgcgattcgaaggatcgacaactccactagccggcaagtgactttctcaaagagaagaaatggattgctgaagaaagctagagaattatcaattctttgtgatgctgaagttggattgatggtgttctccagcactgggaagctttatgactatgcaagcacaagcatgaaagcggttattgaacgctacaacaagctaaaagaggaaccccatcacctcatgaatccggcttcagaagcgaagttttggcagacagaagcagcaagcttgaggcagcagcttcagtacttgcaggaatgccacaggcaattaatgggggaagaacttatgggtttgggtattaaagaactacaaagtctggaaaaccaactggagatgagtttaaagggtgtccgcatgataaatgaccagattgtaactaatgagatcgaagaactacgcctaaatggaaatctcattcatcaagaaaatgttgaactctatcaaaagatggagcagatccaaaaagaaaatgcagagctacagaagaaggtttatgaagcaaggagtacaaatgaagaaaatgtggcatccaatccttcttataaggtcagaaatggatatgatttacatgcacctattagtctccaactaagtcagccacagcctcaatacagtgaaccatcagccaaagcaataaaactcggattgcagctgcattagcaaaaactgttcagtaatcggggaggttgtcattttgtaccaagcagccaacaaagcaacaacttctccctagaatgatcagacttctttgagttggatcttgtagttcatcaaccacatttgttccattcaacagtacaacatatgtatggtacgagattatctaccaagaagcatacaattgctgttaaggatcagacataatgtttacctttgtaaattttgtgcaataaaaacataacacaattgagtctggtgtt

SEQ ID NO: 2191 - protein, 239 aa, Glycine max
MGRGKIAIRRIDNSTSRQVTFSKRRNGLLKKARELSILCDAEVGLMVFSSTGKLYDYASTSMKAVIERYNKLKEEPHHLMNPASEAKFWQTEAASLRQQLQYLQECHRQLMGEELMGLGIKELQSLENQLEMSLKGVRMINDQIVTNEIEELRLNGNLIHQENVELYQKMEQIQKENAELQKKVYEARSTNEENVASNPSYKVRNGYDLHAPISLQLSQPQPQYSEPSAKAIKLGLQLH

SEQ ID NO: 2192 - DNA, 1019 bp, Glycine max
attcggctcgaagggcgctttgtctgttataatcaacgcgctcctcacgagtgaatttctggttcggaaggatctgattgttagggtttggtatggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaaattttggcaaagggaggcagcaatgttaaggcaacaattacacaatttgcaagaaagtcaccgcaggaaaatgatgggggaagaactgtcaggcttgacagtcaaagaattaccaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctcacaaatggtctaggcataggagaggatttgcaagtgcctgtgaatctccagctaagccagccaagcaccagcaacaacactacaaggcaccttcaggaactacaaaaatgggcagattgcaattgcattgatccatatacaggatgcgtgtgtttcacaattgctatcaagaaaaatggactcagatttaaacctcgatgtcttcgtataaatgttgtggcatatagaccacagacaaattggcttaaagattttaatttgaaattatcagaaaaagaaaaggcaaccctagcatgtatgtaagaaacaatgaaagcatcttatgagaaaccaagactcaaatcaaggaagaaattcttccacccgccc

SEQ ID NO: 2193 - protein, 286 aa, Glycine max
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELPNLENQLEISLHGVRMKKDQLLMGEIQELNRKGNLIHQENVELYKKVYGTQDDNETNRDSVLTNGLGIGEDLQVPVNLQLSQPSTSNNTTRHLQELQKWADCNCIDPYTGCVCFTIAIKKNGLRFKPRCLRINVVAYRPQTNWLKDFNLKLSEKEKATLACM

SEQ ID NO: 2194 - DNA, 1074 bp, Zea mays
gcgcgagagagaaagagagcagcttctccatctagctagtagttagagagatgtagtactagctagctagctagtaccaccggcgacaaggtagttaggtttctcctctttctctctctagatctgtgctgctaggaaggatcggagatggggagagggaagatagagatcaagaggatcgacagcgcgacgagccggcaggtgaccttctccaagcgccgcagcgggctgttcaagaaggccaaggagctcgccatcctttgcgatgccgaggtcggcctcgccgtcttctccagcaccggccgcctgtatgacttcgctagcaccagcatgaaatgtgtgattgaaagatacagcgaggcaagagaggaacaccgtcagactatgagcgcaagtgctgaggccaagttctggcaaagcgaggcagaaagcttgaggcagcaactgcataacttaaaagagcaccatcggcagttgttgggtcagcagctttctggcctgaacgtgggagatttgcagaatttagagaataagctggagacgagcctaagaaatattcgtctgaaaaaggaccaacttattttttatcagattcaagaattaaacaggaagggaagcctcatgcaccaggaaagcatggaactatacaacaaagttaaccttcttcatcaacataacactgaattacggagaaaggtgtatggacaaggagtaaataatgagcaaacaagtactactgttagacacagtactcggaatacagagaatcttccgatcaatcttgagctaagtgtgcaaagggacaaatcagaaacaccaagtgtagggtgagatttttgtccaaacttcaggataactcagagtcagtaaaccagatgatttaataaagaacactgaaagtgccataagactttaaatacagtgaggataactaaaccgagtgataagaaatggatatcgttggttgaattgcaagacctaacagctaaactttaagctgctagatgcgattgtttatgtatgaagaagaatgttgattttaatttagcttttcatataaaaaaaaaaaaaaaa

SEQ ID NO: 2195 - protein, 227 aa, Zea mays
MGRGKIEIKRIDSATSRQVTFSKRRSGLFKKAKELAILCDAEVGLAVFSSTGRLYDFASTSMKCVIERYSEAREEHRQTMSASAEAKFWQSEAESLRQQLHNLKEHHRQLLGQQLSGLNVGDLQNLENKLETSLRNIRLKKDQLIFYQIQELNRKGSLMHQESMELYNKVNLLHQHNTELRRKVYGQGVNNEQTSTTVRHSTRNTENLPINLELSVQRDKSETPSVG

SEQ ID NO: 2196 - DNA, 1209 bp, Zea mays
gaattcccgggtcgacccacgcgtccgcccacgcgtccggtcgtcctcttctctcgcctccaataattcgtaaccattctccttccaggccgggctcctgctggccggagttcccatctccctctttccttctcggttactatccgtgagtgtgcctgcccccgtgtgtgcgcgtgcaagatcgaccgggcgcagcttcacgatggggcgcggcaagatagtgatccgccggatcgacaactccacgagccggcaggtgacgttctccaagcggcggaacgggatcttcaagaaggcaagggagctcgccatactctgcgacgcagaggtcgggttggtcatcttctccagcaccggtcgtctctatgaatacgccagcacaagcataaagtcagtgattgatcgatatggtcgagcaaaggaggaggagcatgtagcagaccccaacacagagcttaagttctggcaaagggaggcagcaagcttgagacaacaactgcacaacttgcaagaaaatcatcggaggcagttgatgggacaaaatctttctggactaggtgtcaagggacttcaaaatctagaaaatcagctagagatgagcatttgttgcatccggacaaaaaaggaccaactcttggttgacgaaattcacgaactgaatcgaaagggaagtctcatccaacaagacaacatgggattacacagaaaggtcaacctaattcgtcaagaaaatgccgaattatataagaagctctatgagaaagaagcagaaggtgaagtcaaccgagattcaacaactccgtacaactttgtagttgcagagggtgccaacgttcctatccatcttgagcttaatattccactgcaagaaaatggtgttgagcaacctgtggctcctaaattagggttgcaattaaatcaatgaagacatgcaggacattgcctttgttctcattgtccttgaagtctgcaactcaaagcagcctaaaatgataggttgtaacaggcctaaaaacattgcaagacaaataaagtatgcatgccagagacagtggcaatggtagtgcaaatctatctcaaataacttgtgttatattgaataatccagcaaatggtttgttttttacacgttatgcaagtttgtttgaccaaaatggtatgtaacatgtacaaatttccaagtgaacttattgaaaaaattctataaaa

SEQ ID NO: 2197 - protein, 240 aa, Zea mays
MGRGKIVIRRIDNSTSRQVTFSKRRNGIFKKARELAILCDAEVGLVIFSSTGRLYEYASTSIKSVIDRYGRAKEEEHVADPNTELKFWQREAASLRQQLHNLQENHRRQLMGQNLSGLGVKGLQNLENQLEMSICCIRTKKDQLLVDEIHELNRKGSLIQQDNMGLHRKVNLIRQENAELYKKLYEKEAEGEVNRDSTTPYNFVVAEGANVPIHLELNIPLQENGVEQPVAPKLGLQLNQ

SEQ ID NO: 2198 - DNA, 1268 bp, Zea mays; identical to SEQ ID NO: 1757

SEQ ID NO: 2199 - protein, 256 aa, Zea mays
MGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIPRRVKLPSYDAEGNYLL

SEQ ID NO: 2200 - DNA, 1635 bp, Oryza sativa
gaccctcaccacgcctccccatacggatcgcctcatggaggccgccgttgctgctgcggctgcggccgccggggcggtgacgacggcggtcgcgcctccgcccggcgcggcggtcagcaacggggtggcgaccgcgccgccgccgttcctgatgaagacgtacgagatggtggacgacccggccaccgatgccgtcgtctcatggggccccgggaacaacagcttcgttgtgtggaacacccccgagttcgcgcgcgacctcctccccaagtacttcaagcacagcaacttctcctccttcgtcaggcagctcaacacctacggatttaggaaagttgatccagataggtgggagtttgcaaacgaaggttttcttagaggacaaaagcatctactgaagaccatcaacagaaggaaaccaactcatggaaacaaccaagttcagcagcctcagttgccagctgctcctgtacctgcttgcgtagaagtggggaagtttgggatggaagaagagattgagatgctcaaaagggataaaaatgttttaatgcaggaacttgtcaggctgagacaacaacagcagacaacagatcatcagctgcagactttgggcaagcgtcttcaaggaatggagcaacggcaacaacaaatgatgtctttcctggctaaggcaatgcatagtcctggcttcctagcacaatttgtacagcaaaacgaaaacagcagaagaagaatagttgctagtaacaaaaagaggaggctaccaaagcaggatggttcgttggactctgaaagtgcttcattggatggacaaatagtaaaatatcaacctatgatcaatgaagcagccaaagcgatgctaaggaagatcctaaagctagattcttcacatagatttgaatccatgggcaattcagataatttccttcttgagaattatatgccaaatggtcaaggtcttgacagctcttcatcaactcggaattctggtgttacccttgcagaggtcccagctaactcaggtttgccatatgtagctacaagctctggactttcagctatttgttcaacttcgactcctcagattcagtgcccagttgttttggacaacggcatacccaaagaagttccaaacatgagtgcggtgccttctgttccgaaggctgtggctccaggcccaactgatatcaatattctggaattcccagatttgcaagatatagtagctgaagaaaatgttgatattcctggagggggctttgaaatgcctggtcctgagggtgtattctctttgcctgaagaaggtgatgatagtgttcccattgagactgatgagattttgtacaacgatgacacccagaaacttcctgctatcattgattctttctgggaacagttcctggtggctagccctctatctgttgataatgatgaagtcgattcaggtgtactagaccaaaaggaaacacaacaggggaatggatggaccaaagctgaaaacatggctaaccttacagaacagatgggcctcctgtcatcacaccatacaggatgatgaggtacaataggacatacttagccaccatttgtcaaggtaccctgggatctcggtaataaactcccacatcatcacct

SEQ ID NO: 2201 - protein, 506 aa, Oryza sativa
MEAAVAAAAAAAGAVTTAVAPPPGAAVSNGVATAPPPFLMKTYEMVDDPATDAVVSWGPGNNSFVVWNTPEFARDLLPKYFKHSNFSSFVRQLNTYGFRKVDPDRWEFANEGFLRGQKHLLKTINRRKPTHGNNQVQQPQLPAAPVPACVEVGKFGMEEEIEMLKRDKNVLMQELVRLRQQQQTTDHQLQTLGKRLQGMEQRQQQMMSFLAKAMHSPGFLAQFVQQNENSRRRIVASNKKRRLPKQDGSLDSESASLDGQIVKYQPMINEAAKAMLRKILKLDSSHRFESMGNSDNFLLENYMPNGQGLDSSSSTRNSGVTLAEVPANSGLPYVATSSGLSAICSTSTPQIQCPVVLDNGIPKEVPNMSAVPSVPKAVAPGPTDINILEFPDLQDIVAEENVDIPGGGFEMPGPEGVFSLPEEGDDSVPIETDEILYNDDTQKLPAIIDSFWEQFLVASPLSVDNDEVDSGVLDQKETQQGNGWTKAENMANLTEQMGLLSSHHTG

SEQ ID NO: 2202 - DNA, 1799 bp, Glycine max
attcggctcgaggtgtgatactttcctttcatcttcttcttctctctgcgataaaagcaaaacctaaaatttggtttaggcataggaatctgttgtagagttgatctacctggaatggagggagcatcgtggaatagtagtgtttgtgtggcaccgtttctgagcaagacctacgacatggttgatgatccttccaccgacttagtggtgtcgtggggcgaaaacaacaactcctttgttgtttggaacgttccccaattcgccacagacatcttgcccaatcattttaagcacaacaacttctccagcttcgtcagacagttgaatacttatggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagagcccaggcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcgcctgctgttttgggtttctgtagaagtcaggggatggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgcttttaaggccaagcccacttacagaaggcacagaggaaactaaatgtagctctctaggatgtggtttgactgatgatcagggtttgccttcagaaatgggaaataagcaggaaaattttgatacgatactacatgttgaccgtcttactcaacagatgggacttcatgcattggagtactgattgtgtgtatatatgttactcgcaactgaaggtaaactttttagcttgcagcctctcacttatgcataactttataagcatactggctctcttagttccctgaactgaaaccagtgtaaaatctcctgtcattgtcatcatacccaattgctgccattaaagagtgagaacagtgaggcagtaaatcaggagtgtttaaaacaattacagtgaatgtctacgaaaatgtctgatgtattatgatcttacatacacattattaggatagaaatttactacgtaacaaaaaa

SEQ ID NO: 2203 - protein, 464 aa, Glycine max
MEGASWNSSVCVAPFLSKTYDMVDDPSTDLVVSWGENNNSFVVWNVPQFATDILPNHFKHNNFSSFVRQLNTYGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQSPGFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGMETESSLLNHELNVMGADTRNMGEIDMMSTVLDEADEADHFSPDTDGISKLPEISDEFWELLLRPSPLTEGTEETKCSSLGCGLTDDQGLPSEMGNKQENFDTILHVDRLTQQMGLHALEY

SEQ ID NO: 2204 - DNA, 1819 bp, Glycine max
ggagggaagtggaagctagtagtccgtttcagcgtgtgtgatactttcctttcatcttcttcttctctctgcgataaaagcaaaacctaaaatttggtttaggcataggaatctgttgtagagttgatctacctggaatggagggagcatcgtggaatagtagtgtttgtgtggcaccgtttctgagcaagacctacgacatggttgatgatccttccaccgacttagtggtgtcgtggggcgaaaacaacaactcctttgttgtttggaacgttccccaattcgccacagacatcttgcccaatcattttaagcacaacaacttctccagcttcgtcagacagttgaatacttatggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagagcccatgcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcacctgctgttttgggtttctgtagaagtcaggggatggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgtttttaaggccaagcccacttacagaagacacagaggaaactaaatgtagctctctaggatgtggtttgactgaagatcagggtttgccttcagaaatgggaaataagcaggaaaattttgatacaatacaacatgttgactgtcttactcaacagatgggacttcatgcattggagtactgattgtgtgtatatatgttactcacaactgaaggttgaggtcccctttgctactgagcagacaaagccatcttacttatacaacaaagaaacctgacagatccaacaacttgatcggtgcttttatccgcttgtaatgtcgtcgtgtgttctgtttgtcattgggggcttaaaaacatacaagttcacgaaacttcatatatctccatgtattttgaattttaataactatgcccccgtttccaatgcgatgatatttttgtggggatgttccgtatacaaaaaaaaaa

SEQ ID NO: 2205 - protein, 464 aa, Glycine max
MEGASWNSSVCVAPFLSKTYDMVDDPSTDLVVSWGENNNSFVVWNVPQFATDILPNHFKHNNFSSFVRQLNTYGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQSPCFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGMETESSLLNHELNVMGADTRNMGEIDMMSTVLDEADEADHFSPDTDGISKLPEISDEFWELFLRPSPLTEDTEETKCSSLGCGLTEDQGLPSEMGNKQENFDTIQHVDCLTQQMGLHALEY

SEQ ID NO: 2206 - DNA, 1803 bp, Glycine max
gatactctcctcttatcttctgcttcttcttccttcttctctgagcgataaagcagcaaaaacctaaaattaggggtttatggagggagcatcgaggaatggtagtgtttgtgtggcaccgtttctgagcaagacatacgacatggtcgatgatccttccaccgactcggtggtgtcgtggggcaaaaacaacaacaccttcgttgtttggaacgttccccaattcaccacagacatcttgcccaaacattttaagcacaacaacttctccagcttcgtcagacagttgaatacttatggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagaagccaggcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcacctgctgttttgggtttctgtagaagtcaggggttggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgtttttaaggccaagcccacttacagaagacacagaggaaactaaatgtagctctctaggatgtggtttgactgaagatcagggtttgccttcagaaatgggaaataagcaggaaaattttgatacaatacaacatgttgactgtcttactcaacagatgggacttcatgcattggagtactgattgtgtgtatatatgttactcacaactgaaggttgaggtcccctttgctactgagcagacaaagccatcttacttatacaacaaagaaacctgacagatccaacaacttgatcggtgcttttatccgcttgtaatgtcgtcgtgtgttctgtttgtcattgggggcttaaaaacatacaagttcacgaaacttcatatatctccatgtattttgaattttaataactatgcccccgtttccaatgcgatgatatttttgtggggatgttccgtataattggatcataactcttgaattgctgttgaataactactgtttactgaagcta

SEQ ID NO: 2207 - protein, 464 aa, Glycine max
MEGASRNGSVCVAPFLSKTYDMVDDPSTDSVVSWGKNNNTFVVWNVPQFTTDILPKHFKHNNFSSFVRQLNTYGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQKPGFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGLETESSLLNHELNVMGADTRNMGEIDMMSTVLDEADEADHFSPDTDGISKLPEISDEFWELFLRPSPLTEDTEETKCSSLGCGLTEDQGLPSEMGNKQENFDTIQHVDCLTQQMGLHALEY

SEQ ID NO: 2208 - DNA, 466 bp, Oryza sativa
gtgtgcgagcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagctagctagctactatggc

SEQ ID NO: 2209 - protein, 141 aa, Oryza sativa
MEDDKSKEGKSSSSYRGVRKRPWGKFAAEIRDPERGGARVWLGTFDTAEEAARAYDRAAFAMKGATAMLNFPGDHHHGAASRMTSTGSSSSSFTTPPPANSSAAAGRGGSDRTTDKVELECLDDKVLEDLLAETNYRDKNY

SEQ ID NO: 2210 - DNA, 393 bp, Zea mays
atggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcgccatgaagggcgccacggccgtgctcaacttccccgccagcggaggatcgtcagctggcgcggctcccggcggccggaccagcggcggctcctcctcgtccaccacgtcggctccggccagcagggggagggcccgtgttcccgactcggagaaggtggagctggagtgcctcgacgacagggtcttggaagagctgctcgcggaagacaagtacaacaagaactaa

SEQ ID NO: 2211 - protein, 130 aa, Zea mays
MEDDKKEGKYRGVRKRPWGKFAAEIRDPERGGSRVWLGTFDTAEEAARAYDRAAFAMKGATAVLNFPASGGSSAGAAPGGRTSGGSSSSTTSAPASRGRARVPDSEKVELECLDDRVLEELLAEDKYNKN

SEQ ID NO: 2212 - DNA, 477 bp, Zea mays
tacgtccgatccacagccatcatcgccacccgcgcgcttatggatggcgagtggtccaaggacggcggaggcggcgagccgaccaagtaccgcggcgtgcggcgtcggccctggggcaagtacgcggcggagatccgcgactcgagccggcacggcgtccgcatctggctcggcacgttcgacaccgccgaggaggccgccagggcgtacgaccgctccgccaactccatgcgcggcgccaacgccgtgctcaacttcccggaggacgcgcccgcctacgccgccgccgcctcccgtggctccgccggcggatcctcgtccagaccggcgggctccggccgggacgtgatcgagtttgagtacctcgacgacgaggtgctgcaggagatgctcaggagccaggagccgtcggcggcggcggcgcagaagaagaagtagcgcgagcgccacaggtggcgaaacggccgcttttccaaa

SEQ ID NO: 2213 - protein, 132 aa, Zea mays
MDGEWSKDGGGGEPTKYRGVRRRPWGKYAAEIRDSSRHGVRIWLGTFDTAEEAARAYDRSANSMRGANAVLNFPEDAPAYAAAASRGSAGGSSSRPAGSGRDVIEFEYLDDEVLQEMLRSQEPSAAAAQKKK

SEQ ID NO: 2214 - DNA, 717 bp, Glycine max
ctaacacacataacaataacttagcaacattttttccttccttctttctttctttctatactttttgttgttaattctaagttctaagagaagaaaaatggagggtggaagatcatcagtttcaaatgggaatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtgttagtcactggcatgaaataaaatgcaaagaaatattgttgattttatttaatatattttgtttgatttttttttttttttttgtagctgatcaaagttcttcgaaatga

SEQ ID NO: 2215 - protein, 158 aa, Glycine max
MEGGRSSVSNGNVEVRYRGIRRRPWGKFAAEIRDPTRKGTRIWLGTFDTAEQAARAYDAAAFHFRGHRAILNFPNEYQSHNPNSSLPMPLAVSAPPSYSSSSSTSNYSGDDNNNHLVRPAFSGEIMQGGDHDDDTFELEYFDNKLLEELLQMQDNRHF

SEQ ID NO: 2216 - DNA, 609 bp, Glycine max
tttctttctttctatactttttgtggttctgattattaagttctaagagaataacaatggagggtggaagatcatctgtttcaaatgggaattgtgaggttcggtatagagggattagaagaaggccatggggcaagtttgcagcagagattcgtgaccctacgaggaaagggacaaggatatggcttggaacatttgacactgcggaacaagctgctcgagcttatgatgctgctgcttttcattttcgtggtcatagagcaattctcaacttcccaaatgagtaccaatctcataatccaaactcttctttgcctatgcctctaattgtgcctcctccttcttattcttcttctttcacttctaattattctgctgatgataataaccaccttgtgagacctggagaaataatgcaaggtggtgatcttgatgacacttttgagttggagtacttggataataagttgctcgaggaactccttcagatgcaagataacagacacttctaaaagtaaaatataacacaagccagctatgttgtgttagtcactggcatgaaataaaatgcaaagaaatattgttgattttatttaatatattttgttt

SEQ ID NO: 2217 - protein, 151 aa, Glycine max
MEGGRSSVSNGNCEVRYRGIRRRPWGKFAAEIRDPTRKGTRIWLGTFDTAEQAARAYDAAAFHFRGHRAILNFPNEYQSHNPNSSLPMPLIVPPPSYSSSFTSNYSADDNNHLVRPGEIMQGGDLDDTFELEYLDNKLLEELLQMQDNRHF

SEQ ID NO: 2218 - DNA, 440 bp, Glycine max
aaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaa

SEQ ID NO: 2219 - protein, 138 aa, Glycine max
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 2220 - DNA, 1096 bp, Glycine max
ggccactctctctctttaacctgcctcaccaactcgcatctagaagcaattatagggtctttctctcttctctctctatgttctgtcccctctactttggagtcaaaagcctataaaaccacacccaaacttcctcttgagccggcttcttaatttgttgctgcaagccaatcctaattcctattctcctatccttttacataactctaaagtaagaaaaaatagagcaatttcacaacacaactcttagaattgtgagttaagtatgggaaggtccccttgctgtgagaaagctcacacaaacaaaggtgcatggactaaagaagaagatgacagactcatatcttatattcgagctcacggagaaggctgctggcgttcactccccaaagccgccggccttctccggtgcggcaagagctgccgtctccggtggatcaactacctccgccccgacctcaaaagaggtaactttaccgaagaagaagatgaactcatcatcaaactccacagtctcctcggtaacaagtggtctttgatagctggaagattgccggggagaacagacaatgaaataaagaattattggaacacgcacataagaaggaagcttttgaacagaggaatcgaccctgctactcataggccactcaacgaagctgcttctgctgcaactgttacaactgccaccactaatatatcttttgggaaacaacaagaacaagagacaagttctagtaacggaagcgttgttaaaggttccatcttggaacgctgccctgacttgaaccttgagttaaccattagtcctcctcgccaacaacaacctcagaagaatctttgttttgtttgcagtttgggtttgaacaacagcaaggattgtagctgcaacgttgccaacactgttactgttactgtcagcaacactactccttcttctgctgctgctgctgctgctgctgcttatgatttcttgggcatgaaaaccaacggtgtttgggattgcacccgcttggaaatgaaatgaaaattcaacgaaattataccaattagttagtgtttttggagagaagtcgagagaatgaaattcattaat

SEQ ID NO: 2221 - protein, 253 aa, Glycine max
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAASAATVTTATTNISFGKQQEQETSSSNGSVVKGSILERCPDLNLELTISPPRQQQPQKNLCFVCSLGLNNSKDCSCNVANTVTVTVSNTTPSSAAAAAAAAYDFLGMKTNGVWDCTRLEMK

SEQ ID NO: 2222 - DNA, 1172 bp, Glycine max
ctttaacctgtctcaccaactcgcatctagaagcaattagggtctcccttttctctctatgtctcctttggagtcaaaagcctataaaaccacacccaaactccctcttgagccggcttcttaaatatttgttgctgcaagctagccaatcctaattcctattcctatccttattactacataactctaaagtaagtaagaaaaatagagcaatttcacaacacaacacaactcttataattgtgtgagttattaattgagtatgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgttaatttttgaattttctctcctattttttcttttttttcttctcttatttgtataaataattagtcgctgatatgcataatatatagtaacggtacagttgaaca

SEQ ID NO: 2223 - protein, 246 aa, Glycine max
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAATAATVTTNISFGKQEQQETSSSNGSVVKGSILERCPDLNLELTISPPRQQQQTQKNLCFVCSLGLHNSKDCSCNVSNAVTVNNTTPSSAAAAAYDFLGMKTSGVWDCTRLEMK

SEQ ID NO: 2224 - DNA, 1082 bp, Glycine max; identical to SEQ ID NO: 702

SEQ ID NO: 2225 - protein, 179 aa, Glycine max
MSRSSAMHGITSTNNKLKGVRRRKWGKWVSEIRVPGTQERLWLGTYATPEAAAVAHDVAVYCLSRPSSLDKLNFPETLSSYSVQLRDMSPRSVQKVASDVGMDVDARNIVAGKTSTVGAETNCESDERTSTASVCNVVGEGGADHSDVFWWDDDGGSWHGSGGDSTERDALSISIEDYL

SEQ ID NO: 2226 - DNA, 687 bp, Oryza sativa
atgccttttgtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgacgctcaacttcccggagcgcgcggcggccacgtacggcggcggcgccgccgtggcgcgcctgtcgccgcggtccgtgcagcgcgtggcgtccgacgccggcatggccgccgacgcgcagctcgtggcggcgcgggacgccgcgcccgcgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 2227 - protein, 228 aa, Oryza sativa
MPFVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATLNFPERAAATYGGGAAVARLSPRSVQRVASDAGMAADAQLVAARDAAPAPAPATAYARPDHCAGATTARHDELARRGMYGAHAHAAGANARTSGERQLVCAEEISVDDMEILM

SEQ ID NO: 2228 - DNA, 656 bp, Brassica rapa
cccacgcgtccgatggattacatcgacaacaccgtcgaaactcaatcaaagtacaaaggcatccgtcgccggaaatgggggaaatgggtatcggagattcgagttccgggaactcgcgaccgtctctggttaggctcattctccacggcggaaggcgcagccgtggcgcacgacgtggctttctactgtttacaccaaccaaactcgctcgaatctctcaacttccctcacttgcttcctccttccattgtttccaagacttcgccgaggtctatccagcaagctgcttctaatgccggaatggccgttgacgccggaatcgttaacagctgtgatcacgcgtcagggaactctgggaatggagatacaacgacggcgtattgtgagaatggaggtgcgttgaatatatcagtgtatgattatttggacggtcacgatcacgtttgaacttcatcttcttgttttttcgtttaaagatacagctactcaaaagaagcagtgatggagcctggtgtgtaagcaagcaaaacgttgtgaatatatataccggtatgtttcgctgttggcccaatgcaagaaacttttgtagtacgaatatatatattttattttgaatgccttcaagaggattataatgcgagtgaagctttgtttca

SEQ ID NO: 2229 - protein, 144 aa, Brassica rapa
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 2230 - DNA, 649 bp, Brassica oleracea
cagccgcataacatattactattccccctggtcatatctttgacttttatttttatttgctctaacctaaaagtattatataagtattgcacaattcatacaatcggaattgactttcttctcctccaatcgtatttttattcaacagttcctctcaagatcatcaactcaaaaaatggatcctagagacggcggagaaacccatcaggccaagtacaaaggcatccgtcgccggaaatggggaaaatgggtatcggagattagggttccagcaactcgtgaacgactctggttaggctctttctccaccgccgaaggagctgcggtagcccacgacgtcgctttttactgcttgcaccgaccatcttctctcgacaacgaagcttttaacttccctcacttgctgcaaccttcccttgcctccaacacatctcctaagtccatacaaaaagctgcttcggacgcaggcatgggcgtagacgcaggattcgccctaaacaacgacagcgcgagtggtggcgtggaggaaggcaccgaacgggaaacgttgaacatctccgtgtacgattatctagacgacggtcgcatttgatatattggtttatatctacgagcaccttatattagtaattaatataggatgtgaata

SEQ ID NO: 2231 - protein, 138 aa, Brassica oleracea
MDPRDGGETHQAKYKGIRRRKWGKWVSEIRVPATRERLWLGSFSTAEGAAVAHDVAFYCLHRPSSLDNEAFNFPHLLQPSLASNTSPKSIQKAASDAGMGVDAGFALNNDSASGGVEEGTERETLNISVYDYLDDGRI

SEQ ID NO: 2232 - DNA, 495 bp, Zinnia elegans
attcgcggccgcgaatatgagtaccagctcagatgaaggtaacaactgtttaagccaaaagacttacaaaggcgttaggtgccgacgatggggcaaatgggtgtcagagattcgagttccaggaagtcgagaacggctctggctaggcacgtactctacgcctgagggtgcagctgtggctcatgatgtagcctcgtactgtttaaaagggaatacgtcttttcataaacttaatattccgtctatgttacctccgacagcacggacagacctatctcctaggtccatccaaaaggctgcgtctgatgctggtatggccatagacgcacggtttatcgcgtctagagataccacaccgactaatgaggcgttgaacatttctgtagatgattatctttaaattttgagaactaatattgtgtcaccaatattgtaagtcgatctacattggcaaacacaatgtacgtgtttggtggcacttccagattattgttt

SEQ ID NO: 2233 - protein, 127 aa, Zinnia elegans
MSTSSDEGNNCLSQKTYKGVRCRRWGKWVSEIRVPGSRERLWLGTYSTPEGAAVAHDVASYCLKGNTSFHKLNIPSMLPPTARTDLSPRSIQKAASDAGMAIDARFIASRDTTPTNEALNISVDDYL

SEQ ID NO: 2234 - DNA, 594 bp, Oryza sativa
atgggccgggtggcggcgagcggcggcggcggcggcggaggggagatgatgaggtacaggggcgtgcggcggcggcggtgggggaagtgggtgtcggagatccgggtgcccgggacgcgggagcgcctgtggctcggctcctacgccaccgccgaggccgccgccgtcgcgcacgacgccgccgtctgcctcctccggctcggcggcggccgccgcgccgccgcaggcggaggcggcgggctcaacttccccgcccgcgcgctcgccgcggcggcggccgcctcctcctacggcggcgccggcggtctcctgtccccgcgctccgtgcagcgcgtggcgtccgacgccggcatggccgccgacgcgcagctcgtggacctgcgccgcgaccacccgcccgccgccgccgccgcctcatcctccggcagcggcgtggcgggagacggtgcaagaaagcaagggacacgtggcgaggttagcgacacgtattggtgtaggaatggagaggatgggagcagaagccggagctccgggagtgaggagctcattgtttacgagggcttaagtgtagatgacatggaaattttgatgtaa

SEQ ID NO: 2235 - protein, 197 aa, Oryza sativa
MGRVAASGGGGGGGEMMRYRGVRRRRWGKWVSEIRVPGTRERLWLGSYATAEAAAVAHDAAVCLLRLGGGRRAAAGGGGGLNFPARALAAAAAASSYGGAGGLLSPRSVQRVASDAGMAADAQLVDLRRDHPPAAAAASSSGSGVAGDGARKQGTRGEVSDTYWCRNGEDGSRSRSSGSEELIVYEGLSVDDMEILM

SEQ ID NO: 2236 - DNA, 702 bp, Oryza sativa
atggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgaccgctcaacttcccggagcgcgcggcggccaccgtacggcggccgccgtggcgcgcctgtcgccgcggtccgtgcagcgcgtggcgtccgacgcggcatggccgccgacgcgcagctcggcgtgccgggacccggcccggcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 2237 - protein, 233 aa, Oryza sativa
MADLPCIYIRVVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATAQLPGARGGHRTAAAVARLSPRSVQRVASDAAWPPTRSSACRDPARPAPATAYARPDHCAGATTARHDELARRGMYGAHAHAAGANARTSGERQLVCAEEISVDDMEILM

SEQ ID NO: 2238 - DNA, 929 bp, Arabidopsis thaliana
cttgaaaaagaatctacctgaaaagaaaaaaaagagagagagatataaatagctttaccaagacagatatactatcttttattaatccaaaaagactgagaactctagtaactacgtactacttaaaccttatccagtttcttgaaacagagtactctgatcaatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgatacgacgaccacgaatcatggcctggacatggaggagacgatggtggaagctatttatacaccggaacagagcgaaggtgcgttttatatggatgaggagacaatgtttgggatgccgactttgttggataatatggctgaaggcatgcttttaccgccgccgtctgttcaatggaatcataattatgacggcgaaggagatggtgacgtgtcgctttggagttactaatattcgatagtcgtttccatttttgtactatagtttgaaaatattctagttcctttttttagaatggttccttcattttattttattttattgttgtagaaacgagtggaaaataattcaatac

SEQ ID NO: 2239 - protein, 213 aa, Arabidopsis thaliana
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 2240 - DNA, 803 bp, Arabidopsis thaliana
ctgatcaatgaactcattttctgccttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctattaaaattcgatttttatttccatttttggtattatagctttttatacatttgatccttttttagaatggatcttcttctttttttggttgtgagaaacgaatgtaaatggtaaaagttgttgtcaaatgcaaatgtttttgagtgcag

SEQ ID NO: 2241 - protein, 207 aa, Arabidopsis thaliana
MFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 2242 - DNA, 908 bp, Arabidopsis thaliana
  misc_feature (851)..(851): n is a, c, g, or t
cctgaactagaacagaaagagagagaaactattatttcagcaaaccataccaacaaaaaagacagagatcttttagttaccttatccagtttcttgaaacagagtactcttctgatcaatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaaaactcagattattatttccatttttagtacgatactttttattttattattatttttagatccttttttagaatggaatctncattatgtttgtaaaactgagaaacgagtgtaaattaaattgattcagtttcagtat

SEQ ID NO: 2243 - protein, 216 aa, Arabidopsis thaliana
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 2244 - DNA, 632 bp, Brassica napus
cacccgatataccggggagttcgtctgagaaagtcaggtaagtgggtgtgtgaagtgagggaaccaaacaagaaatctagaatttggcttggaactttcaaaacagctgagatggcagctcgtgctcacgacgtcgctgccctagccctccgtggaagaggcgcctgcctcaattatgcggactcggcttggcggctccgcatcccggagacaacctgccacaaggatatccagaaggctgctgctgaagccgcattggcttttgaggctgagaaaagtgatgtgacgatgcaaaatggccagaacatggaggagacgacggcggtggcttctcaggctgaagtgaatgacacgacgacagaacatggcatgaacatggaggaggcaacggcagtggcttctcaggctgaggtgaatgacacgacgacggatcatggcgtagacatggaggagacaatggtggaggctgtttttactggggaacaaagtgaagggtttaacatggcgaaggagtcgacggtggaggctgctgttgttacggaggaaccgagcaaaggatcttacatggacgaggagtggatgctcgagatgccgaccttgttggctgatatggcagaagggatgctcctgcc

SEQ ID NO: 2245 - protein, 208 aa, Brassica napus
HPIYRGVRLRKSGKWVCEVREPNKKSRIWLGTFKTAEMAARAHDVAALALRGRGACLNYADSAWRLRIPETTCHKDIQKAAAEAALAFEAEKSDVTMQNGQNMEETTAVASQAEVNDTTTEHGMNMEEATAVASQAEVNDTTTDHGVDMEETMVEAVFTGEQSEGFNMAKESTVEAAVVTEEPSKGSYMDEEWMLEMPTLLADMAEGM

SEQ ID NO: 2246 - DNA, 20 bp, artificial sequence
  Arabidopsis thaliana
  misc_feature (3)..(18): y = c or t;  n = a, c g or t;  h = a, c or t;  m = a or c
cayccnathtaymgnggngt

SEQ ID NO: 2247 - DNA, 21 bp, artificial sequence
  Arabidopsis thaliana
  misc_feature (3)..(18): y = c or t;  n = a, c g or t;  h = a, c or t;  m = a or c; r = a or g
  misc_feature (3)..(18): y = c or t;  n = a, c g or t;  h = a, c or t;  m = a or c;  r = a or g
ggnarnarcatnccytcngcc

What is claimed is:

1. A transgenic plant that has an improved trait relative to a control plant, wherein the transgenic plant comprises an expression vector or cassette comprising a recombinant polynucleotide that encodes a polypeptide; wherein the polypeptide comprises a conserved domain that is at least 87% identical to amino acids 65-137 of SEQ ID NO: 594;
   wherein the polypeptide is at least 79% identical over the entire length of SEQ ID NO:594;
   wherein said control plant does not comprise the expression vector or cassette; and wherein over-expression of the polypeptide in the transgenic plant confers to the transgenic plant an improved trait selected from the group consisting of greater yield and greater tolerance to cold, relative to a control plant.

2. The transgenic plant of claim 1, wherein the polypeptide is at least 85% identical over the entire length of SEQ ID NO: 594.

3. The transgenic plant of claim 1, wherein the polypeptide comprises a conserved domain that is at least 95% identical to amino acids 65-137 of SEQ ID NO: 594.

4. The transgenic plant of claim 1, wherein the polypeptide is at least 95% identical over the entire length of SEQ ID NO: 594.

5. The transgenic plant of claim 1, wherein the polypeptide comprises SEQ ID NO: 594.

6. The transgenic plant of claim 1, wherein the transgenic plant is more tolerant to a six hour exposure to 4°-8° C. during its growth than the control plant.

7. The transgenic plant of claim 1, wherein the recombinant polynucleotide further comprises a constitutive, inducible, or tissue-specific promoter that regulates expression of the polypeptide.

8. The transgenic plant of claim 1, wherein the transgenic plant is a corn or maize plant.

9. A leaf, stem, flower, fruit or plant tissue of the transgenic plant of claim 1, said leaf, stem, flower, fruit or plant comprising said expression vector or cassette.

10. The plant tissue of claim 9, wherein said plant tissue is ground tissue.

11. A method for producing a transgenic plant that has an improved trait relative to a control plant, the method steps comprising:
   (a) providing a recombinant construct encoding a polypeptide that comprises a conserved domain that is at least 87% identical to amino acids 65-137 of SEQ ID NO: 594; wherein the polypeptide is at least 79% identical over the entire length of SEQ ID NO: 594; and
   (b) introducing the recombinant construct into a target plant to produce a transgenic plant; wherein when the polypeptide is over-expressed in a plant, the polypeptide confers an improved trait that is selected from the group consisting of greater yield and greater tolerance to cold, relative to a control plant that does not comprise the recombinant construct.

12. The method of claim 11, wherein the polypeptide is at least 85% identical over the entire length of SEQ ID NO: 594.

13. The method of claim 11, wherein the polypeptide comprises a conserved domain that is at least 95% identical to amino acids 65-137 of SEQ ID NO: 594.

14. The method of claim 11, wherein the polypeptide is at least 95% identical over the entire length of SEQ ID NO: 594.

15. The method of claim 11, wherein the polypeptide comprises SEQ ID NO: 594.

16. The method of claim 11, wherein the method further comprises the step of:
   (c) identifying a transgenic plant by selecting a transgenic plant that overexpresses the polypeptide relative to the control plant.

17. The method of claim 11, wherein the recombinant construct further comprises a constitutive, inducible, or tissue-specific promoter that regulates expression of the polypeptide.

18. The method of claim 11, wherein the transgenic plant is a corn or maize plant.

19. A transgenic corn or maize plant that has greater yield than a control corn or maize plant, wherein the transgenic corn or maize plant comprises an expression vector or cassette comprising a recombinant polynucleotide that encodes a polypeptide;
   wherein the polypeptide comprises a conserved domain that is at least 87% identical to amino acids 65-137 of SEQ ID NO: 594, and wherein the polypeptide is at least 79% identical to SEQ ID NO: 594;
   wherein said control corn or maize plant does not comprise the expression vector or cassette; and
   wherein overexpression of the polypeptide in the transgenic corn or maize plant confers to the transgenic corn or maize plant greater yield.

20. The transgenic corn or maize plant of claim 19, wherein the expression vector or cassette comprises a constitutive, inducible, or tissue-specific promoter that regulates expression of the polypeptide.

* * * * *